United States Patent 9,487,797 (GENOMIC PLANT SEQUENCES AND USES THEREOF) - sequence listing, part 56

SEQ ID NO: 68667 - DNA, 9371 bp, Oryza sativa
ttttggaataaggaattgatttatggaacaagggaaaaggatttattaaatccctgggaaaagaaaatggatgagggacgtgaattagacttcctcaggtggcattggtgcggcccaagggttgaagggggcttggccgagccatttgggccggcgcggtcgcgggaaaggcggcccattagggcgcgcgggagggagagggggcggtccggtggaccgggtgcacctcgcggggtcccgggtggggcccacatgtcggcggcaaggctcacggtggggagagcgcacgcgggtgcggtgctagggtttggtgggtgcggtgtgcgggcggtgcgccgggtggattggatggcagcgggcccacatgcagccggttggcgcaccgtggaccgcgcgcacgggagggggggaggaaggaggcggctgaccggctcggctcggtcaaagccgaggtggcgccgacgtggcgcctacgtggcagccacgcgggccggcgggaggaggaagaaggggcggccgagatggacggtggacggcagccgagttcaccggagctcgtcgcgacgattcgagagagagggagtacaccggaacgatgggacggacgagaggaagtgagccaccggaccggattcgccggaaagaggccagaggcggcggattgcggcgacgcatgctggcggcgagaaaaaggggaaacggcggaggggcgacaaggattaaattcaaggtggtgggagtatctccggggttcaaggagttcatctccggcgtcggatggggcagagcgacgccgtggagatctggcgacgagcggcggcctccgggagcgagcggcgatggcggcaagcctatggcgggtggtggcgaggctaggggctttgtctacgcgcgttcgggaggactaccgagctaccgcgcgagctataggagggagagggcaagcgagaggggagaacggagggaggcactaccgagccgagacgggcgctgtgacgagcggccgacagcgcgggagcgagctctccggcctcgggccggggtaggggaagaagatgggcggccggagccctcttcggctccgcgcgcacgccggcttcccagcacacgcgagggcggaggaaggcgaggacggcggcagcaaggcggcgatggcactgcagcggtggagactgaagtgggagggatttgagagaagggagtcggctttatagtggaggcgaggtcggttcgcgcgggaggtcggttcaaaccgaccttagggcggtcagggcggcagctggcggtcgtgctcggagctagcggccaagcggcggcagaggcggtcacgggtgtgacgccaatcggggaaaaagcaaaaaggggagggagaaaggagctcggctccttgccgattttggacgagctgagggaggagagagcgcgtgggagagagaggtgctgcctccgcgtcttggacacacgcgcgctgcggcgcagaggtgggggcagcggcagagtgggcgcgggcggctgcgcggcgcaggcgggccagggcggacggtgaccgagggctgtcggccaccacggcgggagcgcgcgcgggaacgagcgaaggcggtggcgggttttgggcggcgacggcgggaaccggcgtcggcgcgcgagagagaaaacgagagagagagagagggagaaacagcgagagcgagagagctctttctctccgctcggcttggcacgtgcgagaggagggtggaggacggcagagggaggaaatgggccgaggggagggggaggagcggctgagaggagatgggccgaggagaaaacggcccacaaaaatccgagggaggcaaaatagactttttcagaggagattgatttggagagaaatggagagatttagggtttggattcgaattcaaatttgatattcaaactcgagggtttagggatgtatcaaggggaattcaaggagaagtcatgggaaagattcaaaaggaatacttgggtatttgttctcgggaacataggggagtcaaggaaggaaacaaaacgggggtttggacattttgggatttggaaatgtgtttggcgaggattcaaaggaagggattgactttcggatttagatttcggagacttgaattgggagaggagatttgaggcggaggattttgatttcgatgagagggaataacgggattaaattgagatcttggcacaacttagactcgcacacaaagaacgaaaattttcgcaattaggattttgccgaattagtttttaacgcctcacgaaaagcggagcgttacagctggccacgacttcggaaatggccggccggtcctccccctgcagccgcatgcagcgcgctgccgtctgcgccaccagctccgccgcctccagctgcctcgccgttggctccggcgtcggccgcctgtccaacaccttccacacgaccacacctcccctacctcgatgaacggcggtgtgacttcagccaagacggcggggattgcgttccgatcctcctccgaacagtcgaacaccttgtgcacgtcctcctcttggtaaaagagtgccctcatccccgtcaacacctccagcatcacgacgccgaagctgtacacgtcgatcgttggcttcgcgatcgctgtcgtggcgtactccaggtcgatgtatccgaacttgccatagaaagcatcggccggaacacttctcgtcgagtgatcgcagcggaccgacgcgccgaagtcagccaagcgccaaagcgtggcgcccaagtggcgtcgaacagcatgtttgacgagttgatgtcgcggtggatgatcaccggtcgctcgttgtagcactacaggtattcgatggctcgcgacacgcccagcagtgtctcgatgcgcatcttccagttcaatgacgtcctcaccggcgacgacgaggacgacggcggcggcgttgtaccgtgcaggtggtcgtgaagcgagccgttgttggtgtactcgtagacgatcaggcgctcctccaccttcttcatcttccggaacggtggaagaagctggcgcttctcctgttccagcacgcagctgccatagaagcagatgatgtgcttgtggcgaagggaggggaggatggtcacctctgccatgaattccttagctgttgtcccgtacgtctcgtccttgtgcgtgcgcttgatggccacctcgtctcgcccgtccggaagaagatatccaatgtacactgtgccgaagccgcctttaccgatctctctgtcagctgcaaagttgttggtggccgtcgcgagctccgcaaaggtgaatttctcaccttcgtctccatggagcaccacattttcttgcaactcctaggacgaagtaattgagtttctctctttagcaaagcaagcaagctagcacgaaaggtaaacaatttcagaaaagctcgatcgagtaacacagttttgtattgtacgtaccacctgatgagagtgggaggctgaagatggagacggcatagtggacatgtcgtttggaagaaggatgttgtagattcgatcgagacgacgagtgatgtagatgtggctgacgaaggggaagacgaggaggtacgatcgagtcgatcctgctctgaacttctctgaacttgtcagcttgccgcccggttgtcaccaaccatggtcatgccctgacaggacatcacaagctcgtgcgcctcccggagcgtgtcgccgagcccggccagcggccgccggacctccggcctccgcatcacctccggatcctgcaggtgcggcagcagctcggcaatcatgaacacgcggcgggcgagctgctcgcactccttgttctgctgagccgtcagcgccgccagcatgatcatggagattgttagatagatctccctccccttgagcccaacggcacaaggggccttgacacgcgccctgatcgggggcgcccagcccaatagctggtgggctcccgtcaccctgcgccatataaaagagaggtggaggccggggcggcacaagacacgaggttcgctgccaccgctaactccacccacaaaaccctaatccgatcgagagggggcgtagccagtgacgcaaagcttcaccgccgcgccacgcctcatagacgccgccgacggtcgtccacgccacgaccaccgacgccatcacgaccaccgtcgtcaccatccacgacaagcccgcgacgacaacgacgatggccggcacttcttcatcctccaacacctcaaccggtcggtctctaaaccctctcgtttcatctctatattgttgttcatccacccgatagaaccacctggctagatctaaacctaggcgatcctagagagaatcctaacagtggtatcagagcgagaaccctagtgtttatatcggttcggggaaagaaatccaaagaagacaagaaaagaaaagcaatgatccgaatggatcgaaaagaacgaaaccctaaccctaatcccttaccacgtcgccggtcattgtcaacgccagcaaaggggggagggcaaagggcaccgccttggggcccctcgatggctgtgcatgcacccacgggtgcacgcgcgtgccggcgagggggccgtggcggcgccgccatctccttcgtcgccgcctactctctctcactcggtggggctggtggcgcgttgggggagaagagaaaagaaggcgcggcggcgcgagggccgccggcatcggctgggccgaaatgagcccaagagggcgcgcgcgcaggagcgctttgccggcccaggcctaggttgcggttgcgcgcgcgcgcgcactcggccgtgggccagctttcctccgatgggccaaaatggcatcatgaacagtagcatttttcctttaaattttgtctattttcatgcaaatttcaacacaattttgaagcgattttgcatgctttacctctgtttaaaatttgatccaaaggagtaattttttacagagtgtaaataacagaattgctactgttcatatgtattttataaagttattccgctacaaatagataaaattgatgaaaattagtgtttctaaaattaaatttcgaaccaacgggagaatttaattttaggaacattaattctgtgctatgatgttgtaattttctgaccaacgttgataattgcaatgttatagttatagctttatatgttatgtctatttttacccaacggtgatgtaggcttaatgcataatatttttaatgttaattttgctctcaccgtacatgattatttcaggtggctactgcttgatgggttgcattaaagatattccgaccctgaagggagataactacgcagaatggaaaagaaaactcgacattgctttcatcttgggagaggtggactgggtgttgactaccccatgtcctatagaacctgctgcacttgtcagagttgaaaatgagtcagatgctgactggcaaagaagacagagggacaatgctcccctcataatgtcgtattacattgagcaaaagaaatggtccttagtcaacaagaaatgtttggctgtggtaaagaacacgattgagccaaccttattgggctcaatcccagagtgtgacaccatctctaagtaccttgaaagaataaagagccaatttactggttcttcaaagacttatgctacacagctaataaagcagcttgtgacagaaaggtaccatggaggtggtgtaagagaccacattcttaggatgagcaacatggcttccaagttgaagccaatggatttgggcatctcagatgactttcttgtccatttggttatggcctcattgccaaagcactttgacaactttgttgtcaactacaatataagtccagagaaatggaactttgaaaagctcatcgctaattgtgtgcaagaggaggaaagaatcaaagagtccaatggagactctattaactatgttaaagataacaagaaaaagaactacaagtcaccctcctcaaaagcaaaacagcctcagcatctgccttagcaacaacagttcactgttgaaaaggatcagtgtctccactgcaagaagacagggcattacaagaatgattgtcctgacttcctgaaaataatcatggcaaagaaaggtgagaacattattacatttgtaaatgaatctcattatgttggttattccagatccacatggtggattgattctggagcaactattcatgtgtctaattgtttaaagggattccgttcgacgagaactacgtaaagaagcgaaagctccattagagtcgccaatggagttgaagcaaaagttgaagctgttggagatcttcgcctagagctcgcgaatggcttcacacttttacttagagatgatttttatgttccttctttgcaaagaaatttaataagtgtatcgaaattggatttcggtggataggattgccattttggaaatggaaaatgtaaactatggtataataatgcatgtattggtcttgctgtgttgcaagacgagctttatttgttatctcttcctgagaatgtgaatgttgtgtcctcgttgacaaaagaaaacaagaaaagaaagagaactcctgatgtctcatcgaaattatggcactgtcgtttaggccatatttcaagggggagaattgagagactagttaagaatgaaattcttcctccattagagttatcagatttagaacaatgcattgaatgcattaaaagaaaatttgtaaagagcataaaaaagtgtgcaaaacgaagcgtaggaattttcgagatcattcacacagatatttgtggtccatttcctgtgaaaagtgtagatggctatgactcgttcataacattcacagatgattactcccgatatggttatatttattcaattaaagaaagatcagaagcattggataaatttaagatattcaaagctgaagttgaaaatcagcatgacataaagattaaagtagtaagatctgaccgtggggggagtactatggtcggcatacgccttatgggcaattccatggaccttttgcaaggttcttgctagagaatggtatagtagcccagtattcaacaccaggtgaacctcaacagaatggggtagtgaaaggtgtaaccgtacccttatggatatggtgcgcagcatgatgagctactccaccttaccattgggtttatggatggaggcattaaaaacctcaattcatatcctcaacatagttccaagcaaattggtgcccaaaacaccgtatgagctatggacaggaagagtaccctcgctagctcacctccatgtgtgggggagtcctgcagaggctaaaatatttaacccaaaccttgggaaattggatcccaaaacagtaagctgtcattttattggctatcctgaaagatcgaagggttatcgtttctactgtccaaacagttatacaaagtttgtagaaatgagacacgccgtcttcttggaagacgaaatgattaggaggagctcggtagttcgagaaattgatcttgaggagaggcaggtgtctgtaccggctccgtcgactcaagagccttttttctctctacctgctgatgttgtgcctgcaatgcatgacgttgcggtactagcacctattgttacccctcctgtggcaacattgaatgaaagtgaggaacctgttctacaggattcaacaaaaattattgccatacaagaggaggaggtgcaacagcctcaaacagagaatgtgccaaatgtggaggcccctagaaggtctgaaagagtcagaagatcggctatctgtgatgactatgaagtttataatatagatagtcgcatatggaggatgatcccacctcatatgaagaggccatgagaagcgttcgctcatctgaatgattggaagccatgaaagatgaaatgaaatcaatgaaactaaacgatgtctgggatttagaagaaattcctaaaggagccaagacagtaggctgtaaatgggtctataaaaccaaatatgagtccagagggaatatagaaaagtttaagacgcggcttgtggcaaaagttttcacgcaaagagaagaaattgattacaatgagacattttctccagtctcttgtaaagattccttcaggattataatggctttggtggcacattatgatttggaattacatcagatggatataaaaacggtatttctaaatggagatttgaaggaaaaagtatacatggcacaaccgaaaggttttgtcgtgaaaggaaacgaaaatatgggatgtcgtctaaagagatccatttatggattaaaacaagcttcgagacagtggtacttgaagtttgatgggacaataaagaaatttgggtttcgagagaatattgaggacaactgtatttatacaaagtttaagaatgggagattcattttcctagttctgtatgtaaatgacattctactggctagtagtgatgtcagtgtactgcaggaaacaaagaaattcttgtcctcaaactttgacatgaaagacctcggtgaggcttcatatgttttgggcatagagattcaccgagacaaaacaaagtatgtattgggactttctcaaaagacatatatagaaaaggtgttgaagaaattcaacatgtacagatgcagtgccacacctgctcctatagtcaagggtgaaaagtatgggacatggcgatgtcccaaaaatcagtatgagctcaacgaaatgaaaacaaagccatatgcgtcagctgtgggaagcctacagtatgcgtaagtgtgcacacgtcctgacttggcatttatcaccgggttacttggcagatttcagagtaatccaggcccagagcactggaaattggtaaagaaagtcttgcgttatttgcaaggtacaaaaggcctcatgttgtcttatagaagatcagagccgctccggatagtggggtattcaggttctgattttgcaaaagataatacaaagtcaacatcaggatacgtgttcacccttgcagggggagctatttcatggaaaagctccaaacagactatcactgcagggtctactatgtatgccgagtttatagcatgctatgaggccacggggcaggtaaactagcgaaagaagttcatacccggtttaaaggtggttgacagtattgagaaaccactaaagttatgctgcgacaacgaacccacagtaatgtacgctcacaacaatcagtcaagtggtgctgccaaacacattgacataaagtactattttgtgaaggacaaagtccgggattaaacaatcagtctcgagcacattagaacagaaaggatgctcgtggatccgctcacgaaaggcctaccacccaacgtgttcaaggaacat

SEQ ID NO: 68668 - DNA, 1368 bp, Oryza sativa
cgattgaacgtgaacgagctagggaacatgaacgagcgaacgaacgaggacgaacgttaacgtgaaatgcaatatatatatatatatatatatatatatatatatatatatatatatatatatatatatatgttacttcgctataatcctaatacatctttttgtatcttgcagaaaagacgtgttgtcggagtcgtccgtcaagcctgagtggaagagctagccctagaaggaattggagcaggcaagtgatgtaataatataaatgattgttatatttgtaatgcaattaattaagattattagacctgtaattggacttatcatataagattgtgtagtgttctaatattatttgagttttaatataagattactttatttgtaattagacttagtatgtataattattgactacggaattggggcgacaagtagcaattgactattgtagtcttaattagacttagcatatacgcacgaaacacttagcatagatgactattttagtcttagcatgtaatattattggagttttaatataagattactttatttgtaattagacttagtatgtaattattgactatggaattggtgcgacaagtagcaattgactattgtagtcttaattatacttagcatatacgcacgaaacacttagcatatacatgactattttagtcttagcatgtaatattacttgagttttaatataagattactttatttgtaattagacttagtatgtaattattgactacggaattggtgcgacaagtagctattgactattgtagtcttaattagacttagcatatacgcacgaaacacttagcatatacatgactattttagtcttagcatgtaatattatttgagttttaatataagattattttatttgtaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaatgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaatgaggtgcagcgaag

SEQ ID NO: 68669 - DNA, 20591 bp, Oryza sativa
atcaataacttgtttaaaccgggcgaatttaccccctgagccaatttaaaaggggttttcatctaaggtggacacgtgccagttgggacgggtttttgttctatatggcactttttgggtaaaaaaaacgctattcatcactatttaattttattttattcatcactatttatttttacaaaaaacctattcatcactatttaatttaattttattcatcactaataatttttacccctgaactattgcgtcgatcgaattacccccataaacttgaataccagatatttcacatcataaacttttaaaaccggacgaattacccctgactcaatttagagtggttttcatcctacgtgtacacgtggcagttcggaacggttttgttctatatggcactttttgggtaaaaaaacgctattcatcactatttaattttattttattcatcactatttatttttacaaaaaacctattcatcactatttaatttaattttattcatcactaataatttttacccctgaactattgcgtcgatcgaattacccccataaactcgaataccagatatttcacatcataaacttttaaaaccggacgaattacccctgactcaatttagagtggttttcatcctacatgtacacgtggcagatcggaacggttttgttctatatggcatacatgtgatgctaacgtggcaatccaatcccaaaaaaaagttaacaaggccccacatgtcatatagagtagtactaaactctctctctctctctccttccctccgacgtcgtgggcgcggcgtggagcggagccaaacgcgatggaaacaacaggaatggcaggtggagccgaggagccgtgctcaccggtgaagaccaaggatctgtgcgccggcggatccagaggaggagccatgcgctagaggcggaatcgaggactcgtcgccacatcgccatcgcccctagccttggcagcgtccgccgcttccactatcctctgcgcggcccaccggccaccgcgccctcaccacgtttccgcctcccgccacctccactatcctcctcggcgccccaccgcccaccgcgccctcccagcgacgctgccgcccaccgcccgtgccgtcccctcctcctcctccccccccccccctctcccccgcgccccggcgtttgaccagtgcaaagaagaatgatcgtgcacacgtacacgcgccacccatacgaaagctatactccaaccaaacgtcaggccacaactgttggacggactcccccgcgcgtgtcagagatgtcgggtttcgggtctagggggtattttgtactcacacaatagtttaggaagttgatttggactttttcggaaaaaaatatgacagtgggtctagacactatttctctctttttcaaacacaaataaatattttgatttgtagagtgtctagtaataaataatcatactttgaggatttatttctccaaggatcgatttttctcatgtccatgaactatgaccactaattcgtgtcctaccttttttatgtcctctaccaaattacaaacttaagtatcatgaaccaaaatttaccttattaataacgtcaacaattaggaaaaatagagttttttttaatgttttatgacaagttaaacatgtataatgaaatttttcatgatgaattagtaaggacttcaaatgaaattcattctaaactaataatatcaacatttctaaaatacaacggggtttttaattgtcttagtaaattaacgtaaagaatttaattaatctataatttaattgccaaatatccgtagatgtaagtaactgcgtagcaaattaagcaagccttttgatttataaaaagggaacatttataaaaaggacagcaacggcggagcaccccctgtcgaatagagcgcaagtgccttgcgtgctgcagctgaggcgcgctaaggacgctgatggccgggtgggcgcgccaccgcagctgcctcgccacggggtgcacgtatgttgcatggttgtatcgtccatgctacgtgcccttgagttgaggcacacgcctagaggtgcatgtggccgtggccgacaaaggtgcatggctgattatcgacgagcgtgtgtggcattcgcacactccactcaactggggaagctcgtctctactgagttcatagaggtggttgtcttcgtttgtgccggttgggaaactcttcctctggcacaggagaagtaacccattaacacataattaatcaagtactccctccgtattttaatgtatgatgccgttgacttttcgaccaacgtttgactattcgttttattcgaaatttttgtgcaaatatgaaaatatttatgtcatgcttaaagaacatttgatgacgaatcaagtcataataaaataaataataattacataaattttttgaataagaagaatggtcaaacgttggacaaaaagtaaacggcgttgcacattaaaatatggaggtagtattagttaaaactaacatgaaaaataaattagtataatctattataacaagttttctataatattttttttgtaaaaattatatcgtttagcagtttaaaaagtttacatgcataaaacaagagtgagcagttgggaacgtagcctcccgaacacaacttaaagtccttttagcttgtcttcctgtatttttggggaaaaaaagtaatatgaagttatctatttattcatcactatatttcaagaagaaaattaaatttatttttaactattctttattaatatttttttaattctaggccttttatctacttttttttgtgattatatatactatatgatattatcgacatgatgtggtcttttgtgggcaaccagaatcgatactaggctagtaaacagatgtgtggaagaaatcaccttatggcttaagggattgagggggtgttgatcgaggggtgtaaaattttagtgtgttacattgggtattatattgagtgtcgcatggggtgtttggacactaataaaaaaactaattacagaatccgttagtaaaccgtgagacaaatttattaagcctaattaatccgtcattagcaaatatttattgtagcaccacattatcaaatcatggagcatttaggtttaaaatatttgtctcgcaaagtagtcgcaatctgtgcaattagttatttttttctctatatttaatacttcatacaggtgtccaaacgttcgatgtgacagggtgtaaaatttttatgtgggaactaacagggcctaaaatgcgctgacaagattgtggtatcttcctgaaggaaaccttatcatccatgttaccttgtcatttgacttctaaattccaatcaaaattttggtgggaaacccctcctcctcctcccccccccccctcccccgcgccccggcgtttgaccagtgcaaagaagaatgatcgtgcacacgtacacgcgccacccatacgaaagctatactccaaccaaacgtcaggccataactgttggacggactcccccgcgtgtgtcagagatgtcgggtttcgggtctagggggtatttcgtactcacacaatagtttaggaagttgattcggactttttcggaaaaaatatgacagtgggtctagacactatttctctcttttgcaaacacaaataaatattttgatttgtagagtgtccagtaataaataatcatactttgaggatttttttttccaaggatcgatttttctcatgtccatgaactatgaccacgaattcgtgtcctaccttttttatgtcctctaccaaattacaaacttaagtatcatgcaccaaaatttaccttattaataacgtcaacaattaggaaaaatagagttttttttaatgttttatgacaagttaaacatgtacaatgaaatttttcatgatgaattagtaaggacttcaaatgaaattcattctaagttaataatatcaacattttaaaaatacaacagggtttttaattgtcttagtaaattaacgtaaagaatttaattaatctataatttaattgccaaatatctgtagatgtaagtaactgcctagcaaattaagcaagccttttgatttataaaaagggaacattttaaattgccagaacaaagtaaagcatctataaaaatgataagctcctcaaaagcccttccacatgaattagtttcagaaagcttgcaatagttccacacgaatacagttcaaatggatatttattacaggatcaaatatatagtgccaagcaggtctgatgatagtttacgtgtcaagcaaacagaacaggagacgaagataaaggccacagttttacaaagtcaatccaacataagattccagtgaccaattcaaatcctaatcttgatttctaactcttctgctcacagcttcccggacatgtacgttccacctacatgcatgattcaaaagcattcacgtcaaacccaaagtaaaatctctctaccagtttctatcatataaggtgtaatatggtgctaatcgattcattccatttcgcattagggaacaaacatttatatgtacctctctcagcaatctattccatttgtacaaaaaaaatcctccgaccgtcagcctctacaaaatctctgtgactcccctatccgcctctacaaaatctcgacaactgctgtaactccgggtgttcctgagttatttacaaattcgattaacagttgatatacataattgcgcgcactaattacaaattggattaacagttaatatacgtaattgcgcgcactaaataaggtatattaaaaatctctcacctcgaggagttcttgacagttctgaacgtgtaataaacgatgctcctccgtacggaatcgcacagcacatccgttctcagggcaggcagcaccataaagtccatgattttcgtaaacatgtttgattacctgcatagagagaaagacaaatttgtaaatttactttgttcataaataagtttatttctatcctctcacttttcttttagtaggaaggggtaaattaattaaataaaacatacatctttgcgacggatgactccatcccaaggaaatctgggtgctccttcgaagaagcacaaatgacataactcgaacttttctgagaattttgccctggcatcattgaattccttgtatttcttctttttctggtaaggattatccaaaacctaaaataatatggcaaaaataaatggtcaatttcatctaggggtggataaagaaaaggtttagggagtaacacatatcttctttctataaagctaatgatcactaatggccattcccaacccaagacactagacatagttttgacaaaccacacatcatcaagaaactagtactaggcactacgttttcaatgcaaacaccactattacatacttaaatttaatgctgcttagtatctcacgtgatgttttggatggtgtagaaaccaatggttccggccttctccttcctcatttattcacttgccacatcatttttcatactaagtgacagcttatttaatgatatggacactatcctagtcatttggttgggaatagcctaaacatctagagctcaacatgcaagcatagtatttattagcactcctaaaatctctaaacatatgcatggagcattaaatataaataaaatgaaaaactaattgcacggtttgcatgaaaatcgcgagatgaatcttttgagtctatttagtccatgattagccataagtgttacagtaaccctacatgtgccaatgacagattaattaggcttaataaattcgtctcgcggtttccatgcgaattatgaaatcaattttttttattcgtgtccgaaaaccccttccgatatccggtcaaacgtccgatgtgacaaaaaaaatttattttcgtgaactaaacaaggcctaagataaaaacacagggacagcgatgtttgcaacacatgtcccaattatttgagtggaacatcaacagaaccatccaaggacgtccccacgaacagaatgtatgataatccaagaggaccttaattagtacctggtcatctttcagatcgccgtcctgcggctgatcgtctccctcttcctcatccggctcctctttctttcttgccgtggcgagttggtacttccatgcatggttacctgtcgcgatgaaagcggcggcgcgcttgggtggtgctggtcctggctcggcggcgacgcgcggtgcagtcgaagtggtgcgccgccgaaacgcccatctcttcaacgcctcccaaacgcaatgcaggcaccctccgacgcgtcctcgtccatctggtgatgtgtcggatgtggacgacgacgccggcggtggcggtggcggtggcggtggcggacccggcacttctcggaggcgtgcaagatttcttgcccttcttcttgccatcgacgcggggcgcgaacggcggacggcggagagcactgcaggacgtgcccgccgcgcgtggcgaagaagggacggcggcgagcgcgcggatgaggcacgcctcctgtcgaacaggtagcgggcgcgcgccggcgaggatggctcgcttcggccggagcgtcacggcgaaggcgttgcaggacggagtcaccgccggggcgacaagcgacggcggcggaggtcgtttcttgggcgcggtggtggggaagtgcgcggcggcgagaggaggcggcgtcacggtgggaagcggcgatcggcgcggtggagggcgatttcttggagctcaagacccagaacacgaggttgttattataaccgccttctgcacggccgcctcgccgccgggaatccgtcctcattcggacgccagcttcggcgtctgggttcatccgccgctgctcagccgctcggtcggtcggtcgcacctggtgcgcgtgcggctcaaacgaagcaagccacagcaatggcgccgccgcggctgcgctccaagcttcgagaaggggcctgaggccctgagctcggtggaggccaagccaagctcatcctgttaaaattggttgctctttcaactagtacaagtcgtacttcattgcttggctggtgtacccgaatagctttcaatccgtatgtcctgtgttcgactcccgctctgtttaattttttttgtttttgatttagattttttttctgtcccctctattgtttttataataaataaaaacttccaaaatgctactagcaaattattctttttccttcatattttctactgtctgatacattattacactataatagggttcttttttttttcttctccttcctataatagggttctttccttctttttttttccatgccccatctaattcagttcaagctccgcaactaaggttgtgtgactattcattggtgcctctagctatatttcttgctcgtcggggtatttcgccgaacacaacgaaactcagcatatggtaggcctacgcttccaccaagcttgtagttcagcgccatacatgctcccatccacggcgcgtccacacgtatgtatgtacatggcacgaagatatatccattttcactggcggtcccttaggtgggccgccagcgaagattgattattttcgtaagcctttttttaagaaatccgcttgcaaaaatatccatatttttgctggcagatctcttaaacaatcgcgagcgaaattgaatttttgctggcgtgctgggggcagctaaaaccaacacacgaaaccccgcgcatcattttaaaacaagccacccctcccaccaacccccgcaccctcttttcttctcctctacgcccttctctccggccattctccggcgccatcaccgtcgcctccctccacgacgaagccgcctttgccgaggtccacctctgcatcggtcaacttcgaggcccgggccactggccagatctagcgatcccgggctctccgcggcgggactcaagacctccagatctgacgtcggtgatgctcgggaccgcctgatctgggggagggggtggtggcgacagtccttggcttcggcgagagctctggcaacgataaagtggcggctgcgtccggcggcctacaggctcccgccagccgcacgcgcccagctgtggcgcccggcggcgcagctgtcttcgtgcgccgcgccggcgcccgcgcagccgcgtcctctccgtgactccgcgtctccggctctcctcccctggccgcgccctctccgtcccgcgtccggctgtcgcctactcgcccggcagcctcccgggctcctggcgtcccgcccgacgccgccagcacccagccgcctaggccagcaggccccatccaccgtccgcccgtccggccaatgctagtgcgccacagcgccagtgcatcactccctcttcggatctaaacacatgcatccctctaattatagatgtaagcacgcaaatccatcatttaaatttgtaggcatattctcacatgtgtactaattgttccatcaaattgttcgtccaacaaactaatataattccctggtgaattgtcctttcttgctcatctatctactaatgcagcaaaaaatttgcttgagttcagatggtgttttttattttggaaattggaactgtatcggacatttagtcaacctagttatttttgttgggcatcaggccatcagctcaaccggattgacatggtgacatgtgcatgttgcttagaaacagaattctaaaccttaggtgctcacatatagaattaggcagctgcatgtgcttagatgaaaaaattttggaaagttgcaccttgtgatctaccaattccacatatggatgaagggtcatctgttcctgttgtagatgatgctccaattgatgaagacaccgttgttgaagaagggtcatgtgaagaacaaggaccacctccacctccagatgttgttgctcatttaggtaagattcaaacttatttgtcattttgtacttgtactgaaccatttagagttatataccgtatcgtttaccacattttatatcgaatcatattgtattgcattcggtttttttgctaggcctaccctgagttcaagtcctgggtccgccactgctcagatgcccgacctgcacggctgcacgtatacgacatgtataccgacatgtatagttctagaaccatattatactaaataattgtgtacccaatacatataagcatcatctctctaattaatggcaatatgcaacaataaagtgcatggaaaaaaatgcgtaccataatgaaagataccaactgataataatatttataaagttgataatgtgtcaaccatagacaaaatacctccatcctcaaaacatatgagtatatatatgtatatcaagcaatacaacgacgacacgagacaggatggacgtgcatggccttaatgaattggcgtgtgggctgcgggcctttagctttgtggaacctaattagaggcccatacggtgcagctagctactgtgctagtgcgggtttaatttagtcccacctcactcaccgaatgaacattgcactgccttataaacggaggcatggatactgctagcaagaaaaacataaactgagagctgcagctgatctggagtgtatcgtactgcatatgttaatcaagcatatgtgcttgagaattcacggatattcttgtgatgtgctgccggcctgattgaactttgattcaatcacatttttttatttcattactatttaatttaaggtaaagtatgaactaatcactcttttttattcattactatttaatttaaggaaaaaaaaacgaattacccccttacccccataaactcgaataccagatatttcacaccctaaacttctaaaatcgaacgaattatccccctgacttaatctagagtggtttttatttcattactatttaatttaaggtaaagtatgaattaatcactcttttttattcattactatttaatttaagggaaaaaatatgaattacccccttacccccataaactcgaataccagatatttcacaccctaaacttctaaaatcgaacgaattatccccctgacttaatctagagtggtttttatttcattactatttaatttaaggtaaagtatgaattaatcactcttttttattcattactatttaatttaaggaaaaaatacgaattacccccttaccccataaactcgaataccagatatttcacaccctaaacttctaaaatcggacgaattatccccctgacttaatctagagtggttttctactatgtgtacacgtggcagtccaatcagcatttttttttaaaaaaaacattgggacccacctatcagcttctgccccctttgagcgtgaattttaaacacggagaattaagggttcaaatgaacttatcctgatacaatcaaattatattgctccttaagcacagcgagtactgatacaatcactttttttttcaccttcttataatagagttctttcctctcttttttttcccatgccccatccaattcagttcaagatccgtaactaaggttgtgtgactgttcattggtgtccctagctagatgtcttgctcatcggggtatttcaccaaacacaacgaaactcagcatatggtatgcctacgctaccaccagccttgtagttcagcgtcgtacgtgctaccatacgcggtgtgtccacacgtatgtacgtacatagcacacccctgccatcttataagaacatgcatgtgggggtgcaaaagatgaagcgaccatatcctacacgcttacacggtgtgtatcgctcacatacgcctcagtcaccatccgaaacacacagacgccggcagcgctcgcacttgcaatcactaagctcctagtgcacgacgcaataattcgatcgatagtatatatattactctagatatccacttttgcggtcttcagctaaatagcaccctcgtcataactcatgtatttatttaatttaaacattcagaaatatacatgagtggtttacagtactttgaaccggactaactgtcatacatccagtttacaaatgaaccccttaagactgggcaaataacacattcgagcagcattttgtggaaaagggctaaaaagaaaactaaaaagcaatcaagtccttgtcccatggcctgccttgaacgtcgacagcaaggtgatgaagctggatgccggcggaggaagaatccaggtgagctgcataaggtgaagccaccgcacaatccctaaaaagcctcatagttatggaggttcaggcgatggcgagcaatgcaacgaatcagcaccaccccaaaagatttccatcggagatttgagatgaagtcgatgtagaggcagcccaaccaaaggcaacaacttgatcttttcatccaccggcgagaaaaacctagaaagcatggcaagctgcaaatggaaccaagtacgtagcttacccaaatagggcctccacatcacggaggttgaaggcacctcggcatagctaaaatatatacttcagccgctacgagatgattcttcgccagagatcaagaagatgcatggctacccccttggaaagacctcactggagatcaaacaaaaggccgacacaatatgtttttgtcccagtttggaagtaccccagctgtcccagtttggaagtaccccagctgtcggttaggagtagaggtttgacggcgtggagatccacttctagaaagtctagcgataactactgctgcttcctagagatgaaagccacctccgaccacctcgtgcaaaagggaaatatcaatggaattgacctgactaaacaggagaagctgacaaagaagacaacgattactactacttctactagacaagcaaggacgcacgacccctctcacaccctccgttagtggtgagccaccaacgagaagggatgagaggattcggcatagctagaatactttagttgttgcgagatgattcttcgccggagacgaagatttccccacagggtaatcatcgacgtaccaactatcgatcgattgaaatggagtgtatatcctactgtgactgcgtggcagattgtcgatgagggtgagcagccgcatgtacggctcagcctcagccaacgatctcgtccttgccggcgcacaaaaatgggctgcggacctttcgctttgcggaattaattcgaggcccatactgtgcagctatgctagggggagaaagtacaccgaaggtccctcagcttgtcatcgagttcccccaaccgcaaaaccggatatcccgtgtcccttaactaatcaaaaccggtcataatagatcattgggtggttttgaccccggttttatcctacgtgacggctgagtcagcgtgggacctatataaaccccacatgtcagcatggccacgtcagcctactctctctctctcttcccctcttctctcccttcctcatctctctctgtctctcccttctctgcgaggctgccagtgcgagccgggagaggagggcgtcggcggccggcgatgggcgatgcggcggcggtgggggaggagctgcgggcggggagccgcacctagtgaagctgcagccgtcgacgaggagttccttgccgtcgcggtggagcgccgacgccgggcagcgtcctgggtgggcgtcgggctcgccaccgaccagtgctgccttctccctttacaacctcaagccggcacccaccagtgctgcctccccgctggccgtcgtgctcgttgacgagtcggcgagaccggcgtcgccgtctgcaaagtcgcggctgttcccggccaaggtcaaggggagggtgggacccgtttctgcggcggtggcgagcgcggctcgtccgcctcgccgccgtcttcgtcgctgcggccctcatcctgacaggtatccgcacaacccagttccccatccccatctcctctcatatatagctcagccaacttgtaaagatttgttgtttttctattcttcttgttcttgatatgtttggcttatgcatcgtttgctcgatttggcttttagcttcggccaagaagtccggagatgtcacggagcttcagatcggtgtgaaggtaaccgatttttctggttgctcttgcgattattgcttcggggtgtagtggatctgatactgctgagttcgtcgatttgatacatatctgctaatccgttcagacaagctcgatttgtaccaggtgtctccgccaccacatcgccgccgccgcatccccggccggccgtcggacctcctcaccccagcgacctcctgcccaccgtcggcctgcctgcccaatcagagaagggcgagagagagagagagagagagagagagggggaggaggaaaggagaggaagggagagccggagaggcgcttgctgacttggcatcctgatatgtgggtctcacgctgatttagccgccacgttatataaaaccaggcttaaaaccgccgagggacctagtttgcactggttttataagttggaggatgtgttgtatccggttttgtggttgggggatgattctgtaacttgatgataaattgagggaccttcagtgtactttttccatgctagggcgtattttggtggtgtttggatccataagtcctagggacttattttagttctaggactaatcactttagtctatggctgtttggttatagagactaaaagggactaaagttcattaaatgcgctacacaatgaccatgttacccttaaaactatgtaaagataaatgcaccatgcctatgcatgagggtagcaggtggaaaagagctactttagtcccaataagctcgtcccttagggacttatggactaaagcactttaatccctttttagtccctcctgtttaggactctacagacttaaagtgaagagacttattttttagaccctcaaataaacagggcctttgtcccacctcgctcaccgaacaaacattgcacaaccttattaactgaggcatggatgccgtatgcgagaagcacgtgaacttgagctgagcaatatttgtgttagtgattgcaggagagcctatactcttgtcatttgcctttctgggctttgtatttgctcggcctgatgttctgtttgtcttctcagtccggtcacttttttggaaaaaaaccactcgtcactcttaatttcgaagatatttattttattcatcatcaatattttaaacccattatgttatgacttttattttactcatcaccattttagcatagcgataagtcaaacatttttaacttttactattaatagcaaaaaaatataaaatattaatcctgtataattgatgttactaaatttatcattaaacatttaaacatttgtcttctcagtccggtcacttttttgggaaaaaaaactactcatcactcttaatttcgaagatatttattttattcatcatcaatattttaaacccattatgttatgacttttattttactcatcaccattttagcatagcgataagtcaaacatttttaacttttactattaatagcaaaaaaatataaaatattaatcatgtataattgatgttactaaatttatcattaaacatttaaacatttgtcttctcagtccggtcacttttttgggaaaaaaactactcgtcactcttaatttcgaagatatttattttattcatcatcaatattttaaacccattatgttatgacttttattttactcatcaccattttagcatagtgataattcaaacatttttaactttgactattaatagcaaaaaaatataaaatattaatcatgtataattgatgttactaaatttatcattaaacaaactatcataatatgctactctttttatttaaaatattttattatattttcttggttaaaataacatctcagagactatgtcagagttcaaaagttgttatattttgggacagagggagtaaaggataatttcatttgacacctggtgagaggtgtcgccgaggcagggaaggcccgcggggcagcaacggcagagcacgcctcctgccgaataggtgtgctcgggaaagcgcgcagcgacgaggatggctcgccgcgggcgaaacagatacaacgtacttgatctgagacgaggagcaatgacgagcacgtggttggcaagtgcatacttgccgaggaccatgagaaacaatctgcgccacctagaacagttgtcgatggcgagatcgtgggtgaccggcacgagggccttcacattgaggacggtaacggcctagccatggagagtggcgatggcgtcgtcgtcgagggtgggaggaggcggctcctggggcccgacatgtagagggtgcgctcccagcgcaccatgaaccacgagacaggcgagcagtgctgtgaactcaggcgggaagggcaccggaacagaggagcgctaatgcacaagcgctaaaatctcactcactcgcagttattggcaagccccttctaacttagttgtagcttttttagcaaagaccaagattactattccattatttgaaaaaaaaaacccttctaactagcggtgagctctacctagccccatggtgtcatcgcctcctccttgacgagctcgccatagtaccagatccagaccaccctccactgtaactgcatggcagattgtcgacgaggggtgaacggctgcatatgcactgctaagccggtgatctcgtccttactggcgcgcgacagtaaggacgagatctggaatccactgtcgcccactgccacgattagacctctcacagtgcagtgagctggatcggtgctccaccatgccaactgggattttcgcgtgcgtggcagaagggtgcgcgccctagcagaggagctcgccccctaggagggaagcgcgcttcctcacgtactcgagcccacgcgcggcgaggaaaaggaggatgtgctacgctgtggaggagtaaatccccaaatcgccctccaaaatccccaaatcgtgacatgcttgcagatcatccatctcaaaagaacaatcaagaacagaaacagattgaatcacaatcaagaaagcacaaaattctttctctttcccagcccttccatgccagcaccgaagaacccattctgcaaaatctggggattttttttcaggtggatttcaatgagaactactaccaagctcagatcttgggatgattgatgaggcaagctaaagaaaccagcaaaaagggggattttgggatcaatgaacacaagagcaaagctccaagaaacgaaggcggcgtcctcctcgcctctccccatggatgatggaggtggcgtcctcctcgcctcccaccgccaagaacagccagcgagccgacgccaagatcgagggagaggaggcaccggcgagcctctggaagaccaccgaagtcgccgccgccgaccgctcccgaaggcgcgcgtgaggccgtccgctcccgccggatgaggggagagccgaagatggggggggagagccagcgaagggaggaggggagagcctccgctgagtcttcgccgcgcgctgccaagaaccaccggccgccgacgcaccggcgagccgccgccaacaacgccgcagaccgcgccatcgaaggccgcgccgcagaagccgccgtcgcggaagccgccgccgccgaccgtcgcagactgccccacctcctgctgctgctgctgctgctgctgcttgggatgagaggagaaggaggcgcggcggcgtgggaggcggggaggcgcgggcggaggagaagacgaggggatggcggcgcgggaggagaggcaggcgatggcaatagagtggaggaggagaagacgagtcgctagctggaagggtagttggggaataaatttcgtctattggcttggggtaacgcgtttggggtaacaggcactgtgggctgagtttgcttcaacagtatcttcatcccattaaagccacacaaaataggatgcttgttttgtcgggtgggtgtctttcggccaactttttaggctaggggtatgagccccatagcttgcactgtgagtggccttaggccttagggcatctcctttctttgtacaccccacgacataacgtgccctcacgcccgaatcgcataacttccactaaggtcagccgccccatcacccccagtggactgaggaagaaacaagagaagggggctcgagagagggagaacaacaatgagctgaggcaaacagtagaagcaattagaaaattcaaacaataatttgaaaatgtaacgggtccgctggctcaagaaacattgttcggatggacatcaatgttggcccgtccacgtagaataaaggcattgcccatggctagctaggattgaggcccatcaaaagggccccggaaagcccaagttttaatgcaaaatcccaaattgccaatccacctggtatgtgtttgttttcgggactaggtggaataggatggaaccatccttgattttagggttgggatgattccactcatatttttggtttgtaggataggatgatcccaattttttgtttggttgaaggggtgagagagagatgggatggacgtcgtttgcaaccaccgtcaatgaccgggcggccgtgcgggcgagcaagccggcagagttcacaagatggactatggctgagttcacaagcggcgagcaagaggaaaagtggcgaggacgggctcacaagatggacgacggcggacggagatgcgtgacgagcggcctcgacgacagccggacgagtggaggagcgtgcacagtggatccggcgccaccgagtcccccgccttaggatctgccgccgcagccctccccatcgctggtttcgccgctaccgccctccccaccactagatccgtcgtcgccaagccccccaccgccgccgtcgccgagcccaccgttgtcgtcaccgcaggcgcttccgagggcgaccagggcggtgagcagggtgtcgtcacgacgttcgctcgtcctaggtgggacgagttcgtccgcgaggtttggccggatcgattggtcccagatctgaaaggaatattcgtctccagggaccaacccatcccactcacccctaaaactacgtttgtcccatcccataccattcttgcaaccaaacactaccctactgaatgggcctggattgtgtcctccctaaaaaggccaaagttcacttttggtcccttatttgaccccgagtctgaaattcaccgctaaacccaactaacatatataacatgtccttcaactctaaaaccagtacaaacttgttcatggtttgtacagtggttatggctaacgtgacgtctacatggctagtttgattaggtccacgtcccacatagtattgatgtggcacttgcaataattaaaaaagatgggacccacatgttagtgagtcttcgattaaaaataaaaaaaattacagtggaacccacttcatcacattcttcctccctcctctctctccctctcctcatcgtcgtcgtcaccagggcacgccacagctacgaccgaccctgccgatgagtgttgcctactcgcttcccaccatcggttgtctcatcctctcctgcgtaccgacgagagggaagaaggcagttcatggcgacgacactagagcgacgtcttcctcgagagtgatggccactggatgaagagcaccaggcagtagacctcctcagctcccgacagtgatgggcggctagccatcagatctgggtgccatgggggtggcatcttcccctagagcaaggacaaccagaaggacagcactaggcaacgggccccccttggttcccgatggcagcgggcgaccagctgccagatctctcgagcaaggacctcggcgctacgaacatcaacatgctcggcctcgttagtggtggcacggtctgcggcgacgccgatgaggagctcgatttcgaagtaggcccattcctatggctggcgagccgcatagtggtgtgggcatggaatttggccaggacaccaacaagaagtgggcgcgcgaatacagagactggcatggggagtagtttgccgactccttgttagtgtaaaaacacggcggcctgggagatctaaattccgttgttaacacacctctctgctgttcaagccggccacacgagcatgactccgatcttgctgccatcaccacggtgtaacctcccgccagtggctgccgcccccttccctcgtacctcttgtcacgcccctccacaccgcccgctgcgccaccctgaaggagatgggaagagagaggaagaaagaggaagagaggtggagaaagaaggaagtaaaaaaattggttactaacatgtgcagcacacgtgagtccatgttgactcggctcaccacgtcagctaaaactgagtataatacaatctggtaccttgagtaattcggtattatgagttaggggatatgctatatctattttttttagagatgaatttcagactcggcgataagttgcaataaattaaagaacttgaacccacctccttcctgtggaataagttcatatgaggtcccttaacttgtcaacgaatccgattttcgtccttcaaccggaaaaccagatacaagaggtccctcaactatcaaaaccggtgcactcaaggtccctcggtggtttagatggcggttttggctgacgtggcgcctacgtggctagtttgactcggtcttcatctgacgtggcattgacatggcgcttacatggcaattcgatctgaaaaaataataaaacccgtaggacccacatgtcagtttcacatacaaaataataataaaaaatggtgggacctacatgggccccatatgtcatcctctccttccgtcttcccactatcctctctctctctctcttcttccctacggggcgacgggcggagtagagcgacggcggccgaagcggcggagcgcgaagccagcagggcggcggcgggaatcggcatcaccttggacgtcttctcgtcggagaccaacgaatgggcgaagcgcgatgtggtgttcggcaacgttgaggccttgttgctgtcccccagtcccctaccatgcactatcgcggcggcgtcctccacgtgctcgtgtacccccgaccgcgtcgtgcttacggacctcggtgccagcctcctctctatctccttcttcctttcactcccaaagtcccaatgaggaggcatggtttcagagcttgcaccatcgacagtagagttgtccgcgcacggcgcatccttgtgcagctctatgacacaccctggtcgaaattgcataacgaattgatcaccaacaccgtcaatatactgctggcctatccttgtccatttcagcaacctcattcatcactcctttgaaccactcaaacgacaacggctcccgggtaacccaggaaaattgtgcgcggcttgttctgtatgccctcttcttgttgttacttcttgttgacacactgaagctgttggcgacgaccgacagcgcccggcaagaaagggaggagcggcgggaggtggccggcgatcgaggagg

SEQ ID NO: 68670 - DNA, 12754 bp, Oryza sativa
gccatcatctcgctcgtcggccatggtgcacacgtcgccgcctcccatggtggctatgcagaagagagacgttgcttgcaactggccttggacataatcaggccaagagaataagaaggctttaggatactgatccgattcgagttcaaaaggcgtttagtttttccgcattgtgttcggatttttttcaatctgtttcgttcaagtaaatttaatccgatttgtagcctttttggcttgcattaacaaaaccatgcattaacttatcaagatgaacatgttagcaaccaaatcaccaaacaacaagaatttcaccacgaacaactatccagtcaacagtgctgtttttggaggtggaagacgaggaaatacaggggttctggaaggttctagaagctagggaaatgggaggtggaggagggaatagatactcgacgaggatctagcccggatccaagccgccgccgctgccgccgatcgccaagccgctcaggctggtcgccgtcctgcccctttctgtgtttttcctcccctgaaagaaccgatgctgttgcttttgttctttaccttgggtttgcttgggccagcttgaatgaatggttgtacaggcccattggcagcccactcgattcctaacaatcccctcttcttaaaattcgacttgtccgcaagtcgatggcaattaaaattctgaaaatgcaaaccacccggatcccatggcacttgtagctcttggataatcaaaatgatcaagtcattcccatcactattgcccttccttgtaatgagtaatgacaatattccactccagcttagtatgccttcttcacagtgctcatattttaccacaagcttaacaattgtgcctcttgttttcagccttccaagaatagttggcatagcaacatgacatagcaaataagtgctaatatttggcttgtaaatgcagaattgcttgtcaccttccaagactgatttgatggttggaataaaaacattcttccatgctgaaattatattcttgcttgcacttggcttgatcccttgcattctccatttgctggtaccatcttctagtataactagaattcccttgcagtcccaagtatcctgaacattgttgccatccaagtggcttatatcactaataagcctgctttcaataacctcaaaatattgtgccatcatataggaggtgaatggatttttggatgccggtagcaagtcatctcttttatcatcacttgggtcttcagttaatagcaccaacaaggcaagctcatgcattctagaaatttcaacaacggtgcagctcctgtaactaacgaaatcccactgtgccttccaagcaaacagactaattgccactccaattttccaggacctgcattgcttaagtctaattggcggtggccatggtggtattagacatacacttgtccaaacggaatcaaatgcagaccatggaacatgccacacattccctcctctaaccacaccacctgaccaaggaagtggccaaggttttctcttgggaagccccgccagcagcctcttttcacttttgaggcatttcatcaaacacccgttgggcatcaccaattttatgcagaaaatggaatccagcttttctgccatgactagcatgggctccgttggtgctgcaatcatgttcagtgtgtgaaacggaaaggggaatgcaacctcggcctgaatagtaccgatgttgtctttgaggctgattgtcgtacaccttgaatgcataaccttggtgaggtcagtagtattgatgaaaatagagcaggccttgtcctcgctaaccactgtctccatggtggctgcagcagtggtactagcaaacgactcctcaagaatggcatgattcacaccggtgtcattgtcgaagcaatttaccaagcacttggtgggcgtcactgttgtagtaccaatgccatggttcaaactcacctgcaagcccatggcgactgtcggagtaggaacatcaatgttgtggcttgcacttgttgtcgtgtacgcactggcactgttggaacacgcccacgaacacttggcgagcactggagtaggcgaggtcgggggtgttgaagatgatgcagaattgaagatggaggttgtcgccttgatgatgttagttgtctcctcgaatgatttgcgcctattatagttggccatgtgggccgcccggcacggcacggcccaggcccggccgtgcctgggccgaggcttgtcgggccggcacggcccgaccgacgcaccgggccgtgccgtgccagcccacgtgccgcactcacggcccaggcacggcccaacacgcctcgggccgtgccgggccggcccaaaagcacgatgggccgtcatgcttttcctcagaataagtctaaatttcctccctcctattgggctgtgacatatgtacagccacaaaaagtctattttacctccctcttctttgggctggggtatataaatagctaaaataagtctatttaaggtccctattctttagacagttacatttatatgtctatttttagtccctatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactatagcgcctattagcttctatctcgtccaacttctccaaaatctgatcaatcttctcattgcacctacgcttggtcttcatttgttcaagcttctccaatatctgatccagagcttcatccatcattttctcctctttgttcatgggggaattgatggggacggccttagatatcttgagatcttcttgggacacctctccttggcttgacatttcaccgaacaggttgtgggcgttggtgccatgagcagtagccttgcccaaatccaatgaccaactgcacgggacgccgcagcggtacttccccattgcctccatgcttgaaatcccatggatcagcggctctgataccatattgttagcaaccaaatcaccaaacaacaagaatttcaccacgaacaactatccagtcaacagtgctgtttttggaggtggaagacgaggaaatacaggggttctggaaggttctagaagctagggaaatgggaggtggaggagggaatagatactcgacgaggatctagcccggatccaagccgccgccgctgccgccgatcgccaagccgctcaggctggtcgccgtcctgcccctttctgtgtttttcctcccctgaaagaaccgatgctgttgcttttgttctttaccttgggtttgcttgggccagcttgaatgaatggttgtacaggcccattggcagcccactcgattcctaacagaacacaatcttgagatttgaacattaggtcaaactttgacggagacctgacctaaaacatcaagtcaacaaaagtcaaactaaacgcctcggcgtccggactccgacttggtcaagctcctaagccggcccagaatcctaaccttgccctcccaccctaaccctttcttcctcggcgactcgtcggagagctccgccgccgagtcctcccactggagctcgtcggccgccgcgctctgcctcgccttgagctccacggcgagctccgtcaccgcggcgtccgggtcgtccctgctccgcagcagcacttctcccacctcggccggcgtcatctcggcgccgccgcggacgcagcactccgccgcgtccagcatctcgtggtcctcgacgccgacgtagcggccgaccagctcgcgcatggcgtgcgcgccgcaggcgcccaggcgcacgtgcacgtccatcctccccgggcggagcagcgccgggtcgatgccgtcgacgtggttcgtcgtgaacacgatgatgcgctcctcgccgcagcacgaccacaggccgtcggtgaagttgagcagcccggacagcgtcaccttggagcggtggttgtcgccgccgtcggagtcggagtccgacgagtcgtcgtcggaggcggcggtggcgtggaggagccggcgtcttttgttccgtctgctcttgcggtcgccggtgaggtggagggagcagtcgatgtcctcgatgacgatgagcaggcggttggtggtctggatgaggagcgcgcggaggtcggcgttggtggcgacgcgggtgagctcgaggtcgaacacgtcgtaccggaggtggttcgccatggcggcgatgagcgaggacttgcagagccgggcgggccgtggagaaggtacccgcgcttccacggccgccccgtccggcggtagaactcgctgccgtcggcgaatgccgtgaggtcggcgaggaggcgcgccttgagctccgggtcgagcgcgagcgtgtcgaacgtggacgggtggcagaacggcaccgacgaccacgccgcggcgccgcgcggggatgccgcgttcgtgtgcagcctccgcgcgcgcgacgaccgctccaggtggtccgccgcggcggcgaggtgcgccaggtacgccgggagcaccgccgcggcgtgccgcttgggcagccgcagcgagaacgaccgccgctcctcgagcgagtcctggagcgtgtcggcgtggtgcgtccacacggcgcggtgcccgtcgaagctgtcagccaccgagtggttcggggagagcgacacggacggcgtcgccgccgccgctgccgctcccgcgtcatgcccacctccgccgccggagacggcgacggagcgcggcagcgacagcgtgaggcggggaggcggcggcgaggagaggaggagtgagcggtggaggtagagctggacatggcggtacaacgcgttgggctcgacggcggcggagccgaggaactccggcacgtcgaagtaggagtacggcgtgagcgagtcctgcagcgactgccacagcgagtggaggagggagagtagctgcgtcgggagcacgttctgcaggatggtgaggaggcccagcagcgaccacatctgcgacaagaactccattgccgtcgaatttggagctcagctagcttcttgctcagctactgcttgagctgctaagctggagggcagtgtagtgtggttttgggtttggcttgtcttgccgttgcatggagggaacgccggatataaagaggggaggaagataaaggaggtggccactgttacagattgtttattagccttgatgacggcatcagcatgcatgctttgctgcataaaaaggagataatgtggataattagaatattagttgacaagcataacggtgttggtcacaaaccataatcatcgaattgaagcatgaatttgacaatagacataggtacaaggatcacttccatgcatctattttcatttttcaggtttcatgcttttacttgtttaactgtaggttccattcagacaagcatgccaaacagtgaaaacaacacgtgtccttgatgcggacatacagtgaaagagtgcaactgcagatggtttaggtttactgatctctaacggtgaactgatactaataagaatcatcagacacatcagactgagtcttgacagacattttgttcccctgttgatatatatcatcaaaccatcaatccatatgccaagaaaggccacaaggctgcattgttagtgcataaacaatagtttccgcaggctcaaatgacattgtgtcccccttatgtctgcagcatcaactcacaaaagcagggccagtctaatttcttttcttcttttttcatatgctgcagcatcactgctggtccatctgcaatagttcttcagctcaagaagaagaatatttcggctgcgtctgctcagctttgcacgcagggggtaggaaagaaaaaaaaaggacctgaaaggaaggaggagagggtaaggtgcggctcctcttttgcacacgttctccggctcttttctcatcttttatgacagggtggacggtggcgcgtgcctcggaagccgggaccggcgtggtggcgccgccggccggcccgtgcgcgtggaaagaggaactatgagcagcagccacggggaaggatgatccacctcgccgcacatggaatgttctcttgcggctagtggcggagccagcatcaccatgaagcccgaactactagtttttgggtgaccgactgatttttatacccgtcgacagataacggcaatggaaatggcagcgacggagcccggacgcccacccgacctgtccaggagctgcctccaccgctgcttgcggcatcgctgacctgaccaacacaatgtgttatgtgtcctcccttcttctcactggcctggtaactggtacacagtaactggaaatctggaattttctcttgcactgcttgttaagatgatacacacctcactccagctgaagaactccctgacaaatgtacagcaggcataattctattaggattttttttactacactttggtttttacagtatggacatccacacctaatgagttgatgtcactgcactcgagtgcattactgtgcagataaacctgtaaaacagtactattactgtacctactaccttctatacatgataaacttttggtttacatgtggcagtctcatgggaatcaatcttgaacgaagaaccgaagaagcataggattctcccatccagacaaaagaccagtttttgctagcaacagctgatagctagcattcccccatctttttcgcaccaaagcaggggctgattagttttaccaaaggctgggattaaaggccctaattgtcctttgtagctcagctgagagtgagagtgagagtgagagagtgactgagtgttaggctgcctcttgtcgggaatatatgcacccatcattgcgtgacgggcctttcccctgcgtgcaagtgcgtgcgagccttctctttcgtgacatgggccgaaaatgaggtgagctcggtggttgacatccatgtgaaagaaccggagcttttttatgtttacatgttctcttgtaatcatttcttctttgtccaagtttttcagttcagttgaaatttgttcttgaattcagtgtgtaaagtaaggtattattcagtttagcggttagtgctcgtgaagatctgatttgcattgcaaagcatctgaatttttttttcctgcgggaaaaagcatctgaattctgaattctagcttgtgaccgcacgaagaaatagtcagtactagtaattatactctcttcggttttaaaatatattacattgttatgttttggaaataatgtttaatcatttgtcttatttgaaaaaaagtttcaaatatgagaaatataggtatacaaaattacatttaatagtataacaagtaacaacaagatgctactccctccgtttcacaatgcaagtcattctaacatttcccacattcatattgatattaatgaatctagacatatatatctatatagattcattacatcaatatgaatgtgaaaaatactaaaatgacttacattgtgaaacggatgaagtagtacttatataagagtttttcttagaaataacacgaatgatcaaatattatatccaaaagttaacaatgctatgtatttttattttgaacattgaggtagtaataatcatggtcgttttgtttaacaatactccagacgatagggtttctagctgtatatctaaaatgctagtagacctaggatgctttattttactttgcttgaaaaagaataacaagcattgtacttttgtacaaagcggttttcctacatttggcatctactacctctgtattctctctacacatggccgggaatctgattttgagtccccaaaaaacaccacttttctaagcgtgcaaactttacttggagagggagccttttatctttattttgcatttcgtctttcgtggaggcttttccttttttcctttatttcacgtgcatttcgtcacgttactttcgaccaagacaaattcaacacgacgctttccaatttcaacgtataggtcgcagactcgtagagtcgtagtccccatttcaggccttgttgggcctcacgtccctcgcgatcatgctcgattgatgggccttattgggctatacgtctctcgcgatcatgttcgaccaatgggcctcattgggccctacttattattgggccattatttgtgggcccattcggcctgtcgtggatcgtgcacggagcagagagaacagagcagcagctgattcgcacgagctagcccaaataattgattcgtttgttcccattgaatttggcaatcgacagagtggcagacatgtatttttcaaggcgataaattacacttttacatggacaaaaggagcagaaacaaaacaaaaaaaaaaccatcaagaacaccactcgatcgcatcatcgtgtcgctggcaatgtcatactactgcaattatcagaagtatgtttgcaactttgcctcaatctctcatggcatccatggcggcgttggtcggccggtcaccggctgacgagggggaaccacctgtcgcggaagttggactggtaggacaccatgacgacgagcagcgcgaggagcaccccgacgccccacggcgagccgccggcgcggtggatggagtcccgctcgggcatcggcagcgacagctgccgcagctggtccaccccgcgccgctctccgtcgccgccgcccgacagcagccgcacggcgagcagcagcgcgagcggcgacgccatcagcagcagccgcgcctggtcggcgaaccgctccgccgccgacccgtagctcgtgtaccacgagaatccgaggaagacgagcagcaccaccaggaagaagcacaggtgaagcggcagctccggcgcctgcacataccccgcggccgccgccggcgagccgccgttgctgtacgagttccccatcggatcgttggaatcgaactttctcgcttgcgaggtgaagaagaagaggaaggagaagaagctggcaatggaggtgatcgagcacgactcggcgctcatttatagagccgagcatcgctgccacgtggcagtcacccatcgggcggcgtcgcgtctccggccaatcggagggcgccacggcgcggccgaccacgccgccatgggccccactgcatggatagccgacacgtaggcacgtgcacgcgtggggcgcacgtgggtacggctccgcgcgaggagggggcgcgcgcgctttgcttagcccgagcagagcccatcgcttcggcgctaaacaaagcgcgccggccaggtggtgggccccacctgccagtgggtgattaggcgtgcgatgtgggccccctattcctgagctggccggtgtgtggtgtggtgtgatgcgctgctgctgctgccgccttggtcaggcagctggatctgtactcttcctttgggatttgcagcctttttaagcccaaacatagcaagcaagatctgcagcctctgcttacttaacgcctaaaatgtctaattaacaggagacaggatagcaaatgtgtgtgtcatttagtggtttgtagaatcggtgtcacggcgcctgaagagataagggttctgtttggtgagtttacgacggctgaagcttcttctagaatcttcatccgctagaacctttctcaaactatacaattttatttaaattttaaaaagctgtaattataaaatttagaaaataaacaagaaattaatactacagatttttcagtttctttagattctcacaagctaattggaatgttacttctcaaataagaccaagatctagtaggacagtggcaaatgtggcacactgcgaactggctcaagactcgtttgatgaccagtgttttaatttaccgaggttgtgatcacgtggaatgtcgtcaaccccatcttgtaaattaccttctcttttaccgctaattgtccgtggttagttgaaacctttaattcattccagaacgataaaagtaaactgcgcgagcagtgtgtgtgcagataattaagcaagtacagcttctaaaacgcctattctatgttagcacattactacacaaataattttcccaaacgactacaatgcattttcgcatatgggtatagcacctgtggtgtatgtagaaataggaattttaccaagtggattgtacaaccgcatgtaaaagagattttcgcatatgactgactgcaaaaacaattttcggcaaaaaaaaacaaaagaaaaatcctaggaacctagctcgggagtggccatccactgccgccctccctgctacctgatccacacttcccaaggcccatcaccattgtcgccgtagggggaaaggccgctagaacaacccttctcatcgtcgtcgtaggcaaatccacgcacaagggatggagagaggcctctggttccacatgggaaggggagatgccgccggatccacccctcccgtcactgctgatgacagatctacatgcgtgaggggagatgcctctagatccgcctctcctgtcaccaccgccgatagatccacgtgctagggaggggaagaggcttgcggcggactgcacctcctaagggcgtcgctacttgatccgccaccattgaggccatcgctgttgtcgttgttgtcatcatcattcccccttctcgtcgtgatctggggtgtccaccactacccctcccaaccacttcgccgccaccaaatccacgagggataggaaggcaagggagggcggtcgctaccgaggtcactgtcgacacacgctgcattgctgactcgcgtcttgtgacatcctggctcaattaggatttgacatatgtgacccataagagctatgtgcgcatgcttagtaccacaattgctagttagcatggtagaaccaacttataagggtttgtccctctaaacataccacctctgttttaaccattttacatgaagcgaggacaaaagtgtaagtgaggtagtatgtgtaagtgtgttcactcgtcgaatggactgggctggctgttacaaatggtattagagccgggtctcacggttgcacgtacttgtcaatgcgtaggcatatggcgcttgtgggctctgtgtaaagtatacatggcatgccatatggagctgacactggacgtacggacatgtgttaagagagggcgtgctcctaaatatttgcctatatacgtgtgtggtccatgagagccatgtgcgcatgcttaataccacatttctagtttagcacaaacggaaccaacaaataagggcttgttcctccaaccatagtaccatcgggttaaccattttacatgaagcgagtacaaatgtgtaagtgggatgacatatgtaagtgagctcgctcatcggatgggctggattggcggttctggagaacgggctattacacgtccacgtgccatgagcgagagagagagagaaggcgagatgataagaatgaagtggagctacgagatggtgagtagataaggataagggagagaagatttagtaaattttaagatgaagaaaggaaggaaaggaggggtggtcggccttgtaggtgggcttcttaaacaggccctcctatgacctattttcatctacgggtttatacccggtacctctgaaatctttttacatacgggttttcttttagtccgtgtgtaaaaaaagatatgtttgtaaaaagtagtggcaacctgtataacccatataaaacttaagctacaatgcatcatttttataatatatgacatagacttgcaaagtgactaaatgaggagagcgtgtgaagatgttatttcttcgttactgtgaaagcgggaatgtccttccgtcccctcccccatcgtccgctcgagtctccctcattcgcccttgcctttaatctcaatccacctaggtagccaattctcaatcatatggaccgactcattacaaatcacaggagatgttactagttacacaaaatatctgagcctcccttcccaagtccaacactactcccatacgtcaaatcatttcgttgatgataatcaaatcatgcgaatagcagctactactaacttacaactaggaaccattaccacatactacctccgtctcaaaataagtgcagtcgtggatatctgtacccaacgtttgactgtccatcttatttaaaaaatttatgaaaaaattaaaaatatttagtcacacataaagtactattcatattttatcatctaatagcaataaaaaatactaatcataaaaaattttcaaataagacgaacggtcaaacgttgaacgtgaatagtgcaaaactgtacttattttgggacggagggagtaaaaaacaacaataatttgcttgtgaccattttgaccctggttcacgtgtgctaagcggcttgttgtgattgtgaagacgatgtacttaaaaaaaagagagaataaatcaagtgttcatgctgcaaatacagaataaaaatgggaagagaagcaaagctgatgatatagcgatactactgtcgatcaaacctaatgggccaccattttgtgtcaaggtttgacgcatcaaatcatgggccggcctataaaaaagggctgccaacttcaattttatcaagcctgcacgtcactaatcagggtgaccacaagaaagagccacgtttct

SEQ ID NO: 68671 - DNA, 6523 bp, Oryza sativa
aaggaaagctcaaacgggtgattcgtaaccggcaatgtcggtctcatcttctccagtcaggtgttggccacctcgttcttggcgagcacccacgggaagcgcaatcgacggtcaccgaatgcctgcggaagctgtcggaacaacgaaagatcttccaaccccctgccctctcctgatgatgcagtgggtcgaggccacctagtgaccgtggctcggtaggcagcgacaacggcaaccacggcagccacggtgaagcctgtagcgagctccctccttcaccgacacagctcgatggcagcaatcgatgattggggattgggatttgtgattggaattacttttttgctccaaagaaaatgttttcactagcgggcattttaacattgccgccagtgaaattctattttcgctggtggtggtcttagcttggcggcagcgaaaatgattttcactagcagctgtcttagcgtggttgctagcgaaaattgattttcgttggcagtcaactgcccgccagcacaaatgtattattttcactggcctttgattgctagcggtacagcaacctccagcgaaaacccatttcggccgcaagtaaaaatggttttttagtagtgaatcaaataaacatgatgaggaagtgacgttgactctagatgagaaaaacgtttactatacaaaatatacacaaatcattcatacaaaagcaattacaatttacaaaaacaacactaatgaacatgattattctagatgtaggaattattctggaatactcctcgtcggaaacatgtggaacgcatttctctcaaaacgcaaaaaccgtgcccagacaccaatccgccgctggatgtgaagccaacggcccagatggaggccaacggtgccaaggcgcaggccacgcgtgtagggctggacgaaaagctcgtggctcgttagctcgctcggctcggctcgtctcgtttggatttgttaacgagccgagctagagttagctcgttagctataacgagccggctcgagctagctcacgagctgctcgcgagccaaacgagccaaggcccagtacaaacagcgtgctcaaccacacaccataagtccaacaaggcccacgagacaaggtcacagctcaagcccacaagtagagtcaacggtgccaggtcatgaaacagcaagcccaactaagcccaatagtctaaccctaaaatccctccctacctgtccgttccttttctcaacgattcccagaagcgccgcttatcctcaagccgagtggccgacagcgccgcccaggagtcgaggagtcgtagctcgtagcgccacccttccttgcgcgcgcggttgtgccctttctcgccgccggtctccccgcttcacctcgcatcctcaacgtcaacagctgccatccgctcctcacgctggctatcgggaaggtcagtaggtcacgccgtctccttccctacttgcctccggccaccctaagaccccaactcgcctcttcctcgcgcgaatcgcctagttacccggcgggcgacacccctactcccgtgtggccgcgcgtcctcgtcgtcttgcttgccctgctttctttggctcacgagccaaacgagcccactcgagctagacaactagccgagcctagcttggttttctagctcgttagggtaatgagccgagactagctagaccgagccgagctggctcgacatccacccctacacgcgtgcctttgcccaaatcttatctcccgggaggctcacttccctccccgagtggctgcgacgacctccacagctcgagacgaggtgccacttcttcttctctctctccatcccccattcctcccctctcttcccgtgtcccgtcgtccacagctccccgaccaaatccctagccctactattcccgcgcccgcccctccctcgcgtggtcacgcccgacagcgccgtgccgccaccgcttcttgccctactgccgcagttcttcaagaggcttttgtcctgatttgctgcagcccggtaggtattatatatttttgtggttggtaaattcggcagcaaaaaagaaaaaaaaataataccgaatgttataaacccgagcatctcatggtgtccatgtatcagcatatatgatatgttaggatcggtaaggatgcatagcacacgattacaaccaccaactccacctcgaagataatatagcgtagtgtttgccagcttcgcacgttatggccgaattcttatgtataacaaatttaccatggtatgtaagctcaaaaatgcaaaactaattatcctcgaacctaaaaaagtgtatacatgcaagagatgatcaatcccacatataaatacatgcaaataatacacgccctgctcgacagccactgctgcagctgtacctaagctactagctgtggccgcggtgtgcatccacaaccgtagcaatggctgctcagcaggcccatgatctctgaaaaagttcctgcaagcagtacatatgtatgtacagttgtacacaccctcgcccctattcatcctcttaaaggagtaaggagtaatgacagtcgatatgtgttggttgattaaaatttagaagagaacgtttttgaatagaattgtgaacttactcgaatatcgttcttttgtgtattgcttttgttatgcttcacctgactctatctctgtgaaatggcagctagtatattgaaggttgaagctttgtgggtatccagcaagtatttcaatggcgttgctacagtttggaggtaccttggcccccaaacttggggaaaaacctcagctgttgcccaggtcacctgcacttacaagagttatttatgctgatccaagatttctggtgtcgaaaagtgggtatgtgaatgtgttctgatcagtgagatgtactaggaatactaaaataaaggacacattgatattataaaaaggcaagatttctgagtaaactgaagatgatatatctctttttgtgcagtagtggaggcaggcttaaacaccttgtatcacctactgctagtttacaatcacggacatcttctcgactatttaaccatgcaccatcaccgagatttcgccatcgaaggagttcaaggttcattgtcagagctgatgctgtgagttacttcatttgcttttcttctttgctggtattattagaaaatccagtttcctgacatggatttgatattttaatttacaggatttctattccacacttggtgtttcaagaaatgctagtaaatctgaaatcaagagtggtaggtgtggttttatttgtcagtttagggcatgcagtgattggtgctccgtacaatcgtaggagtattacccagctttgcttcttctctagtttgagcctggttgtaggtttgtaggtaccctataatttaccaaacaaaccagactgctttcatgtggctattagtcgtagattactagttttaaatcatactgttcacgtgtgaaacaaaatatatgtacaacagaaactgttaagcttcccagggaagatatgaaatatataactagtctttttcaaacttggccatagtgagctttatggcccacttgtttgttctcgaaagctttactattcctactagtaactcaaatatttgctatttcatctaatttgaaggctatctcagcaaaaccccttgaactattctaagacaagcctatgctgtcttcagtatcattttctgcaactgatcatcttgcgttctagactcgatactgtttatatttctgaaaatctattgttggcaacttctcattgatgcattgtttgtatggccctcaatccctgccctccacgtgtgtgggcagaaattttgaacaaaaatcccaacccacacccgtagataatctaggatttgtcctatccaaataatgcctaaggggatattatgttagaaatccttcagagtcaattttgatcaaaatatgtgtagtagtttaatgttgctttctattgtagttctaaaatggtccttcttttccagcctataggaagcttgctaggagctaccatcctgatgtgaacaagtaagtactaaccattatatgggaattgtgtttcagctacactcgatatattgcttctttttctcctttcgatccattataaacctgagtactagttgttgcattacctttttcataactacataatcaaataagcaattgttatgcttgtgtatttttctttagagatcctggtgctgaacaaaagttcaaggatattagcaatgcttatgaggttagtccagctaaccataaccaaatcccattgtttcttatgactatgttgttgtagggttacaggtgcttgccagctaacataaataggattgcaggttttgtctgatgatgagaagcgatcaatctatgataaatatggagaagctggtttgaagggtgctggaatgggaacaggagtgagtgttcctagaatgttgtccaattctgaagtatgatcagcatgacctttatatgatattgattgtatgaaatttgtgaatctgcaggattactcaaacccattcgatctctttgaatcattattcgaaggctttggtggaatggggggaatgggaggccgtgctgctcggaacagaccaatgcagggtgatgatgaggcctacaatctggtactcaatttcaaggaagcggtgtttggtgtagagaaagaaattgagatcaccagactggaaggctgtaatacatgtgatggaactggtgccaagcctggaacgaaaccaaccacatgcaaaacatgtggaggacagggacaagtggtctcctcaacaagaacgccacttggaatattccagcaggtctccacctgcaatacttgcggaggcactggtgaattctctaccccgtgcaacacttgtgggggtgatggccgagtgcggaagacaaaaaggatcagtctaaaggttcctgctggtgttgattctggaagcagattgagggtccggtctgaggggaatgctgggcggagaggaggccctcctggagatctttatgtgtttattgatgttctctctgatcctgttcttaagcgagatgggacaaacattctatacacatgcaaagtttcatatattgacgcaattcttgggacaaccgtcaaggttcccactgttgatgggatggttgacctgaagatcccctccggtacccagccaggcacaacgttagtgatgtccaagaaaggtgtcccactcctcgggaagtcaaatgctcgtggagaccagctagtgcgtgtgcaggtcgagattccaaagcgtctgagcagcgacgagaggaagctgattgaagaacttgcaaacctaaacaaggctcaaacagcaaacagcaggagataattccatgaggcttcattggacaaaatgctttggcaatatgcaattttaacgcaaattgcagtgactaagtgagcatgaactggtaaatcacttcacaaactgtacgctcatgctgcgccgtaccatcggtgggaactgtgaattctcatgtctgtaacttcatttttaagccatagaaatctagttccatccaaaacaccaaaacggatggtgttttacagtagcttgtcatatgcttttaggcgagcttattagtctatttttcataatactttttcacaattttgaaaggcctagggagaaatatttaatggtgcaaaagggacgagttttgaaacatttgtttgtcgcagaagcaccagaccattctgattgttattgtaagctgtaacatcaaagttttggcagcaggttttcatgtgctcttaagcgttgggggtttgttccgtttggttttcaactgtatgctagctttctctattagccaatgtaatggcagttgcaaaatctgttgtagtgcaggcgtgcagctaaatgcagtatagctgactgttaactttaagctgattgttccatgcatgtgccagtaaaaggccagtcaggaatgagtctcatggatcaatatatggtgcagacatgtcagtaggatataggagtattacattatagttttttcagcttcaataacgttcatgttagcttgtacattgtatggcaacccttccatacttgcgttagccacaaaagttcaccatgttagcttggctttagatcagtttaaactgtcctttaatagcaaattaataatccataaatgaaattttacttccactgtttaccagtgctactactgttctacctccagcgttcaacagctgagaaacgtgaggagtccagcaccagcagtaccatttactgcaatgcgagagagatgttctccgtttcctccttcactgaggcttaggagtaggagtagtagtgattttttcgtgtcgacttgtttaacattatcgttaacaccatcaagtgtcaatgccagtagcctgctgcttctgatcatttcttccttccctcttctaacgccattatcgttttatctcaccttgcatttatgttcaagtgaccatggtt

SEQ ID NO: 68672 - DNA, 3134 bp, Oryza sativa
attatccacccgattatctaatggcaatacagtgcctaaaattcctgcttccggagtcttaaactttacccgaatccaatctggaaaccgaaaagacagctgcttggctgatggcaagtcactgggtacattgatttgtgttaattttcagtccaataaaacagcgcaaaaattgtaagggtgatccctctttagtaaagccatgcattctgcaaactctgttgcaatgcaagctgtatcctatatccagtgccgatgaaccaattctgtttgcagactgtaccctatctctactctacaagccaaccaaaggaaagtgtttgatctgcagtggaatactagcaggtattccaccatttcagggttgggagtgtgattgatatgcaggagattgacattgtgcagaacattggccgtcaggctgccgctgccgtcgccggtggtgtcggtgagaaagcccggtggtggtggttgtgccggcggcgaggagtggctgcaacaggatgggctgttgtgcatgggcggatcagcgggtggcttatggcggtggccacgctgttcgccggcgacggacccggcggcggcggccttcacgagggacggcgcatgatgatcctggataatttcgagacttcgggccggcgtgcgtgcaaagcccatacatattctacgcgcaactgtcacgcacaaaaacgaagtttttagtaccacatggaaaatctatgacgactgacaccggcataaaagacgacgcgctcgcatcgctcctggcgagctcggtggcgtgagcttgttaccccagctgcgggggggcgggagttggcatgtttcggctgctggagaaaatgaggtttctccctcgatcgaatatggatgcaaacatcctcccgactttggcccacgagggagggaaggtgtgagtcaccctgggctcttgacggctgcgtcatggagcgaagaggacgctgaatcgtggtagaggtgtgtggtggccggtgcccgacgacggcgcctggcgatgggtggggagaaggtgagcagttgtagttgggacccgtgccacacccccgcacgtgcgcaagtccatgacgtgagcgctcccggtcattaggagccacgtcagctggcggcctccgccgttgagcttttccctgccaaccgacacccttctccccacccattggcgaatgccctagaggtttgggttgagataggagtagaggggagtgaggtggaagaagattgctagttggcttgtgggttccacgtgggccctgcactgactcagccaccacgtcaacaaaaccggaaagcaatactaccttgggattaaaagtggaccgttttgcaagattaggggttcagggccgtttaaaactcaacgacaagataagggaccttagatgaacttttttgggagatgaggcgcctgtgcatatgacccataggcaggcgacaacgcggcagcagagcgctgcacgacctccgcctccccaatccgtcccgtctcctcgcccgccgccctcgactcccgtctcctcgcctgccgctggcgccgatctccatcctgctagcagaggtggcgccggcgtcctcctgctcccgccgcattcgcatcctaatccatcccatccggcctcggcctcgaatttcgtctcctcgcccgccgcttgcgccgatccccatcctgcgagcagaggtggcgcccggcgtcctccttcttccaccgcatcgtcgctcgccggtgagcatccctccctacccacacctcatcaggtattctgcgttatccctcaaaaagtttgggggttcaaccgaaacagggttagatctgcctctgcccagctccacctactttcaagttgttaattttgatttccgtttttagcagatgtaatttggttattgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactgtgacacttggcatgaatctaatttaacattctttctttatcaggttataaattgaaaccattgaacgtactttgtcttcccgtccctaaaacattgtgatatatctgtaatattttaatatttttaattttaaaaataatttagactaataatatagatatttaaattaggtaattagtaaattcaaatcaactatagtttggaataaaaaaacaaaatgatatatgccaagtacaatctaataacaatagaatgcacttttggttaatgtttactcctaatttcttaatttctagtttggctccccccaccgttatggtaaaaaatcgttatgttttaactatttatctgctagagcatatgtaatatttatgtaaactatgttctttattaccaatcaaaatagacaccttacctactttcatcaaaagaaataaaaaatgttgatgatgtagtaggtattattctggaatactcctcgtcggaaacatatggaacgcatttccctcaaaacgcaaaaaccggggccccgagccctcgacaccaaccccgtcggatgtgaagccgacggcccagatggaggccagcggtgccaatgcgtaggccacgcgtgcctctgcgcaaatcttatctcccgggaggctccgctccacttcccttcccgagtcactcaaaccatccaatccctccaccttcccttcccttgcccccatttcccaccgccgccgcgccttgcccccattccccaccgccgcggtgcggccgccgacgacctccacacctagagcacgcgtgccgccgacgaggtgcccttttttctctcactctcgtctcccccattcctcccctcttcccgtgtcccgtcgtccacagctccccgaccaaatccctagccctactattccccacccaccaggccttcctcgcgtggtaaagccgacgatcgggcccgacagtgccgccgcttcttgccctactgccgcggtcttttagaggttgtcctgattgctgaagccaataggaatgtatattctttcgc

SEQ ID NO: 68673 - DNA, 2021 bp, Oryza sativa
acttttcgttttttatttttggcggaattattttaattaaaacaggggccaacctttttaaaaaaatagtgaatatcccttatattaggggacagaggtagtactagaactagtggataccccacagcttgatgtgggatttgaaaaatccttcaaaagcacttaaaaacaacattaaattaaaggccagacaataaaaaaaatacaaactgcatgttaagttactaaaatgcctgaccgcagaacatgaacagagcaaaaaccgaaaaataaaagccatgctatagttaatggtcctagtgaaaaaaaaaacacttctcccgtaaaaaaaaccaacctcgtactccaacgaatctggatactctctatgtccagattcgtcatactaaagttggtttttgctatacatcactagcatgtttttttccaaattgcactcaaatttctagcctttggatggacgtcaagattcgtgctatgttatcgggcccacagtcctttgtcaggataggatccgttttgttttggcccgtttccatccgaacccgatccacatgcatgtttttttttaacttccacaactccaatggctccaggcaacatcgttgaggagaggaggtgaatctggcgacgagcggcaagcgcaacgccttcaccgacgggaggagctaggacagctcgcgcagcaagtccacgagtaggatgccttcaccgtgacttgttattttaatatgtagatcttgtatgtctctacacccttcctaaggaggaaggtatgacataacaaggtgaggggggctaggacccggtcaggtcctgggctcctccctaacttgttattttaagatgtagatcttatatgtctctacacccctcccaatgggggatgtatgacctaacaaggtgagggggccctgggacctggcctaggtcaggtcctgggctcctccctatcttgttattttaagatgtagatcttatatgtctctaaacccctcccaaggagggaggtatgacataacaaggtgaggagggccctaggacccggcctagatcaggtcccgggctcctccctgacttgtaattttaagatgtaaatcttatatatgaattttgtatgtttcgacactcctcttgaaagaggggtgtgctacatagaagggcttaggggacttcgggacccgacacggggtaactctcgagcccccttccttgccacgtggatatttttaatcgctgctaatcaatgtgttttctttatataatgagaatataacctcgggtcctcggggaaaggggtaccctggttcccatttcaccgacagcaacggaaccaacggactaacacccaacaccatagacgacggcagggaaccatgatgaaaccctaattttcacttctcttcaacttcaccttcagggtggaggaactatatatatagagcaaggatgagtacttacgtactcaacacgtcatgggaacataggtgttgagtgaaagcatgaaagagaggcaagattgttttgcaaattctttatttggaaccattttgaaaccactaagtggttttcttctttttaagtttaggtcgaaaagagacttgtttctcgattccacttaagagacttcccaggtcggttcattaattcttggctcccaaagccatttcacttgattaagcagctccccgagccattgtcagtttctcggacttctcactgcccccatagcacaacaatcttcttctactcagtaagcatagtctatgatgccgcaaacatcccgaaacacacaaatccattcctgaccacctaggtcatccatctgccacaaaggttgattctggtaatgagtctcaatccacaatacttttcacaaagcacaggcaaacaaaactacgcaattggaaacacttcacatctgtagagggatatactttacccacacaacacgaaacttactccagaaaatagccggtgtcggaggtttgtgacaaagccctttccaaccccaccccagg

SEQ ID NO: 68674 - DNA, 727 bp, Oryza sativa
cagctcatggttaactaatcacgctataatggaccgccctggcttcctagcgcacttttggtgttgagaacaggtgatggcaaacacagccttgattcgttctggagatggaaaagaactaccacagatttagtaggggtcaagaacaaggctacttcgaggacatcatgcatgaaaacgtctagcgcttttgaaacatccggattattatacattttgtgtgcggtaaacatatctacttgctatgttagattaatcttctcatacaatcgagggagtcagcgagaacaacctcagcacggacgagcattccataagaaagacatttcataagcgctactttggaagaaatgtacgttctttgtagggcaatatttcgtgaatgattggactgaggaacatatctaactcttcgttctagttttcagccatccgtgctggtgttgcacttaatgctggtatactgaatgacgtacttataggctatgcttctgagataccaatcgagcgaggctgaactaacgaaagactagtacactacatcatgttatgattgatggacaacaagatggtttcgatttgaactcagatgtatataaaacaggcgttaatatatccatgcgccagactttacaatgtcagggctttgatgacacataactaatggtaattggctaaatttcgggagccaccaccagatatcgtgttctataatgaaacaacctat

SEQ ID NO: 68675 - DNA, 5931 bp, Oryza sativa
agctcaagcgccctcgccaccatcgccgtgcgctcaacacgggcgctttccacatggcgggtctcatgcccagcaacggcctcctcacatttggtgagctgctcgcctagccggcgcgccgccacctcgcggcggttcacctcggcctcacgctcggcgagcgcggcatctcgttcccgccacgcctactctcggagccacagctcctctgtgcgacgggccactaaagcctcagtggcaatggtggtctggttgcgctcggtcgcggcctcctcgcggaggcgaagggaggattccgcctcggccgctgtcgcctcgtggacggccaaggtagtctcgtgctggtccaacgcgcgcgcccgctcctcaagcgctagggcccgctcctccagctcctgggcccgctgcgcctgtgcccgaccgcacccctcctgttcgcgttggttgcgatcgaagacctcgatccgccggcgaatcgtggcctcgaactcctgcgcgaagcgggtgcgctcgtccaaggccttgcgctcggcctcaagcgccaccgacggggccggcagcgaggcgtcgaccttcgatgcccgccgcacttgggccgcggccgcgtcgaggaccccgcgggcgtcctcaaccctcttcgcaaggacctcggcgtaggcctcatactgcaggcgaatgttgcccagcacctcgtctaaggcgcttgaggtgatgagcgccgcctgccgctcctcctccgtctcacgcatgaccgagtccagcgtctcctcgcgcgcctggatctcctccagctgggcttggtgcattttgcgccccgtctccctgcggggaccccaccctttcggcggcgggggcgggttcaattttttgacccacgggtgaggtggggtcggggccccacatttttgcggggaggggacgggggaggcatttcaccgcgggtgacccgcggggccccgtgggatgtaaattaaaccttaaaatgtagtccatggaagacccaaaagagcccaatccaacaatagtctaaaatataaaaataaaaccctagccttatcctctttcctctcccaatctcctctccccgtcaccctcacaccacacaggcggcggctacgtcgaccgccaggcatgggcggtggcgacggccagggcgcgggcggcgacgtcgatggcctggcgcaagcggcggcggtgaccagggcgtggccggcggcgtcgacggccaggcgcaggcggcggcggctcgcctcatcgtcttccaactcgctgtcctcgtcgccattgtctatcttccagtccaccggcccaaccgggtagtgcggggccctgctcacccccaaggtccctgtggggatcggggctggtgacgttttccacccaaccacctctgcggggtcaaggtcggggggagaagtcgggagcgggggcgggggcattccagctcaacccgccccgttgtcaaccctaatccgggccatgacatatgaaattcaaagactcagagagcaaaaaaagtttactggctaaaactcaaaagtactacagctccaacttgagacgtttctgaacatatttatacattccagcatatcaaaacactactggagaaaacatctttgcccggtcgagcaaaaaccacaatagtcccggttgcaataaaaaccgggactaactattatctttagtcccagttcaaaaggttcgagctacttttttatctttagtcccagttggaaacaccaatcgggactaaagatcatttttagtcccggctaaaagaataacaggcggtgccatacccctctaactaaagatatgtttctagtcctggttggtgtaaccaactgggaaaaaagatcggcatgtgcggcggagaggccaaggcgtgcgcgagatcgaggaggagaatacgggatcagttaataagttctatctcctccaccctcaccttatctcttcaccccatctcttcctcttcttcctcctctcctcattctcttcctcccttttctcaggtagcgacgggcagcggcggccgggcggaggcggaggcagcctcacgccgcggcggccgggtggcaacggatccgggaggggaggcggccggcgaggaggccggtgcggcggcaggcggtggaggccggcgctgctgctgtattttttttcttttttttatttttttcttaaagcgtgattcaatctgtgttgaatgtgtgattcgatctgtgttgtggttgtgaactatttggggatgaactattgtgtgaatgatttgggatgaactatattgctatgagtgatgaatgtttgatctgagatgatttgggcaaatagcaaaagaacagtaaaaaagaaaaagagaaaagaaaaaaaatgaaaaaaaaaccctatagtcgggaccacatctttagaacaccaaccgggactaaagtcccggattcgccgtcccggttgcataaccgggacaaatagatggttgccaaccggcggcaaaatcggttgtgcagcagtgaaaggcttcaacccaagcgatacaactccagcttcacaggacaactccatcttgacccaacagaactcagtcttgctgatgacagtgcagtgctgtagacgtcagttcttccgcacattgttccagtttgatttgatcctcctggctttgtaaacctgaccaatataagagggaaacaaacagatgaaacacaccatatcaggagacttgatcttctttatccttcaaaacatattacgggccggcttcctagagggcccaacacatggcggccaatcccgcaatgtgattttttttttccatttggtatataaactatgccctgatcaaaaattgctcgaaagagttgggacgacatttgagctccaaacacataagccattagccatgaggctccaaatatatttggccaactcacagtgaaaaaaaaaaacaggtcgttgacagtctccttttccttgcaaaaggcacaagtttcattaccattccagtttcgtcttacgagattatcttttattaatattgcattgtgtacggctaactaaatttttttttatctttaatggtagtttagctttcaatgcaatttatatgatgtggccatatacagctgtgttgtcacatcctgattttttttcaggatttataaattatttaataaattattattagaatttatattaaatgttctttaatttacaagtgaagttaaatgtgggaaataaaatttcctaaatataaagcatggatggatttaatttttattaaattctccatgattaattacactctctaaaattttctcggatttttcagagctcaattcctaaatgatacaaagaacagttcagtaattatttgatcattaatgatctaattataattgttaggagcttttcttgtttaaaaatccttaaattataaattgttgtttaaaaggaattattagaaatgatcttaaaagcctaaaagagaagatctaattttaattaataaattccaatataaaatagggccagataaaatttcattaaatactttacttgattctaaagttcctagatttttctgggatttatttgagccaaggaagtatttttaatcaatggaatatcatttcatgaataatttaaattgaaaaaggtttttaaaagtctcttttggctttgggccgaaagccggcctaaaacctctctctttctctctccctccccggcccagtcggcccaaaaccgctctctctctcctccccggcccaagccggcccgcatccgagccgctgctctcctctctctctcccgctgacaggtgggccccacctgtcaggcctgtcttcctcctcgcgccggccgccgctcgaaccctagcgccgcgccgccgtcgtctccttccaaatccgaccgtctttttcccaatccggtgaaatcaatagaggggaaatgatcttctcaatctcctctaccttttctcttttggaatcgtcggctaatttcgtttggaaatccgtggattcgagtttgattcggatcgacttctctcctccgaaccctagctttccttctcgccgccggtcgccgtgggcctccgtcgccgctcgctagcccctttataagcacccccgagctctcctctatccgccgccacctttgccttagcccgccgtcgcgtctagcgccgcctccgcgcagccctagccgtcgccgtcgttgccgtcggttcagccgcgccgcgtcgccgttgcagccgccgtcgtcggtcgtcgtcgccaccatcgggatcgtgaggtcgtcgtcgtccccgtccaccgcttcgccgccgccgaagaccgccggagcaccgccatcaccgtcgacccgaagaccgtcgccgcttcttcctcgtcgccggcgccgtctgttgctcttccgccgttgttttggtcaccggtgagttcgccgcgtcgccctctacccgttggtgtcctccgtttgcgtcgtcgcgccgtcgttcgccggtgagcatgcgccgcccgagccgtcgccggtgatgacgtcatcgctgacgtcatcgttgccgttcgccatagaccggtcgtagaccgtttagatctcggccgttcgttgtggatagggtagatctcggccgttcgtttccatgagccgccgccgtgcacccggtccaccgtgaacccgagcccgctgacgcaataatcctcttttccttttcaaaaataattcattattgcgtcataattcaattaaaatctatataagtgttttaatccgatttaatctttgaaaattcataactaattctttgtaactcagtttaatgtggttcaagttgcaaaagttgtgtaaaataaagatctacgtattaaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgagtactttatatgtactgtttatttggtttttattagtctttttcttcgttttgcgtgttagcttgtcgtttccgtcgttgcgaaggttcgcgagtgcgccggaagtattcaagaagactaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgattactttattccttgataccttgggatattataagtgtgtaacgttattattatgatggatttgtatattaaattgtcagtttgtgtacctcggctgattcctggacgaggattttatgcacaaataagttcggaaattaccagtgaatttccgggcgtgacaaaaatatgaaacctagcaaagttatcatcgctgaagtttggctagacccaagagctagcactaaccacatctccacatcctgtgccattttcaatttgtatccatgatccactaggaacccaatgatgcttcacctttggctcgtaaacatttgttgtgacccctattccatatatatatcatcccaatatattatccctgctttctacaaggaaaaaaaacatttatgaatcaaaataacgtaaatacatatacgaaattttgcagcatgttaattacatgaaggactgaatgtgcaacacttagaccctgtttggcaaaatggttatgggaggtggagttgggaaatgaaaaggagaggatgcctaggattaaatgagatgaaaagaatggatggctagaattgaatcttacctgatgggtggggcatatttttccaaacccattagctagtca

SEQ ID NO: 68676 - DNA, 2436 bp, Oryza sativa
ggcccgacgcggcgaggcggcgcttgacggactccgcgagcgcgtgctcgtcgggaggacggctggcgcgaggcggctcgagagcagccggtcgcgaaccgcagcgcgccccccgcatccctcccgccgccgccggattcggcggagatgaggcggtggacgagctccttgacgagatcctgggtttggtggtcgtccattggaggggctagggttcgagcaaccgattccaccgagcggggggggggggggggtttggtttgggggattttgcggagggaggcgaagtggtttcgtttcgtttctctctcctcgttttgtaatttttcggttttggatttgtgctgaatttggtcgtaattttgggcggggagaggaatcttttttgaaaaagggtgagggttgtgtgactgctaggtgggaccgggagtttcgaggtggggatgcgattttttttggtgtggcccactgtaggtggcgtgaatcgcagagaaagcgaagcccgggaccaccaccaggtgggacattggttcctctttttgtgagttgtactgctgatgagtgatgagcagaaatttaaaatcgtccgtgcacagaataagctcggtttggattagagatgatcgggatcaacaaataaagttgcatttcagccctacaaatttctctccaacattttatcaaatacggaggaggatagacttcaagcggaattaggaaaacagaaaaacagacttcaagtggaatttggaaaacaattttaaaaaatttgattataaattaaaataaaactcctgcaaagaaaaagctggaacgggatacacacgccatacacctgacaagacctctcctacttcgagcaagttagcagcatgtgtacaacttctcctatttctcaacccgttcatgagaaaagagatatgcacgaaacaagtatgggctccttcgattgctagcccatgaatcaattacagcctcgacaagctttcacaatcatcttaatcaaagaaatcctgcttataccaccaatccgtgttggagccatcctctttggtttggactatatcatatgtgaatggttacaactagttggtgttgttactggttgcgcctccaataggctcgcggatgtgggcgactttatggtgcaaggtggattgtatccaatccggtcgggggcaacttcgttagcatggctggcaccttcttgcgaaggtagccgcactagtcgatgttagggataacctcgtcgacatgcaatgttgcagtaaaggagtcgttttacgagcgcatgtggttcttgtccttcaccactagtcccaatgtgcaacaggatgcttgccaacaagctcaatgctgcacggcattaaccaacatgcagtgtcttggttggcttcatacttgtcttgtgctgatatcggtagacatgcttcttcaccgtggttcgatgataagggaacttgtttccgtcgtccaagaatggtagcaaaagaccggggcatgctttttacaaaatggatgcatcgaggcatcgatgaactagcgatgctcagtcatatgtatcttgcttggtacctcaatatcaatcagattcggtactttttatgcatatagtataagacttgatatttatcgtgttgtttcggaatggtatcccgtacaacagcgtaaaagcgaaagaaaaattaaagtaccagtataagaattgctataaatcaaattctatatcacaatataagaatttcttttactaatttatcatgtttcacaacacttaaattttaagtgaaaccaggtcaatttgatgcttcaaaagggaatctgatccgttcaaaatcttaaaactaacaactgaagtgacttaaaagatacggagtactaaatattttgatctaattttaatactactaaataaacaaattaaaagaccttcatatttatatcttcaaactgagagtttagatggagaggtagaagtagactctgcagaaaggggaaaaaaacagaaaccttccagaccggagtggagcctctctgtcccgtggcggccatgtcagccggaagcgaaagagcccacgccgccttcgcgagcccctcgccggtgtcgggggccttcttctccgcctccggctcaatcctctccggctcaatcctctccggctcaatcctctcctcctcctccgccgctgtcaccaccaccaccagcgcgggtaggaccccgtcctcctcctccggagcgcccacgaaaaagaagaagaagccgccgttccgccccgtcgccgacgacaccaagcccgtcctccgcgacccggttcgctcccctccccatctcagaacccatggggtgatttggttccttcccattaatctgttcggtgttgtgatttctgcagatatctcggtcggacccggtggagaccgagcaggccgtgctgc

SEQ ID NO: 68677 - DNA, 1789 bp, Oryza sativa
cgcgagtgcgccggaagtattcaagaagactaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgattactttattccttgataccttgggttattataacttgactatttgagctttatatattggttcagctagatattagatatgattgcttagccatgcttagaaacattagcacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataaggggatgattatgatccaggaatggtgcactgtggtgagttgtgttgtacaaagggtattgtcacaacctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgctataactggtaataatttgtttagctcctggtttggagttagatctgtacggccgggtatggttgttcagaatggttgggcctgtgcagcatgggtgtgttgttcagtgttgattaaaatttctgattaattactccactgttttacttctcttaaatgttttgctaaatgctgcttttgcaaatgagcctatattatgccatcctttggtatctttgtgcacttgcatatttgctgtgtggcttgttgagtatgtcatatgctcattcttgcaataatcaatcaacctcagttgaagaaaaaggatccagaaggataagacgtttggcttataccccagttgagctgcctgtgggagtggagctgaagccatcgctagaccgttattccgctgctgttttcttttcttttgtaagtgtgtaacgttattattatgatggatttatatattaaattgtcagtttgtgtacctcggctgattcctggacgaggattttatgcacaaataagttcggaaattactagtgaatttccgggcgtgacatgtgtgaagatggttgtacgttgactttacagaaaactaaactggccactggggctcctgtcacgcccagaaatttgacttccgtcaaccagaagtcacacttgctgaacttggcgtatagctggtgctccttcaacttttcaagtaccagacggagatgttgctcatgttcttcctcggattttgagtagataagtatgtcgtcgatgaacaccacaacaaacttgtccagaaattccatgaacactttgttcatcagattcatgaagaatgcgggtgcgttggtaagtccgaaggacataaccgtgcactcatatagcccgtaccgagtggtgaaggccgtcttcggaatat

SEQ ID NO: 68678 - DNA, 14121 bp, Oryza sativa
  unsure (1)..(14121): unsure at all n locations
agcgaggagccggaggaggaggaggaggcccccaccccgaggcggaggaagcgatgagcccttccattgagtcatcggaggaaccatccgccgccgccgccgccatctccctggccgcggccaccgtcagcgagggccccgtgggaactcccggccctggggccgccgaggaggaggaggagagtggcgctagcgccatgtagcatatggttgcctccccgccgctgtgtctccttgttgccgcggctccctcctcgccgggcgccgtcgccgctactccggcgaggcagcgaccccttcccgtgccgctgctccccaccgccactgggaacaacctatcaatgcgagggtcccactatttttttattattttgtgtgtgaaattgacatgtgggtcccatgggtattattattatttttggatcgaattgccacataagcgccacgtcaatgtcacgtcagatgaagaccgagtcaaactagccacgtaggtgccacatcagccaaaaccgccatctaaaccaccgagggaccttgagtgcaccggttttgatagttgagggacctcttgtatctggtgttgaaggacgcaaatcggattcgttgacaagttaagggacctcagatgaacttattccccttcctgtccacacaaacctgcctcttccgacccattccaagaggctcatccagcccacgaacgagctctctcctctctgggccgacccaaaactgccgcttccacccactccaaccggcccatccagcccacggcccccgcgtggcgccgccactaccacggccgcattggaggaggagaggagaaaaacatattcagcacatcgccggctcgcctctccgccgccgccgccgccgccgtcgccgccgcctgcctctcctcgccgccgtccgatgcgggccctcctgcgcgccgcgtcggtgctccgccgcgcggcggctccggccctcggcggcggccgcgccgcgccgcttccccccaaggtttctactcggggctcctcctcccccccccccctcccttacatctcgttctcctccctcgcctcggttcccgtcgcccgtccggtcgtcggtgcggcggcgggtgtgatatagcgcgtccgaatacgacgcctcctccggctgcttcgtttctcgtcggtcgctgtgttcggggtagggtttaggggctaggagggatttaggagatactgctcccttgtggccgctgtgccaattacttggttgttttcatgacgagaatttgtggttgggtttgatgccgtggagtgcggaatgattgggagtgtaagaaatggggggcactggatcgcggtggggttttggagcaggtttgcacgaccacttagatccaagttatgtgcagtttgagcttgggtgatttggtcaggagacatatcatgaactagtattgcaggattctaggctaggctagctaacatgttaaagtcttgaagaactgttacaatctatcttccatagtgtagaaaatgttccagctacacatgaactagtatgaataattccccattgtagaaaaaggtttaagtggcaataaaagactgtgtaagactgttccagaggttgcgcataatccaactagtagaacaagagtggagaatggatattggttgttttcacatttggattgagatattttcatctgcactcgtattctgtcctgtgtgaatttcgattcagttgggacttattccagttgccttccacctacattcttggcttgtcaaaattctaatcattcaaatttgtgttatgctttgtgctgttgatggccaaattttggtgtctccttagtccatggttttgaatgctatttgggttgaaaactcggctttttgtgtttttttgctcaaataatgctccttaggtatgtatcatggaagtttgatcctgcattgtaattcaggcacttgttttatttgcagaacttgcctgctgtctgtttgaatgggtattctactcttttggctccagcaaatgaagtgctgattccacaagaacttctatccagcaagactgtttggactccagatcgtgagcttggtatctttctactactatatcctttttgcatgtttacgttttgcatgcttccttcttaaaatgctattttctcaagatttacctgctcatgtttctttctagctagcatgaatttgttacatgatacttttgcattgttaaattgacaaatctgacttttatctaatcgaatagaattgtacataattcaaaattcgaaattcgacttcacttttaatagtatgattgtattgcaattggctgatgcctgactggaggatatatgtttcctgaacttggctgagttataaagtaatctgaaattctgtattgcagggcagtatgaagacctagtagcccgagtaacaaacttccacaatgaggataagggcttcatggttttagatggtgatgtttttgatgttccaatcaggaaggatattgttcatagagtagtaaggtggcaactcgctaaaagacagcaggtgcaacctgatatctcattttctttgcttggctccaattctcgtctcccacactattgcgatctactttacgagattttctgaactattgtggaccttcctgcttcacagggaacacactcaactaaaactatcagtgaagtgagcggcacaggaagaaaaccttacaatcaaaaaggaactggcagagcacgacatggtacactgcgcggccctcaggttatgttactatttcgaatattgtctggcataaaagttgtttatggcctgtagaggtatccacatctggtttggatttcattttatctaaagttagaccaaaactgaaacagtttcgcggtggtgcaaccatgcatgggcctaaaccacgaagtcatgcgattaagttgcagaagaaagtacggcgtctgggacttaagatagcattatctgctcgaaccgctgagggaaaggtaactgcagctttactgaaattactgcattccttctttgatgttctcaattgtagttagcgtttgcctcatgcctacaaaacaattgtgctctagatgaattgtttgtattgaatcttcactctgtattatgttcaaggtatttgctaactgcatgcatgactgtctgctttagttcacaaaattttttgacatgacagtttgtcacctgaaagacttccttctcttttttttttgtttatgatggagtgttctgtgcgatctcagttgtagttagcttccccctcatgcccacaaaacatttgtgctctaaatgaattgtttgtactgaatcctagttcagtattattgtccagaaataatttgctgatagtatgcaagactggctgcttcagttcacaaaaattggtggcacggcattttgtcacctgaaagacttccttttttttttgtttgtaatggagtgttttttggggggagtggtgtttgcctgtgtgggatcctttgctgtgaagtttaggaagatggtctgatcacttacatttctatcaatcctcagttgcatcctgttcctctatgtttatattcaaccaatgttatctgcacgccttactgaagataactgtatttatgggattactcgctcctataagctctcctgcatataagctatcttgacattttctggccttcttacaaatgcctatttgacaaatatttggagtcatgagttcattcttcaccattaaagtttgcttctgtcattttttggtagctcttggtctttgatgacctcgaagttcctagccacaagacaaaaaacattgtgcagtacattggccagatggaaggcacaaagaaggttttgttggtagatggaggtgacattgataagaagttaaagctggctacccagaatcttcactatgtgaatgttcttccatccattgtgagtgtctctgaatctcatcacttgattggagtaatgaagatggcatagttttccaggcagattatttcactgatgcttaaatatcatcaaatgcagggcctaaatgtatacagcatccttcaacatgacactcttgtaatgacgcggaatgctatcaatagaattgttgagcgtatgcacacccccatcagccgctagcatgttgagattcgacgtgaacaccactgttttgtagcagatgtacttcgaccccctaaagcttcatgcatgccagttttcactttgctggtgtaaggcattagcaacaacacaattttccttttcctttttgaaaatgatctatttgcttctgctagtgatttcagtgaaccatgttgcgtcagatccaatacatcaaagtaggaagtgaattggtcatcatggtgtgcgctcatgactccagatttctaataaagacagttctgataaacttgacatgttattcctaagatttgctattcattacgaatttgtctgtcaatcatcattttgccctagttcttttttttttgttctgcaagtatgcagtttcgcgtttgattgtggaacacactttggagacatgaacaaaatgtagaatcaacatatgcaagcaagcaactttctgtacttcaaatcatggtcaagcaattccattgtttatgtctgtgtgttaggtggcatataaaacctgggttttagtgtgccatttcttaagttcatattcccttttgttttgtcccagttcataaaatgtaagacatcagagtttaaactatatgttgtgtcatttacaagtcacaagttgccccagataagctttcggatcttgtcatgatttaaattccgcattgacaaagccatattatatggatgtaagaaagatatcaataaaaacgattaaactccacggtgttgttgtacttgcttcattaaatttcatcacaaattttcagcagttgaggctgctccactccaacatggacgtgacagcaggagtgagtgagcaagaacagctttgtacggtagcctttcccatcacaggtacgcaacgcaagaatccctaatcatgtcgtgagctgcttaatcacgccatgcgtgtacgtgatcctaggggattaagtgaattgaaagcaggttaccaagggcaatatactctaaccacaccctctgtccatgcccatctcattggtgccaattgtaattaacagagtgattaggagatattaggatgagataaacaaacataattatgttagctaagctaaaccatgttatttttttgtgccaactgtaatgaagagagaaacttgggaggatttatgttagcttagctaagcacatgttttttagggtgccaattgtaattaagggagaatttatgagagattgggatgagataaattaacactattatgttagctaattaagctaagcacatgcttttgtgagggttaggttggtcaaatggtacgagcgtgcttgctttgggggacaagaacatccttcgtgtactcagaaggcacaagacaaagaaaggggtttttgtacgaaaaggtgaagcttttgtgcctgcttaagggagtaagtaggaggagcacttcacacccgtgccaatgcatgtacactaacactacagtgttaattaatcccctttctaggcaggtggtgatgatgatgcacattgcactacgtgtccttttttatttgtcacgtacattgatctctttaaaaaaattgtcgatttctcttggtgtgaattggagacctgctatggtgctagatagggcctagggacaaagttgctcaacatctccacctccactcaccaaggtttatgatctcgattgatttttctttgctaatttcaaaggaaaattggcacatttagaatgagttttgataatttttccgttgagatgcatagttcgagccttgagacgattggaatcgtaaaagttgatagaaattagtcgagattgtgaagcctgctacttacttggaatcaaatcatggggttgataatctttatgtagcggatgtaggatttatgatattttttttatttttcaatgagccatattttgtaagatgagtttacgaaaattcattggtgagattaggcatgaaagactattagtttagccatttgttaatattctcctctttttggctacgggattggctcaaatgtccaaaaatctcgtcaaactagaccactcatgaaaaaacctataatgagaaaatgatggatgaaagtattaaaatttggcagcaacaaaggcatatgccctttcaaattattattccccgttattttgtcaactctgtaaaatcatgaaaatttatcaatcaaatgaccctatctctcacacagagacacgctagatgacgtcgtgaaccgatggcaccgcgtaaaaaaaatatagtttaagttgtaatcatcctaacataccatgatttaggtccatctttgatcacctgataacaacttagtaatatattcaaacgccaaaaattcaattaggatcacatgatctataaagattagttggtcaatccatcagaagaagtcaaagctgaaagcagcccccatccatccttttttttcctcctcacggttcagacttgagacacaccacaccagtcctctcgtagaccaggtctacagacagagcagcacggttgccagctggccccgtgggccccaccggcccatagccgttgttggctcgggtttggttaagcgcgcggccgcctctctcacctaattaacccgcgtccaccatgggccaggtccacggtgcaccgccgcggcggctcacccgcacgcggctcggccgaccacatcgatccagcgatggccgggtcgggtcgggtcgggtcggttgggcgtgcgacgcaacacgagccgttatccgcgcccggtttccctcctcacggctccacctccactcctgctgctgctgggttgtctgctgaattgggtacttagtagtagtagtatttttctttatacatggtttatttggtgtttggtttctcggctaaaaatattaccatgattgaaaagtactaaggggatgttggttgctatcttcaatgtaccacatgcctatcttagttatgccataatttttttcaatcatttagttcattaccacaaatatggctcgccgcacttttcagtcatatggtctcacgtgtcattgacctatttttttttaactaagcttgtctaaggtttggctgagaatttgtgagccacaactaattgcctcaattgtggtttggcagtgttagctactagccaaacaatcctaagtctaatgtggttttggtgtgtaaaaggatgaagttatttaggttcgttttgggtcctcgagacgcggtacgttacgtctaatttagtacgattacgatgcaaaaaatagacgtgggtaataaaatacgagtaaaagctcgacgcggtgaaataaacgtaggggaataaaataggagaataagcaaatgaactcttggctcaggggcagcgcttggcaatggccacgttggcacgctacctatctgcatcggaccgggggatttttcccatatggcctctaggttaagtcccaaatggttagggtacccacacgcgtgcgcgttcagtggtatgtcatgttccccgtgcatggaagctttagcttctccaagtctttagcttaaagtatttgttggacacgcgtgtgcgtgcatgtgaagttgcatgggtggtgtgatgtgtgtacgtcctttgtatcctctcagaagaaatatgagaagaaagtctttgtgtaaaactaactcagcaatggaattaaatttgttagatggttgttatgcctatatgccatgatatgagaatagtctaaactgagacttaggtcatgtttggtgggcttggattttgaaaaaaaaaaactttccatttctaatttattttctgtattttataactatggatttttagaaaaaaaaatgaattttatattctatattgtttggacgagtggaaaattatgaaaaaaatgaatctgtcaaaaactcttccaaacaaacagctaatttgataggattttttctatataaagtaatacttagtattacatcatttttagtattttatacagtacctacgtattcttagtgttacaccttttgtaaattaacttaatgattcatggctagcatgggtttataaattaatgtttctctaaatgaaacgagggggacaatgccgtacattttaagggggaggaaagagatagaaattcaccagggttttaaaagagaattttgttagggtggcgttttgcttgtgaaaaaaagggtcattttctcgaaatccaaacaaaatcaatgtcaacaatgtatcattgtaacatccgacggcaacgtatcagttactcattctcattgtatagtcctgtaacatggaattgcaatttccttctctttttttttgttgttttctactttttctacctagaagtgtactaaaagtagatagatgtatagtgacgtatgcggctggtctccagctgcattcaggttctttaattctgactttgtgaggcaggttggtgggaccaagtttgacttcccccaaaaaaagagatgattagagcaaatgcagtaaagatcatcaaagagtaaagttaaaaagttaaggcgaatgtgcctcacttaacaaagctgttaccaccaagagaaacttaacaaagctgttaattaattaattactcctacccctggtacgtaattgccattaacttaatgtagcattaccttcctgattttttttctaccatttctatggataagttttcagcataatttaacacataaaattttaattgcatggacatgggagaatcgtataagtaaattaataaccatgacgaaatgaatttatttgcatggacatatatagaagaatcttgcaaataaacaaacaagtcggatgaaatggcacagcgagtgtgacctgttgcatgttggcaaccatgcaacgtacgcgcaactcctagtttattgcttggggaaagaagattagtgcacatgcatgatgatgcaatagaacaccaagaaaaataaatatggccaagacataagacaggtttagaccaggggagcaaggcacagattacttaattaatcggcgttggcaatacttaaatcatttggatagctagattcttggattttgcctagcttagctagtgcatgaatattagaaaatcaggacagcttgaacaaccgatttagggaaaagaaaacaccaaggtctaatttgtataggatccttgaggttgaaaccatttatacaatgaaaaatctgtatggataaacatgaccacaatttgccatagatttaggcttagtttaaaatagtctaaacagatgaatggatgatagattatttaatttttatgatattcaatagtacaaacagataaaataaacaaagctgaaaatttgttttaaaaatattctaagcaatttatatatatataaagcttttgaaaaaagaaatcagaccatttaggggagcttaaaaagcgtgcccgtaaagaggggaaaaaaataagccttagtctttgtccatcgttaaaatctacagtatatgacatccagcttattttatcactgtttcaaaataaaaaggagagcttattttaatttatcacacaaagatatgaccaaacatagcttctcttctaaaggaagatggttacaaccagtggaatttcaccactttagggaattatactgcaaacacaaactgttaataatagaaaaaaaataacaccatagtttattttcttgtcactatctgagtgatgattgatattgattgtatataaaaccaaacaaggctgtaaatatgggtaaatcaagccgttgggagcattgatatacccccggggaagacgatgatccgatcgagagtagctgagccgactctctctctcactctcgtctcttggcagatcagatcaagatcaccatttaattcctacatactcaccgtgaccaaatacgtacgttgaccataaatggccatccatccacaatccatccatctgcatatgcttctctcccaaccccaaaccgcgtcttcttctacctcccgctaagtacacgcacagtacgacacattagtagtcgtagtcctcctcctcaccgccgccgcttctcctcctcctcttcctcctcgtcaccatcgccatattccgaccaatgccattgccgctgtcgcacgaatataacgtatccaaaaagacacacagcagcgacgatgtcctgtatgtgtagtcgagcacgtccggacgatgtacaaaattttaaatttaaagcttaagtttaaaacttaaatttaaacccgtgaaattttatttcttttcatcataatttatttctcgatattgactttaaactcgttaaaaatatatatttaaatattttttaaaaatatattattccttctttaataagtgttatggaaatatatatctaaatatgtttttaaaaatattatttttttgttaataagcattaaataaatatatactccctccgttctattttaagtgcaaccatgattttttcatgcacaactttgatcgtccgacttatttaatgtttttctaaaaaagattaaaaacataagtcatgtataaagtactatttatgttttatcatctcataacaataaaaaaatataaattataaaaaaattcaaataagacggacgatcaaagttgagcacgaaaaattatggttgtatttaaaatgggatggatggagtatttaaagatttttaaagagaaaatcagtggtagccaaaaaaccatgggagccacagcgctgacgcgcagcacagtggccaggtggacacgatggggttaggcttgtcctcgatggatggccgacttaacccccgcaattaacgcggattaatctcgccgcgaccacaacaacttcctctctgtttcactaccctctctctctctctctctctctctctacacgctttgcaattttgcatcgtgccatcgtcctgtctctctctcttcctcgagaaagaaaggaggagaggggataaagcgcacaaagagcagccgctttgtgccaatctctctctctctctctctctctctctcttctctctctctctctctcatcttctcctccccaaaaagaagagatcaccaattctgtggctgcttgtttcagctgcttaggattcccaagaattccattccaaagcagcagctgctcctcctccttgaatcttgggattcagtgcacgcctccctgcttcttccttcctcctcctgccttgcaaatcttggagctttttttttttttcccctcttctcttgtaggagtaggagagtaggaggggttggagtggaggagattggatttggtggtggtgttttgtgcggcggttgggggtagaggaaaggggagtttgtggggggagtggttagttcttggcttcttcttcttcttcagcgagagctactacagctacagctcgtgctcgtgcgccattaaagtcctcgcctttgcgtctcccccctctttctaccagcccacctcctcctcttcttctttggattagggcttcgaaggcggctgctttctctgcggagggggttgaattcttgcgattcttggaggggggatttgtcctgagtgatttggtatgtgggcagcatgaggaagctcttcttctccgagttgacctcctgcaaggagaccaagctccactccgcgccccactcatggcttcccctcgagaaagggaagctctccaagttcgccggccactccacctcctccatgtaagttctctctctctctcttgctgttacatgatgcgtttggcttgttctgaatcctgctactttagttagttacctggtctttgttagtagtactttgtgtagagagagattcacaaaattcagattttactggtatagttctgaagagctttgctggctggttggttggttggttgtgatgttcatcaatttgattcttggtgggttgtggttgtggtgcagagaatcgctgatgaaaatgccggagccggtggttcttccccacttcaagcctgcggattatgtggacatattggcccagattcatgaggagctggagtcttgccctcctgatgagaagtcgtgcctgtacctgctccagttccaggttttccgcggcctcggcgaggtgaagctgtcgcggaggagcctccagtccgcgtgggagaaggcgagcacgatacacgagaagctgatattcggggcatggctcaagtatgagaagaaaggggaggagccgatatccgacctcctcagctcgtgtggcaagtgctctcaggagttcaagctgctggatttcgtgtcgcagatctccaccgggtcgcatgagataagctatgatgatgagtcggatgtgttttggggctctccggtggtacatttccggataagagatgatatgattgcatgcgatcggcgaaagcttgctgctttgtcgactccgctgtatgcaatgcttaacggtggctttcgggaatcacatcttgaggttattgatatgtctcggaatggcatctcctcgattggtatgcgagcaatcagtaaattcagcttgacaggaaggttaccgtatttatcagcagatgctattttggaaatgcttgattttgctaataagttttgctgcaatggcctcaaggatgcttgtgagcgaaagcttgcttctttcatttgctcgaggcaggatgctatagacttcatggagtgtgctcttgagctgggttgttccatccttgctgctgcatgcttgcaggggctcctgaatgagcttccagagtgcttgaatgatgaacaagtggttaggatattctcctgtgcaagtaagcagcagcgatccacaatggctggaaatgcttctttctccctatattgccttcttagtgaagtctccatgagcatcaacgcgacatcggatgtcacggtgaccttcttggaaaaattggtggattcagcatcagattctagacagaagcagttggccttgcatcagctggcgtgcacaagacttctaaggaaagattatgctgaagccgagcgcctgttcaatgccgcctttaccgctggacatctctattcagtagtgggtttggctagactggcctctatgaggggtaataagcatttttctctcaagttgcttgattctgtcatgtcatctcgctggccacttggatggatgtaccaagagagagcactatatttggagggtgataacaagttggaaaatcttaacaaggccactgagttggatcctacccttacatacccctacatgtttcgagctgcatctttgatgaaaagacaaagcgttgaagctgcccttatggagattaaccggatcctgggatttaagcttgttctggaatgcttagagctaaggttctgttgctatcttgcacttgaggaccatagagctgctttatgtgatgtccaggcaatcctcactcttgctccagattatcgtatgattggtggtcgggtgtctgcaaagcagctgcgtatgcttgtgatggagaatgttgagcagtggacaactgctgactgttggatgcagctttatgatcgttggtcatctgtggatgatataggatccctctcggtcatatatcaaatgctggagtcagatgctgctaaaggagttctctactttaggcaatctttgcttcttctcaggtaacttaattaacttattttattgcacagaataagagttagcatgattaaaaaatgatacagcacatcagtgattagcattgtagatgtatagcacatggtttgcattgcctggcatgtcttacaccttntagtgtgtggattcatttggaatgccaaactaccagatggtttatcagcatagttgcacatgcctcctgaccaacttacatcatggtctaattcttgtgctagaatctcagggatgttgtgattaatactattttaacctctttttttcagattaaattgtcctgaggctgcaatgcgcagtttgcagctagctcgtgaacatgctg

SEQ ID NO: 68679 - DNA, 2021 bp, Oryza sativa
cattctgaagtagtcaaacaaaggtttcaaattgggttcttggtacatgaagtgtaattttaccttgttgagttatcttttaataccttcgtacttgaggcataatggcataatatgcatttgttcattttccaaattcgttggttgttatttagatcaggtgttgttgctccacctatgttaggaagttaagatgtcctattcattattgaattattaatgcaaatggcgctctcactattaaaattggctgtcctggtgctcataacatgccaaccatcaattcttctcataggtgcactgcaagcgtgatttgatttcctatcaagtatctaacatgtttctaagttatgagttatgacatctgataccattgatgctactgataattgccaaccatatggatgagtggactgacttaaatgaaactttgctctcttttttttcatcagtttagctaaatggaccgaccagccacaatcagtacttttttctatcagcttaagctgacagtgtacattttatttctgtaacattggttgacccaatctgcagcattgtatttgatttgagatgttcgcgaatggtacatcttattcatcgtaatgtgtgacatcttgtaggctctgaacaaccttgggagtgtttatgtggattgcgggaagcttgacctggcagctgaatgctacatcaatgccctaaagattggtcataccagagctcatcaaggccttgccagggtccatttcctcagaaacagcagaactggtgcatatgaggaaatgaccaagctaatagagaaggccaggagcaacgcatcagcttatgagaagaggtcggagtactgtgatcgtgagctaacaaaatcagacctgcagatggtgaccaaactagaccctctgcgtgtatacccctacagataccgtgctgctggtaagcaccgcttcctgcctagcaaatcttgtttgttatgatataggtatgactgagacaagatttgtcatgatagcaaaccaccagtttcaaagcaggttgaaacttggatataaaatcgtggtcacagtagtttaatttgttagtagatgtagctcatcggtgtccaactcccagaggtttgtgctattataactaaccaactactccttttcctatcataagctggtaagaagtcaatgttgtttggcaatattctatgctcaacttgatcagttggtgtaacaaccacatatttcactcagttcaaaaattagctcatctgtttgatattctcatgcatcttttttcgctgatctggaatcctcagtgctgatggacaaccacaaagagaaggaggccatcgcggagctgacaaaagcaatcgccttcaaggcggacctgaacctgctccacctgcgagccgccttccacgagcatgtcggcgacatctcgagtgcactccgggactgccgcgcagcgctctccgtggatcctaaccaccaggagatgctcgagcttcatcaccgggtgaacagccaagaaccctgagccccccattgttgtacatacaggagctctacatagccaaccataccccaagtgtatgttttgtaccatacacagcagatcaatgtaaggatagtagccaatttaggccctccacccccaaaaccaacccaattccttgtgtccttaattagaatatgttgctcatcatagagtcctttttttagtaaattattatatttttgtgattaagcccccctcctaattgtaccctccatgtgccctcccccaaccccatgttcccaacaagttttgactatctcatgtgtaaatgaaaaatggaagaaaaagaatggagaaggtttgtgtcggcgtctgcgcaaaactgtcaaagttgatgctaatcactgattgcacatgtgctttgtttctcttctgattataaacaaaatgaactgatgaaactatcagaaacaatgccatgtggattaagaagaacttggaattgtttctttgcttaatttgtttattaacagcag

SEQ ID NO: 68680 - DNA, 24903 bp, Oryza sativa
aggagtatgcagaaatatcaaaactctgaatttcaagaattgcgcataagaaaactttcaaggagtatatgcagaaatatcaaaactctgaatttcaagaattgcgcacaggaaaatgatgtgtgtatatcatcagagaatatgagaaaaaaaatggagcaacttgtagttgattgcgcacaaatttgatcttttatatttcagattggtagggaatacagacatggtttttttcagacatgtgagacataaataaacactgaagtggtagcagcagcagcagcaataacaaacacaacctgccagctccaacaaatccatggaaatacaggcgctatgggtcagcttgttgtggccttgccggcgactttctgagctatccagccgagcccgtcgtagaggccctcaccggtgatcgcgcatgaggcctgtatgtgccaatcgtggttctttatgctgtggagggagagagcgtcggtgatctcagctggcgacatggcgtccttgagatcctgcttgtttgcgaacacgaggactactgcgccctcgaggtccccatgctgaagcagccggaagagctcatccttgataatgttgatccgagcacggtctgtgctgtcaattacaacgatgacagcatgggttcctctgtagtatgttgcccacgaagtccgtagactctcttgtcctcctaaatcccacacctggttcaataagaatttcagtatcaataacactggcatggaaaaaatgtcccagaagattgacaatatggtaaataaattatgtggcatgaaaaaaatatttgtcgataagtaacatgatattagatatatggaatcaggattcaagcaagccacagaagattgttccaggaaagaagtgaatttcatgtctctgtgatttctgacaagtattgggtatttgggtgactaactgaaagtctgaaaacactaagcagctacctttccttttgagaaagcctacagtagcatgtgaggtattataagccttatcaagaaaacatggaaatgcaaacatcgtagcgcttgtatcagtatactgtgcaggactgcaggcaaataaaaatgttattatgtgattttgctgtacaaatacagcaacatgtacggtgaatctgtgatggaaactagactatggaagaacaagaatatacatgcaaacttacaaagccgaaaggtatcaacaatagcatgcaaactcttaaagcaaagggatacatttcgatagcttcctgtgttggttcactcaactggttactaaactacaccatcgattaattgcatacagagttctcttcttttctttaaagaaaggtatatctttgatctatctgattacacctacctggagccaggaataaaggcgacaacaaagactgaacccagaaaaaaaatgtgaatgcagcatgccattccttacaacaattattacaagaaagtaccaggcaacattttattgacaatgacgcatatcgatttttgtttaattgtttgttactttgccttagatggaccttgatagtgcttagctctttcttataggacaggaaagatggtttgtcccagtgtaagtttggaatccacaatggcttcactcctagtatacatgttacatttctcagagtgtatatgaaaagcccaattcttttattggtccaacagggtaattggcctgttgtccttaagaaatgacatgctgctacttgggtagtgtagagtactatgttgagccaatctctatatcctatgaggtaaaaggatgaacatttgctcattcataaacacccaaaatgatttaagtctaaaactagagatgaacatggtttttacagggtgaatccagtccttaacaataccggaaaaagagcaatgatgaaacagcaaaaaggaattacagtttatcttgatggaataccactagactagatgaagcaaaccgcggctaccggatatgccttacaacaacacacaattctcatctgctatgtacctcactcgctgtcctgaacaaattcagaggtggattgagcgacaaaagctatcttggggccaggctaatcaagtatatcaaaagaaactacggattattaagactcaatcatttttcttcctttccctctacctcttgagcttaattcttcttatcataaaaaaataatcatgttttgaccatgatgttcatatctcaaagcatatatgacaagcctaattttcctattggtccaaaagggttagtggccccattatcgaaaaaaaacagggttattggcctaggtttattggctgagcaatgcccaattccagaaagacatgctggcgtgctgctgcttgggcagttgggctagtgcagagacaatgttgagccgatttctatattctatattaaaggtaaaatgatgaatttttgctcattgataagtgataacactcaacatgattagatctaaaagtaaagatgaagtgatgaacacatttttttacagggtattgttacagtttgtgttgatggactactactagattagatggagaaaccaaaattatcggatagacactacaatagaagaactctcatctactctttacctcaccgaatctcctcaggaaatcgaaaggtgggaattgagaaacaaacgttgaaacatatcttgatctgaggcacccagcgtctctcaaaaaaaaaaaaaaaactacagattacatcaacaaagaatctttttcttcttccttcctctctctacctcttcttgagcctaattctttcttaccaacaaaaactacgttttgaccatgattaccgactacaactactactacatgattgtgccgcaaccaccaccaccaccgagcagcaaagcagcagatcggcgacagctaccctgtcattagttagatcaggcgggggcctgaacttggcaagagaggagaagaaagcaaagagaggggaggggaggagaggtgagacctcgaatcggatgttcttgaagacgacctcctcgacgttgctgccgatggtgggtgcggcggtgacggcctccccgaggtggagcttgtagagcgtggtggtcttgccggcgttgtcgagccccacgacgacgatcttgtactccttcgccgggaacatcaagaaccacacccgcgacatccacgcccccatcttgtccctcctcctcctcctcctcaaacaaccaagagaacgacgaatctgaatctcgcgccgcggcggctggcggctggtggtggatggatctccgcgggaggaagtggactgcgagtttgggggatcggatcggcgatgggggtggaggaggaagaacaagaggaggtcggatttggaggaggaaaggtgagaagggaattgggtgtggatattcgtgctcgtgtcgtgtgcgaagctttcctctcatagctggccgagggtgaaggcggcgagagggagttgggctgggccttccatgggcttgggctgtggaagtagacatggtgagtgagccgccactaaaagaaataagtctattttgcatccctcagctcttgcccttggtttaatcgcatccctcgaccacaaaaccgggtataatacatccccaaatttcaaaaactagtgcaaattgactccttgggtggtttgggaagtggtttttgttgacgcggcgagttgacttggtctaagtgtgctaacgtggcacctaatcatcaaaggagttgaaaacagaacagggtcctacatgtaagtgacaacagtaaaaaagtattaaaaaaggtgaggcccatttgtgatccccttctcttcttcctcccttctatttctctcgcatcgcccgtgacaactgacaacaagcatgggttgtgggtgcgggagaggatattagcgatgcggcggcaattctccttcctcgtggcggtgaggttctcggcgggataagggatgcccgtgttgtccgcagcggcaaagctgcagaggaaaagaaacgggggcagctgtgcatggggaggtggctgaggagcggcatggaaaggacggaggatagcgagcttgatgtcctctctgcggaatccgacctcgccgaagaccatgctgacgtcggggtcgttgaggacaagccagaagagctcgcgccgactagccgcatgaggtggcggtggcaggccaccatggccggggtggtagtagatcttgtactccccgaatgccgccaccgtcctgctcgctctgtgaggaggatctacgtgtttgagtcggtttttaagcccattcacttttgaaaatacatatccgtatttgattcggtttttaagttcgttcggttttaaaaatacagaaagagttttataagaaatctctttaaacaaactcacatgctaacttgagatgatcggactcctaattacagcttatgattttgtaaaaaaaaaatcattcacccgttgcaacgcacgggctttttttctagttattacaaacttgaaaaatggattaattttgttggagaaaaagaacgagacctaaatatcgaattttgggattgtgccgcaaccgcaaccgcaaccaccgagcagcaaagccgcagatcgacgacagctacctgttaacgaccaaatttggtaagatatgaaccaggttcggcattggagtcgaagcggattcggcaaagagatggattcgaagaacagagtatgaatcggctgcgaaggcatcggctggagtgtgcgtcggctgagatggattggatagaagacaaccgatacagccgatagagatgaagcagccgattccgacggtagtggcttcaaggctgtttctagaatcaatcgacgtgcttcacatggattgccatgatggagataaagctcttacataggcaattatatctattaattaggatatcttatgtaatttcctttgagatatgtttgggcaaaagtctgccgcaaagacttatggtatcttagagtttgttagagataagagtcgtgtccggcaaggacatattttgtatctcgggtataaatatgactcgaaccatgtaatcaaacaacacacgttcaataacaatttcggcgcatcgccacccttttattctatttcgacgagttcttgctttcggattgagctgcatcaattcgatcttcaacaggtaaacttgtcatggcggcttgcgttctcgggattagcgcttccatctttatgacactctaatcttgtttatgtaattcctcgagttatcatatatactatataatctttgttagtttcgttatataacttgtcatcggctggtttttactgttagaaagtagccgatagagttaaatctcgttattgatctagattatatcgtatatctaccatctctcagagattttcatcatcttgtttagatcttacagttattttatatgcttaatgttgcatcggttgagttcgatctattaagttctatctataattgtgatatctagcttgttttatgatcatttatagagatagtatcggagtttcagccgatcttacctgatttagctattctaatatcatatgcttaattgttatgctaaatctgccctttatattaagatcttattgctttaaagttatattaagttcttatttgatatatcttgcttgtttcgatatcttagtatagagtggtatcggagtactagccgatacatgctagatctatctgatcgactatgctataaatatccatacaatctttgctttaacgtatatttcgacttaagtgattcatactgtctcggcatgacgaccgatctatcccaatcacttagattaagtatacatcgaagtaaaaactgtatgttgttaatatctatagccgatcgagtagatttagttttattttatttattaatcattgccgatcgattccaacatgacatcggctcaaagataaatgatatgtcatcggcaactagccgatcggctatcgtttatggatttaaccgcaatttttcttgtctttattcttgttgattgcgggatcaaatcaactggcacgcttatgaacctaaaggtgagattttggacctgcacaggagttaaggagatcttccaggccagtatgtgtttttcgcatcaacactaccctgtacttagataacctgtccttagatagatcaggtggggcctgagcttgccaagagagaagaagaaagcaaagagaggggatgggaggagatgagacctcgaatcggatgttcttgaagatgacctcctcgacattgctgccgatggtggggcggtggtgacggcctccccgaggtggagcttgtagagcgtggtggtcttgccggcgttgtcgagccccatgacgacgatcttgtactccttacatccacgcccccatctcccccatcctcctctctgtctctcctcctcaaacaaccaagaaaacaccgaatctgaatcttgcgccacggcggctggtggctggtggtggatggatctccgcgggaggaagtggactgcgagtttgggggatcggatcggcaatgggggtgaaggaggaagaagaggaggaggaaagggagaagggaattgggtgtggatattcatgcgaagcttcctgtcatggccgaccgagggggatttggcctgggcctcctttgggcttgggttgtggaagtagagacatggtgagtgagccgccgtcactaaactaaaatggaataagtccactaatcgtccctaatctttacgtctagtttaatcacatccctaaaccgcaatacgaatcttcacctttcatctttttcaaaaccgttcgacttaggtccgataccagtatggataggtgtttttgttgatgttgtatcctagttaggaaaaaaacatgcgagactcacatgtagttgagtccatgtgttaatcgggctcacatgtcagggttttcttcttctctcctctattcccatctctcttcccagtctccacctatcccctctttccccatctctctctagggaggtgcaggcgacgaatgccctgggggcgggtgggggggtgttggagagctgcagcggcgaggagttgcgcacctggcatgcatcaccaccaacttatgcatgtgatgtggtttggttgcgccggcgaacttcgcggagcttccttcacctacttgcaaatggcctccccctaaccgaactggatagctacggagcacgccgataataacatttgggtttcatggcaagtggatgaaagtaggatatgatgcacaattcgcttcccagtcaccttccaaatactctggatattcatgacctaatgagcaattgtatgtgcagtgcaaggagctgagaactaactgcaacgcacaaatatatacacctgaatgaactctactattgcaggtgtttcacacacaattcttagaaatcgatagatatagattcttggtttcctcccagtgccaatgacgcctcttaataatctctgcaattttcgtgtcaagaagcagtactacaaccccaggtgcttgatccccgccgtctctctcctcctactcgtcgtcatcctcaccgtctctaatacatacttccccttcccgacaactaagtcgcgaacactgtcttactcttccttctcctcctcccacggtgggcagaaggccgccgacgaggcctgcaacatatttaggggagagtgggttccggatcctgatgcaccttactacaccaacgacacctgctcggtcatccacgagcactatgactgtatgaagtacggaaagccggaccttggcttcgtgcagtggcggtggcatcccgacagttgtgatctcccccgtctcgacccggcgcgcttcctctcctccatgaggggtaagaccttggccttcattggggattcccttgccaggaaccacatgaactccctcatctgtctactgaccagggtaaaaaagtgaaaaacgtgccggatttgctacagtactagcttcgatctgacccgtcgatcgcttgatcggacggtcagaaatgggccagcagcaacaagggtgtgacgttttgttggccggcctgcaggtcgccgagccgacgacgagctggccgagcagcgagcacacggtgtaccactacggcggcggctacaacttcaccgtcctcagcttctgggcgccgttcctggtccggaacgagctcatcgacaccgacaggccggcgcacacgggcctatggaacctctacctcgacgagcccgacgcagtgtgggcgtcgcacgtcccggcgttcgactacgccgtcgtgtcggcgtcgagctggttctaccggccgtcgatgctgtacgaggccggccggctcgtgggctgccaccactgcctcctccccaacgtcaccgacctcacgctgcggtacgcgctccgcatggccacccgcgccgcgctccgcgccgtggtgggcggcggcggcggcgtgaccgccgtgctgcggaccgtgtcgccgtcgcagtacgagggcggggagtggaacaaggacggcaactgcgtccgaacgcggccgtaccggcgcggcgagaagacgctgcagggcgtcgagctcgacttccacacgctgcaggtcaattttttgaatttcctccattgatctagtgatcaattatcttgttctttctaggaacgtgcgttctgagcttcgtaggtggaggagttcgaggcggcgaagagggcggtgaccgcgagcggtggcagcggcggcgcggtgaggatgatgctgatggacacgacggaggcgatgatagtgcgggcggacgcgcacccgagcaggtacagggggtggacgcggcgcaagggatggatgaaggagtacttcaccatctccaacgactgcgtgcactggtgcgtccccggcgccgtcgacgcctggaacgacatgctctcacacatgttgctcacatcgcaaagctagttaggttattgatcaaacgaatgtagcagccaaaaaaacagagaaaaaaacattcattcctgaattcagtctagaatttaaaaatcgtcgtccatgatccatgtgaatttctagcacgtttgcacaagctgaactcaaacattttggtcctgtttgctgcattcgcaaagggtaattgtgattccgtctgtatgggcctaaatcgacctgaggcccaatattgccaaaaatttcagaacaaacttcgtaatcgatttggatactatattgatattttgtgacaaatctggaagaattaggaataatctagccgattcaaaagcagtggttgaactcaagttggctgatctcgacatgcagtcaaaagattatcagacagaaagggagagctgctgctaggttagctcatacaggtggccagtgcccctggtctcaaacaatcacacctgtttagcattttgattctttccatttcgccaagacctagtaataaacaggtggttatctcgtactacacgcgtggaatccaccatcccaagtgtacacttcattttaatttcgtaatcaaatcaatattcgtgacgaaaattgcagaaaaaaattcgatgtatatacagcaatctcatttctcatctcatttcatatccatgagctaagctagctatagtgtggatgttgaccgcccaggtcgatgatgaagtttcacgaggtgatcaagctgccatccattgctcattacggcctacgctatgtgctccccgccgccgccgtcgccgcgtgcgttctggtgctcgccgccgtcagcctaccgggccgcgtgccgctgccgccgctgctggcgccggaggtgacgaagaacacggcggatggcgtgggcggcgaccggtctggttgtgatattttcaagggcgagtgggtgccggacatgtccggcgagccgccgccgtacaccggcgagagctgtccggtgatccatgggcactatgattgcatgcggtacggacggccggatcttgggtacgtccggtggcggtggcggccggacggcgggtgcgagatgcggcggttcgacgcggcgaggttcctcgccgcgatgaggggcaggtcggtggcgttcgtcggggactcgctggcgaggaaccagatgcactcgctggtgtgcctcctgtcgcgcgccgagcggccggcgccgtggacgaacggcagctacgcgtaccgcttcgagcgccacggcctcaccgtcgcggcgttctggtcgccgttcctcgtccgcgccgtcgagacggaccccgacggcccgacggggagcggcgccggcctgtggagcctccacctcgacgagcccgacgccgggtgggcggcgcacgtcggcgcgttcgaccacgtcgtcgtctccgccgggagctggttctaccggccgtcaatgttctacgaccgccgcggccgcctcgtcggctgcaacacctgcctgtccccgaacgtcaccgacctcaccctccgttactccctccggatggcgttccggagcgcgctccgggcggcggcgacggggggcgcgcgccgccgcggcgggcgcgccgcgaggaggacggtgatcgtgcggacgatctcgccgtcgcactacgagaacgggacgtggaacgggcacggggactgcgtccggacgaggccggcgcggcgcggcgagtgggagctgaacgccatggagaaggacatgcaccggatacaggtcgaggagttcgcggcggcggcgaggaagagggggaaaggggcggcgaggatgatgctgatggacgcgacggaggccatggcgcagcggccggacgcccacccgagcaagtacaggctgtggcagccggacaagttcaaggtgtcgcgggactgcgtgcactggtgccttcccggcgccatggacgcctgcaacgacatgctgttccacatgctcatcgggtgatggctgatgccgttcttctcattatggctggtcgatgattatgtgcggtttattcgcgccacgattttaaatgtacgattcgtttctttttcaaaaaaaaaacagcattgtttaaattgcttgggagcctactatatggatcggatgtcttatttttttttaaaaaaaaaatcgttggacagtattgcaccgcactgttgaaaaatgtttcatctctcgataaaattgtttcaatgaaaatgttctaaatgtttcagatatataagagaaaaatagttctacgcttgagcataattgtttcaactaagtactctattcaaacatatcaattgcaacactaagaaatcaatgtatgtaatgttgaatcaaaatggaatgaaacatcttaataaagtgtaacaaaaaaaacacaaataagctgcaacatcactaaaattcccaacaaaacccacctctgacttctattccagccaccagaaccaagttcccggatcgacggagtcgagaaaatacactacttgtaagatgattctataaggtggacaatgaaaatgacatgtgttttcctccttgtgaagtgtagatataccaggagaatttggggggccattgcggactgggtcgcttgccgcaatctaaaccccgtgcaatggaaccaagccactacagtggaggactggtgttagatgatcacaagcacgagagaggcgccaaagcaagctgcacataccctaactcttttgatcaactgagagaaaccaacatatctcctagcatagggagatgtcgtcaagcgggcttatctttaaaattaaggaggtacccaagacgtcgcgtgtcgacgccaactgcctccctagacagatatggggaaagaggggagaggtagatactggagagagatgggaatacatgagtggaggggggagataggaggtagaagaaagccaccaagaaaccaaggaatcagagcaaggcaagaaaaagacaccatcgacactagccatcgtcgccgcgacatcaaaggggggggtactcacaagggggcgccagagctgacgggcagcggtgggggcagtgttggcccctggttttatagcacaggagaccatatatatgtgtacataataacaattccatggaccgatagattgacatacacacaatacatatctggtgcatcacattctgcatagcataagtcttacaatatttaatattacatgggttactcgaatagaccgagtatggttgattacattaaccaagatccaaaagatacggtacggaagtggaagctgatctgcgagtgaatgaaattgaatttggtcgcataacatgtatattttcatcaaaaatctcctgcatacaaatatttaccaacacttgtgataatggttagcaataaacgcctatcgctaagtttggtttttcattttatttagttttttgcaggagttggtggtcaaatttagcacttaagaatcgtcaacaacgtcattgtcatgtaggtgccacatcagccgaaaccgtagtccaaaccgtcttaggatcttatttgcactagacgcgtcatatctagtattgcggctcagggacgaaattcggactcggcgacaaattgagggacctaaaattacttgctaagtttggggccagaaatatcccggcctagctagctatctgttgctcttctttcaatgatatcgcatgtttcatgtcttctcgatcttcatcgagaatgaccaagagagcacgacatcgttgaccgtgaagtctcggtacgagaacgagtactcattttgagttgaagtcgggggctactgtcatggttacggataaagcataccttctatcctacaacttatgaaatatacggatacgatataccttctatcctacgacttatggaatatacggatgcggcataccttcgtatgtacgatagacttccgtatacgataagaaaattgacaagagattatggaaataatcctcacgggcaagtacgtaacagagttctactcagagagggttaggattatactatatcgtgcagggtctggggtctccaagttctacttagagactaaggggattcacggtataaatacataccccccgagaggtccatgggatcgaatcatagcaccagccaacctgccaccacaggagcaatccagaggacttgaagcctactcgcttgtagatctcgtcgagactctctcaacaaggatctcgccggtaatctcggaatcagttgttctctattgtactatgtggatttctatatcaatctcatataagctggattagtgttattacctcacgaggggcctgaaccagtataatacttatctccttgtctgcttgatgtcgaatcgtgtagatcctcgtatcaacgttccccaatacccatattatccggtttacgggtatcccccgttgacaccttctgttgacagaaaatccatcccaaatcatataaattttggatcactggatgtgcttcgcaatttgtgctccagtgcttcttcttcaactctggcgagttcctattcttcttcaacgccggtgacaacctaaactcggttagaggaccaacagattagggtcctaggttggggtggggtgtgaggggtaggagagggagggggaagaagggaaatgttgttgggctaagtgagatggccgtgggaggcggcggcctggagtgggtagcaaggcggcaccggcactttcgaaggcacggggttggtagctggctataggccagtattggtggcaagggcaaagcgaagcaacaagttaggaggtaatgagcggtggaagcgaatccattgacggggagttgctggagacgaggaagacggcggggtagaggtacctcgcagccactgaattgagaacgagtagaagggggggaggggagggggggaagaaggaggaggaggccggccagggggagggtgggaccttgttggtgccactgacgccttctgggcagccggcgaggccaggtggtggtggaagtggtggagttgagaggcatcaagcatcaaacatgcggtgtttgaggggagaaagaaaaagagaaagaaggtaggcttaggtttctgcacggatcttaaagcgatccaacgatccaaaaattgcaagattttgatgggtgtttaatgtcgaatgtgtaacagatagtaaaaaaattaatgatcaaatttaaattttagctgcggttgataaggtaacgagtagtaaatggaacaaatattactcatctcccgtctttgcaacataaagtaatatctatcccgtcttgttagtagagatatgaatcaatgtttgaacttttggtttgaaattaatttccaatatttcatgaattttgaaccccctgcacgaaactatttcgtccaaaatttccaatttcttttgaatttattcaaactttgttaaatacagtcaaaattagttcaaatttaataaaacttttgctcaaaatttcctcccggcgtaagtatacaaaacgaaaattgcaaagcctgaaagaggtctaatcgagtggccgatggcatgcatggtgttggtaggattagtcccatatggagaattcaggtaagttgcgatcaatatttaaacacatatgtttttggactaattattttggtgtactgtagtaggaaaaaaagaatatatgcttttggactaattttttttggtgtactgtagtaggaaaaaaagaaggggaggaggaagggggagaagagggaggaggtattgcatattggggggaggggaatgcggggtgatcgcttggcgcgcattagcagtccccccttcccttccgctatttcaaagtatccgtcttcctccctgtccacatgagctaaacgcttcctcttccctgagtcaaagtcttccctatattactactttgtattatagctgggttcactatgttgcatcatctcacagctaacccgaacatcactaacatcgcaatattctccttccgcgcccttcacatcagctacttccaccacctcccatgtttcaaaggtaaattcgtcgtggtggtgagattatgccttccttccgcctcactaacatcagctactataaaagcccttccttgttgcatcatctcaaggagctgcaagcacttcctctctggcagcacttcctcatctcaaggagttgcaaatgttgcatcatctcaaggagctggcagccgtagccggtatacacatgatcctcatctacctctgccgctttctcctccgccgcagccgcaacgtattattcaccgtttccaacagcctccgttttcgcctcaaggtattaactgtattgttgtacatatgtctctcggtcatgctgttctacctgtttggctccatcatgccgctgccgccgtggggcctcgtggtcggttgggtcatggccctcatcgccgtcgagctcgcctacgccttcatctttccatatagctttcgctacatcgctgacaacgacgacgacaagatggttattctccctgtttaagccttcagggcctatatatatagtatatatataaagccttccatactgtctcttcaataaaggctagcttgtgttgtgagttgtatctgtgtacgtattttgtttggttggttatatattgtcacgtaggtatgccatatatatatgtattgctgtatttatatttgttactatcttttgtttttcagataataaaattcagccagctttgcttgcttcgtcgtacgtgtatgctcatcatatcctcatccatcagctgctcatagctagctgggccgtgttatatgtgtgtagtgaccagtcacaaccatgtatttcatcccatgtatgttagtttgtttttcatttttgaaagaaaacatgcatatatgttataactcaaagttttgagatgaatttgatcatctaatttatttctgttttgaattattctgctctgttgttgcaaacttttttttttatgttgggacactttctcctcggtttgattgttatattgaattcgtcgattccagctagtatatatttgctagtttcactcagacaatcatgcctatttgctgatcaggaacaattgaaaacaaccattacagagccagacgaaattaattaatttacactcaccaattattcatcatcacatctctaaacatcgaattctgggattccatcgttcgtccccttcccgcagccgtcggatcgcggatcgacggtgacagatcgcttcgttgaacgtttttgtaatataccatttcttgaggggggtttatgcaaaatatctctatcccttacctcctcctacctcgccggcgtgacgctctcctccctcactcccatccgccgccggcgaggccctcttcgccgccgtgtcctcctcgtcgtcgctgtatggggcgaggccgcggccagcgaggggctcggtggcggcgcggggggatgggggagcagctcggcgtacgtcggcgacgagattcgagtcaacgacgccgcgccgcctctcccctcaaatctcggtagacgagtatatatgaggattgagaggttccgatcacggcgacggaacgaacccctcccttgttcgccatcgatggcttcctcgacgacagacagggcctccggcctcccactctcccaggtttgcattattcccatccctctgccgtccgtacagaccgtgtgagttcgggttgaagctaagcttcctccaattctgcgtgctcttgcacgaatcctacgaattccagaacctctttgctcaaatccaaggcttaaggcctttttttgttagaattaaacctgtatttccttataatattagttctgtttattcctgtacagaggcaagaaagctcaccagagaagcaagcagacaagctaccaattctgaggtgagtacttactcatctgcgtgttcttaattgaactgaaaagtgcatctagatgtgggttttttttttctgaattcagttaatttaacaaggtttccatatctgacatgatgcaaattttgctcaatgctttccaggtataatttgtagattaatgacctgttggatccatttcagcataacctttaggtatattctaatcctgtatttggtgtttgctaatggattgcagtaaacttttccaactccattattatagataagagagaatgcttgcaatggtgtacatgttgagaacttgatcgatgagtatgtgtcaacggttgaggacgtcaatgaaatcttgatgaagctataattttgatctacaagagcagcagaaagaaattgtcctttctattttgcttttaaaactagggtttctttgcttttcattttcacctctgcatggatgaggatcacaaccaggacctctgcttgagctaccctgtagtcacaaagacctttgtcttgataacaagctgtatttttgttaagatcacatatattagttcttgtatcatgctctctcaatactagttgtttcatgttgtcctaataactgagtcactgccttctcctctaagagattaaaatctgaattgaagtctaccattgctccagcgttattgatagcttgtctaagcttgtttttctttacagggcctttcaaacagaaaagttggcaccaccagtatgaacttgaaaaggttgttctcatgtaatattcacttgtgtcattgaagaatggagcaaggtaaattaaacctcctatttcttctgttgtttggagacctcataaccagctatatttaacttctcgtattgcaataattatgtcagtattagagcatttaaaagatcaatatgctttttggtctattctattctattttttaagtttccactaactgatccgcaaatatacatgctgtcattatcttgtgaatttaccttgttcaaccaaattacagggttgctcatcaaatggcttcaacagctcacggactagcagaattacctttgttgatcttgctggtcctgataatgatgaacttgatggtggcagcaagcactgtacaagagaagaaagataagaagcccctgtcaaaagcttgggtatgtaaatttatacgatggcttgtttgggcagaaatttttatgatgtcatgaaaattcatcactaaaatatcttctatgtttatttttcatgttaatcgggttctctttcttaatatgttaacactacagttaactgctttctttagagaaatatattaaacatctagcaataagaataaaaatatgcagtaaagcagaaaactgacttccacattgttacttcaggaaactcatcaatattctatcagaagcaccagagaccaagaaagatgactccccacaagtaatcctgtttgacgcgtgagctgacgaatacactaggtgttgcattcttagagcatcttcagtaatagctcctattttacagtccctaaaagtacaataggggcttcccccatttcctgagtacctaaaaaatacctttaactccagcagcagtcccttttctcaccccttatttcatttcatcttctattttaacatatactttaaagtactaatatatagttctatactctacgctactcctagtatgaaaccataataatccaaccatatttaaattcacaattcaaaacatcacaattcaaattcgattttttttaaaaaaaataaaatggaaatacatatcctagtagcctgtattcatagctcgggtgaaacgagcttctgctgctatcgcgcttccatggagtttctcacatgtgttgatttttcctgtcttctcatccaccaatagacctgctacttctctcgcgaagcaacaaccaagcaaagcaacaaaaaagctgcatagcacatcgcatgtatcactttccccatctaaaaaaaatgtaaaattccattatctaaaaaaatgtatcactttccccattcttcttttgtcccacaatcgcagctgctagtgctaccctgctactactgtctcaatttcgcagcccgcagcagcacttgaaccatccagtgccttgacgccattgcatgactcggtcactaggccatgtttttcatcgagttcaggcggagggtgcaggctggaggagactccaggcacggcaaacgcgtcggccggggaggagcgtcgggcagaggagggcacctgaaggaggacacggtaggcagggaggagccgcaccggccggggatgagcactgggcaggggaagtgccggcggaccaagaccacgtcaggcggctcccgcgcttttccaaccgtggatgggggctgtgcagtagagcccctgggactgtgggggcttggaaaggttatttgggtgcccacctaatttaggatccttgataggggctctgctggattgaattttttagcctcaacactggggctatattcagggtccctgctggagatgctcttatgttccatttcttcagcaggtattttctgtttatgaccttatgtacttcattatgccatatacgacgacgaggagatgcatgcccctgtttaagctttgagggttggggcctataagtttgggggccccaaaatatcccggcctagttagtggcctgtcacggtagatgggctgggccgggaaattaaagcctcccatacttgtgagttggcttgtgattttttttttttgagaacttgcgagttgtatttgtgtatttgtttgtttggttaatattgtcacgtaggtatgccatatacatgtagcggtgtattcactggtggagaaagcgtttgtagtcccggttcgtaaccctcctttagtcccggtttccaaaccgggactaccaatccaggactaaagatcgctatctttagtcccaggtgaaataaccgggatctttagtcccgtttggtaacaccaaccgggagtaaagatggcttggtgttaccaaccgggactaaagatcaagctgacatttttttttttgcatggccctgttgctgcatggtttatatatatatataaaccatgcatatatatgtttcaatacatatgtacatgcataatatatatgtatttatacatatatatgttatgcaaatatatatatatatatatatatatatatatatatatatatatatatatatatatatatgaccaaaatatatttacattatagaaaatgtgtacacatgcatatagaaacatatgtagtcatgtattaattacaatccattatatgtcctagctagctacgatttcgacgtagtagtagtcgctagctcagaagctaaggacctatgaattgtatttccgtcgtagtagaattcacccttgggatcaaggatttgttcgttgatgaattccataagttgttcttgaaccgccgtgataaattccttgtgtgtggtcaggttatccctcatgcgaataaactatatgaatgtatgaaattgattagtaattaaacaacaaatcgatacgtaatgaaattttgaatttatttgtacgtacatcgagctctcttgtggtgatgatttggtctgcaaggcagtggcaatactcgcacacgtagtagccgcacaagttagttccctgcttttgctttgcgcactacaaataaatgacaaacgacgagagatctaattaatatacacttgtatgtatttgaatcggagaaatataaatgtagagcatgtgtactcacaggaaatttgaacttccgcctaagtctttctctccagttgccgcggaccaaatgacggaaccgataccaagccctacatggagtttaaagctatgattcgtagtagcaattaacataacaagattttcttaattaacagaggaacttatgacagtacctgtctataagttcgaaaaccttgtcaaacgtagactcttttttatccattgagtcatatacgttgacggtgtaggccgccaggtcgaagagtaaaagcacccagtggaatctgcaatgtgcgtgggatgcattacatatgaaactcttagcaagttcgtacgggaatgaaatttggtataggaagacagtaaaattaaactaactatgtgttgtacggcaacagtatgaacgtcttgtaatgctgcgccttcaggagatggacgagattgtccactgtggcttgcggatattggtcgagcattgcgacgtttactttccgagggtcgatgaatccagtatcgaaaaccccctgccgtcgggccctttgaatctccattctacaacgataaaagggagtatatattatatatagtctacttatatacaaggacctaattaattaaaggagacgtagtaagaaatctaactgaacgatatacttacaaaatccagcaactcataatagagacgtcgagggcatccagctggtatagttcgtagattcccttgaaattgatccagagaatgtcatctccttgcaagaagtccgtgtccctgatcctcgctccgatcatctctctaccaatggcgctcatctccatgtacagatgatggaacttgtacatttgtgtgggtagggactgcggcagctcaggcttgacaagcggtttaccgagttcgtacatgtatttcacttcctccttttcgattggtgcgactcctagcaattgatctgtagttaggccggtgtcattaataaattcttccattccaatatcttcaccggtcaccaacggctcgatctcctggtttggttgctctccaagctgagggactggtttggactttccagaagatgctttcttcagcgttcgctcatagtccgatagctttatggcctccttggcaggtgcagacatacccctgaagaagttcctgacactcgggtctataggaatcttcttttctggacttcgatgcttgaattgtctcttgacttctgatgccatgtaagcgtcaagctcctcttgcgtgcaatcgtaccccgggtccttgttcttggcggcatcaactttcgtcttcttcgttgcccttgtgtgggcaggcggtggagcttggggggccgttgactttgaaggtgccggaagaggagcctgaggaggagtcggtgcaggagcctgaggaggagtcggtgcaggagcctgaggtggagacggtgctggagcatgaggaggagacggtgcaggatcctgaggaggagatggcggagccggaggagatggtgcacgagacgccgcttgtcgcccagggaggatgatgtaccgcttgcgccatagaataatggcatggcttgtgtctcgtagatgcgtctcaccgtctcctccagggtaatccagctcgaggtcctcatacgcgccttcgaccaactcaactttgaccttggagtatcctgctggaatcggcctgcagtggtaagtatctgaagggtccgttgggatggatgcccgacgccaccttcatgtagtgagaggttatttattagtaatcaacatatataagcagcaactagcggaatggccaaatctaaaatatataaactacgagcttacctttattgataagttcttgaaaggaatatgcagctcacatggtgtccgctgagtgatgtcatcaacggggcaggtggattcgtcctgggtttgcatggcgtccatgctatgtgatcctacctgccccgttgaggcgcagctgctacagtttcctgacgggctcaccattgcaagaggaatggtcggctggggatcatgggaccgatgtgcggccatgcgttcatcaaccttccttgccacctcctcttgcatgctgagctcgtagctcgataccctgaactctagatctgcaatcttcgcctcggtatctctcttgctcctcatccgactcctgtacgtgtggatgtcctccttgaacccaatcttccaaggaatcacccctttccctcgtgttcgtcctggatgctctggagtctgcagggcgagtgacaaatcgtccctctctctgtctggtcggaacgtgccctgagaagaggcttccactgcgtctgttagtcgacgcgcagagcatatctgatcgccgaagaccagtgagccatcagctgggttgagcgttccaccgtgagcatagtaccagaacttcgatcgttccggccaattagcggtggccggttcgatacccctctcaagtaagctagcctccatctcctcccacttcggcatcgcgacgctatagccgcctaaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcagtgtctgcccctttaggatatatttctggtacagatctcccttgaagctctgaaactgttctgccattttcttcagagtccaccttttcactttgtcctctgtacccgcgggaagggtgaatatctcgagcattgtggtccacagcatctctttctccgaatctgggacaaagctctcatgatctccgcgtgcccttgttctgcgccagtacaccatactgacaggcacgttatcccgcacaacccaaccgctgtgacgtacatagttcttggcggcttctgccggggcactaggtcgttcgtcttcgtccacttccgttatgatgtgccgaccctcaagcttcttcgcggcacctcgttgcccgcatgccctcttctgtccaacggagggttgacttccactagcctcctcctcctggttccactccacatccctttccacgtgcccctcctggttcccctccgcatccctctccacgttcccttcctcgttgaaatactggtttggatcctcgttcccctcttcttcgttccagtactggctgcttccctccgcaattgtatcatacaatatatgttcctcatcgcgatcagccatctgttcatacaggaaacatctgctaagtcatgagacatttatgttttaacaatcttatatgctaacaatcatatgctaagtctaggtgacgtatattataggaccctagctagtcaataattatatactaagtctaattacaaatataataatcttatagtaaaactcaaataatcttatatgctaagactaaaatagtcatgtatgctaagtgtaactgtcgtatattagaaccctaaacaatcttatatgctaagtctaattacaaatctaataatcttatactaaaactcaaatagtgatatatgctaagtctaggtgacgtatattataggaccctagctagtcaataattatatactaagtctaattacaaatataataatcttatattaaaactcaaataatcttatactaaaactcaaatagtcatgtatgctaagtgtaactgtcgtatattagaaccctacacaatcttatatgctaagtctaattacaaatctaataatcttatactaaaactcaaatagtgatatatgctaagtctaggtgacgtatattaaatctaatagtcttaattgcattacaaatataacaatcatatatataattacgtcacttgcatgcgcgaattccttcgagggctagctaccactccggcttgagggacgactccgacaacgtcttttctgcaagatacaaaaagatgtattaggataaatgcgaagtaacatatattgcacttgacgttcacgtttcgttcacgatatcgttcacgttcacgttcgttagttcacgttcgttcacgttcacgttcgttgacgttcgttcacgctcgttagttcacgttcgttcgttctttcacgttcaattctcgttcacgttcgttcgctcgttcacgttctcgttcacgttcgttcgctcggtctcattcacgttcgttcgctcgttctcgttacgttcgttcgctcgttcttgttctcggccacgttcgttcgctcgttcacgttctcggtcacgttctcgttcacggcggtgtggcgg

SEQ ID NO: 68681 - DNA, 2184 bp, Oryza sativa
cttgtctattcttcttttccccagggacgatgttggctaaccaccgaggatattgtatctccttgataaaacccaagttgatgagtcgatcgacttcggcgatgacttggtcttggaactctggccttaagcgccttggtggttgcttcactggccgaaattggggatcaatcgccagcttatgggtggcgacacgagggtcaagtcctggcatctccttgtatgtccaagcgaagcaatctcggaattccatcaagaagcttcgatagtcttctcgctcttctttcgtcagcatgccactaacgaaaatagggtgtggatcatccttagttcctaaattcatctccaccaactcgtcaatggttggttggccaccgtcgtcaagttgtttaagagcccctgcaacatcaagctcctcttctaccccaacagctgcaacctcaaaggggtgttgttggagtaaagcatcacctattgtagtggtacttatggtgcagcaatgaaatatatcgtcttcaaatacttcatcttcatcatcgggttcatccacgttgatatagccgagaccgtactttggcgttctttacatctcctcttgataaactcttccgcttatgcccaccagtcctcacatactgctggaggtggtggcaacctgttgtttcgctgtaggttgatgcccgccttctccaataggcgagccattctaggctcagccttcatggtcgtgcacgcttcttctgtatcagaatgaggcttagggaattcgattatagaatcacactcttgtacctgtgggaccttgtagagaatggtccgggatgtagaagaagatggatctggaattgcccattcctctaacggggtagaaactgaagtgtagagggctgggggctgcatgcactgagcacccgcttttacctcctctatctctgcaactctcttcttgaccactccctgttgtgcaagcgcggcttccttgcttggaatccatcttgcctgtaaggtgatggtagttggcacatcgccgttgcttttgggcggtttctcgcttcctcgagaggttgcccccaaggtgatcggtgttgaggtagagcgtcttactttgagcaatattggtgtaatagatggggcagacgtgctggtttcagcgggagatggaagcttggtgctgaggttggttgctgaagaagaatttccccgcctactattcttgcgattccttgacgaagattcgctaatgattggggagcacggcataatgaggcgtctcacctcaggggttgtctcggtgccgggttcaataatgatgtcggctgccggtgctgttcgcccaagttgttgcttgttttcttcaacagggaagtaatacttggcgtcggcatgatatgattcttgaatagtgtatggtgagaagttgccaatgatgcgctgttgcactccattgccgtcaaggaattttaggcattgatggagagtagacggcacgacacggtacttgtgaatccacggtcgtcccaagagagcagagtatgatgtgttggcttcaataacaaagaaccgcaccttgaagctgaatgtagacatttggatcttgatagtaatggcgcctaatgttggcttgccctggttgtcaaagccacagatcaccacgtctgttggctccaagtcttttgttgtgaaacctactcgagttagacttcgaacaggtagaatgttcacagcagatcctgggtcaatgagaatccatcgaagatgagcagaaccaatgtttccttcaatgtagaggggacgattgtgatcgcccccttcgatgatgttatcttcatcagcgaaggtaatctcattcacaaacaaggggttgtcgtagagtcgatgcttagccatatcaacttcgtaaacttccggagcctgcaacgcctttataagagcttcacgcagatcaggcacattcataagagcatcatagacactcaatagtgctgggatccgtttgagatgcgcaagaacgttgtagtcgacagcaggcttctctttgcttccagtttttgtttttggagcttctggagcttctccaggaggagaggcctccttggtaggcttgtctacatttggagctttggacttgtgtggatccggcaaggtcttcccccctcgcaggcttatgttgacctcttctacctt

SEQ ID NO: 68682 - DNA, 2473 bp, Oryza sativa
cccaaagttaaaggcttggtcgtatgtaccctttctgcagctgctcatcaacatgcttcttgacctctgataattcgttggccgccattctgtacggtctcttatagattggagcagttcccggtgccaagtcaatccggaattcaatctctctcttgggtggcatggtagtgaggtcttcggggaacacttctggatactcgcagactatgggtatatcttccaattttctcaagttcttctctacggtgtccactgggatttccgtctcaatctaattcaacgagacccctttctttggcgagactagagatttgtacaccacggtttctcccttctcgttggtcaaggtgactgtgcgactcgcacaatcgatgactcccttaaacttggtcagccaatccatcccaagaatgacatttaggtctttggattcgagaagaatgaggttggctagaaatggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcactagaatcaaaaagtactgttgcagggattgagttaacagggaacgtacccagtacgacctccggtgctgcttgtgcctcctctgcagatgcgtggttgacacgagcctggataaaccttggcccggcacgcctgggcttcgggcatttgtcagcgaagtggccaagctcgtcacagttgaagcaggaccctggttttgctcccgtctccttcttggcttgcgcgggctggcctgactgtgccggtgccactgatgggcgtggagctgcaccgcggttgggctgacctccatggtggttctgactgccactggtgccctggtggaagttgctagggttgaacgggcggtgctggcggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtccaagctgacgcgggaccctgaagctggtgtgtggcaaaagcgaccttctcctgatcattacactgcaggagattcagcttcttctctattgcatggagccagtcgttcgcctccatagggttggtggtgctggagaaggtgggtggcctcacgcgtagaaactctggcaacttggactgagggggagggggaccaaactgttgatgctgctgttcggcgtgctgcatcatcctctggtgcatctgctggtgctgctgctgcatctgctgcatcatggctgccatcatctgagtctgatgtgccataacttgggcaagcgtcggattctcgggaagtggtggcggaccattgccagaatcactgttggggtgcacaccatcagcgcgttcttcgccgttgctgccctcgcctgttgcgcggctaccagtcctggtgtagaccatctggagggaaaagcagacggggaaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagaccatcgataaactaattggaaaacgagactaatgctcggaccggctcctgcggtcggtggagtcgaaggcgtcctcctgctcgtcacccggtccctctgagcgactcctggagcctgacagatcagtctcgccgctgccactgggagtagcagacaaccaacctccggtgccactggctggacccctggcggctgatgctggagcgaaggagagagtgaacgcgggagctggaactggagctgcaggaactgcgggcggaactggaggtgctgcgggagctgttctataggctcgtaccgttgcatcctttaccaataaggaggcaagcactcaagtctcagtaaatcaagaaaaatgtgtagaatccattaaaaatggttttgttctctgtttcagtagtcttatagcctgtttgcaatgtttgctttgtatgccgctagattccgatccctccgacgctccggtgtacttcgagatagtcgccgaggttcccccagcagcagagcaaggcaagtcatgcttgtcacttgaa

SEQ ID NO: 68683 - DNA, 1376 bp, Oryza sativa
taatttaatagctaattaatcaatagttatctataatattatataataaaattaatacctgattccacctatcatatacacacaaggtatcttggaatcaatactgcagctgtctataagtcaatagtccgctgcttttctctttattttttgtcttctcgaaatgtgtttatagctagcttataatatacaattgtacctactcctgatcactgtagctcatatagctcatagaatggcacacattaatctacaattaacaataatgccgttctccatacaaacccaaagagagaggatattaagttaatttgcatcgatctagaaccacatgaatttcacgtgaggtggtactttaatcgccggatgaatatacgtcaagacaaattcgatatgtatgttgcaaacaactgggagcgattatttgttcttccccatacaactactagtgcatgattgtggggcttcttgtcctgttccctgcttctggccccaacaacgtttctttcttctagaagggagtcttgtactgttgctccctttgtcacgtcattctcgaaaggtggcttatcataaagttcacgacatacttaaatacacgtgttttgctatggataaaaatgaattatacatatgcacattgtttagagcaagttggttgtaaagtttttggaacaacatatatcatccctgatttttttggatgtttttgcatggtaaacttaaattcttagagagaggataagatattaacaatacgtagaaatattgttttataaagaaaaaaatacgaattacctttcccaaacaatccggggtgatacgtaattagttattcaattcgccgccgcccctattccaccgccaccttttgccccgacggaaacgagggcgacggcgagcgcgacgtcgatggcgaacatggtggcgaccgtcgcggcgaggatccagactaccttcccataaaaggcggcgcggcacaggcgaagggtggtggcattggggtggagcttagcggcggcggcctcgacgagcgcggcgacgaggtgcttgaagcgggggctgagtccgcggcccccgcgcaggtcggcgagcgcgagactgatctggtcccaggaggggctcctcctcatcgaccatcgccgtagtctcggctacctgcacgatataatcacagctgtcaaattgtaaaatccaaattcgtagacgcactcgaatcgagcaaattttggaacagaaacataatcttcagttggaaccaagaagtggattcagaatcgaagcaaacttaacaaaaagggaaacaaaaatgaatctgaaatgattggggatcaaatcgaagttaaaaaaaaaaacacccgatgccataaacccaa

SEQ ID NO: 68684 - DNA, 2139 bp, Oryza sativa
tcctgcagccctgtgaaagaagcacatgaggagcccaaatcactacacggtggccgctaatgcgcgaccagtcgcgcgtcccccggtgcgcgcggcgcctcagctacagtactactactagtagtactagtactactactagtactagtactactactactagtagtatgtattactattactagtctacatatgtatatatatgcgtatacaaactttacatacgcgtatacaaactttgtatacacgtatacaaactttatatatgtgtatacaaactttgttatatgtataaaattggtatatgtacatttaaaaacaaaaaaaatacatgtatataaagttttatacacgtatacaaactttgtatacgtacccgaagtgtaaaaaaccagaaagaaaaaaacgaaacagaaaaccgcaaaaaagggaaaagagaaaacaaaaaaaaaaggaaaatccagcgacgtgtcagcccctcacctctccgcggggccctctcgcacgcgccacgtgtccaccgggggggggggggagtgggttgcgcattagcaatttcgtcactacacacataaactccatccgccacccctaatagcagcgatctgcagctcccagatacccatccaaatcacctccattccaggacgttcaatggaactcgggcacaaaaaagtcgacgaatccttcccttgtcagccaattcgacgcggcagatcgataggccatcggtgacaagttgaatggccacggatatttttgtcgttggtgcagcgatgggacagaatggctgcccggtggcgcgacgagattaatttgaagatgatttgttctggcgttcttgattgataaagggttgcattatgtctataaaaatgcatcctctcatgaataaagcacgttactttggccgtacttgattgagaaagggttgcatcctgtctataaaaatgcatggtctcatcattaagtcagatctactaatgggggttaatattattttgaaggttcttttttatttaaaatactaccaggcctagcctagaagttatatatcaaaagaaagagtatttacaacattgtacaggagaacaaagaaagaaagccttaaattacaagaagttgtaaccagctgaggacagaagagctaaggacttcattcatccacaaacatgtaagagaatctcatttttaaaagcaacaaatcaactatcttcacttggtagcacattatcaaaaaccttcgtatttctttgcctccatatatgcctttactgtaggatcgaatcacaagaactaagccaaccagaaggggggtgaatggttgatatacccaaaaaccaaaacttttagcggaaataaaagttaccctcgaattcgacggatcgcggtctgaccgagatagtcctgccggtctgaccgagtggaagccactggtctgaccgaggttgaaactccggtctgaccgccgagatcgcctgtcgcgcctgtcgccgccgccggtctgaccgctgtgctcccaccagtctgaccgccgctatgccgccggtctgaccgccggtgagttgccggtaagaccgccgaaacccggtgaaacacaaatcgaagaactctcaaagtggatgacgactttattgattctctctgtgtttacaaagtgtaccaacagcgctccttacaaaaatttcgactaaacttgaaaccctaactcaaaactcaactctattgctctgaaaagcgataccgggaagcctcacgctccccctctatttatacatgaggtaggcagcataaagccacgaaccaaactcatactaagagttctaaacactttaggaaaccctctagtacaagaaagaaactttacataaccaatcgtaccaaatttggatccttccaaatttgactccgcatcccatacgcacacaataacttcatcgtatgcgatatggaatctccatcaaccacgtgcatcaactctagccttagtatcccgcatgatatctgaccaccacggacatcgtcttaccaccaagccgactcccggtccatcaccgcaaatactctcccgaggcatcgagtcacctacacatgaaacaaataaagaaaccatattccgagaccaagctatccccaact

SEQ ID NO: 68685 - DNA, 1534 bp, Oryza sativa
ttcagataatccactgggttgatttatcactggttttaccttgtgctttctcagtgtctctgctttttattgtaaaaaaaattcctttaaaggtttaggtgatctactttgttctacatacctttcctaccaaactttaataatctgctgataaggacaacagtaatggaatccattactgcagtgggccttaataataaaattatacctgatttctagtcaattaaagtatatatctaaagtactgattgctatatttttatttttatcaagatatttacatcatcattttttggccatgcggtgtctacatactataaggttttaagccaacaaatgagatatattctgattttctctttggcagagtttgtttggaaaattttgccaaatgtttatatggatgcatttcctttgtctttaggtgcacatgtgcacatgtgctgtttgcttgcttttgtccaaaatatgatttggacttactggagtttgaattatcaattatgttaattggccacatacctatccatgtgcatgagtgcatcgctgttcctagcttttctttttcctgagtggatgctgcttctagctaggtgaattgttcacattcacacatcggaccagggcatgtgttggcccaacttgagattaggctttgccacacccctaagcccaaccttcattggacctgtaccttgcttcaaaggcttgaaaagtagcctcatcctgctagaccaagcttatagggaacagatagacacatctacacacacaaactgaccctggtaatccattaattgactccacatctaccttcatggctacaacatctgtctttcctttcatctgcatgtgcattttgtttctcaattagtttacgaagacagacatttttttccacccatcacttgtgtatctgcaatatttgctttcacttttgaaacattgtaatcacgctactttgtttctgccaaatagttaatcatgctttattgtctgtattgcagtattgcaagttgccgtgaaaggccattctagggaatgcagaaagatgtgcttgcacgccagagatatctcctatgaagagaagggcatttctcccattgatttgacatcactaattcttgatgagcgaggatttcagttgctcacctggtgcattctgcaatcacaaagtaataatgatgctatcaatgtcagaaatactgctatgctagatcatgcaatttctgatgatggttgaagtttttgcttttacggttttcctctaaaattccaataaagaattgtccgctagcattgttttgaatgatggaacttgagaagaatggaaacattctactgcgaaggtatgagattggaaaattattggggcaaggaacttttgccaaggtttatcatggtaggaacatcgtgacttcacaaagtgtggctatcaaggtgatcgacaaggacaaaatttttaaggttggcctaatggatcagattaaacgagagatatctgtgatgaaattagtgaggcaccccaacattg

SEQ ID NO: 68686 - DNA, 2715 bp, Oryza sativa
  unsure (1)..(2715): unsure at all n locations
gtgcgcnccgtgacatacaatcgactgtatacangccgaattctagctcggtaccctgatccaaacccaagaagtagaatgccaattacaaaaataatggaaacttactggttcaagaaaggacttgatagcaagctaatccttaagaacgtggagacaaatgaaccagttacagctcttgctgatgttaatgttgttttctcctccatgggtagcagtagtagcaaaaagactgaggagaaacaggatgcaggaaagctaaccaaccttaacgctttcgatattatttctctttcggaaggctttgatctttctggcttgtttgaggagactgataaaaagaaagaagcaaggtttacatcaagtcaatcagcttcagctattatctcaaaactagaggatgttgcctcatgttcgaagttgacagtgaaaaagaaagaaggtggtgtgctgaaaatggaaggtgcaagtgaaggaaggaaaggtgtattggcaatcgatgcagagatcttcgaggtgactccttcatttcatttggtagaaatcaagaagaacaatggagatacactagaataccaacatttgtggaaggaggacatgaaaccagctcttaaggacattgtttgggcttggcaaggtgaacgccaggatcagcaacctgaagatcatggccagccatagaattgtttcaatgtcgaaatgtttcgttgccttaggaaaggcactgcttatccttttgcttattattcgttctatcttctgtcttcccaaaatccatagctcaatgaaattcgcacaacaatgtaattggattctaaggaatctgaacttataatgcagtgtaatactagttattttttgttgttggcagttcagtgttcgtaattgaaatacatcaaaggataagctacctcacatcgtcgtctggatgaacatagcacctacttaatatttgagtactttcacatgtttttgtaatgtgattgctgattacaggatattaggcatacagtgtcaacagtggtacttacagagagttgcaggtgaatctttgaaagttgcaattgtgtttagaaaagccgaggatttcagaaatttaattgtgtttagaaaagcccaagatttcagaaatttgaagcactcagttaattctcatcattttgcctgttggacaaatgattagtcatttaggtgctcaactctacctccttttcttttcaggactgcactacttatcttttttttttttgaaggattgcatccttttcatccttgacagatcactagcactagttataaaaaatactaatgaaaaacatttctatcctgacactagtagttgtactccaaaagcaatggaaaaattggttgcttgtcggtagtagctgctatataaaaaaaaatcagtgtgactttgctgggtgcaatttccaattgctgtcacttgtctgtaaaagtcatcaatcaacaaaggcaaaggaacaacagctaataatgaactaaattaagtaacttcaaatgagggagcactgctatagtgctatgctacgagtccttttctttttattctccctttttgttggaggaaccagtagccaagccagtaggtaaagaaaagctgcttttatcatactcatccttgtggaacaaatagcaaagacatccttttattttggcttacaaaaaccttatctttgttatgtagtttgctttagactggaaccctgattcattcagagtatcaccctggcccctgaccctgatggagtgatgtgatgtaatgggatcatccagagagaagtgagtggaccaaagttatatatatgctcatggaatctataatgttatgctctagaggcagatatttgtgcacatcacactagtagcagagggaatgcttatcttcatgaaatgtggcaaggggacaaacaagagagccctacctgtccattcaatgtcaaattaacaggaatcctgtctcaggactaaaattgttggggtctttaaagccttgtctggggcatggaattatttcttttttttatgattcatataggaattgattttttttttgtgaaatcctcttgttctgaatggttctcatgagctaaaggccgtgagccttggagcaagctcacaactcacttcatgtttaattagagtacctttacggtagtctctattggtagtatatggctcaaatactctagatatccatgccttttgagaagctcaaacttgaattatagtatgtcagtgttgttcgaaactcggaactgaaatatgtgaagtgtatgaattaaatctcccaaggtgctacaaattaaattctaacgtcgacaatatatgccgttcactgtagagtttcatttaataagtgaaacttctgcttgagattgttcttgagcctctggtccaaaacccaccaatggtcaagaaaatggaggtcactttctccatcgtttgcaaaagctactttgattggcattgcattgatcatcaacataacatggttctgcaagggccacatcatcatcgtcatcgtcatcgtcatcgtcatcgtcatcgtcgtcgtcgtcgcagtagtatttgacggacaaaacagtgggaatcaaggcatcaccaactcaagcgtgctgagagctacctgcatattggtgcttggagtctcagtgagtgcttcacatcagttgcaacttgcaagtttgccaatac

SEQ ID NO: 68687 - DNA, 1162 bp, Oryza sativa
atatgggctaatagctagtcttttttgctgcctcaagtaagtgctccaaagaatttcgtggaaaatagttcgacttgtgtaagtatccggggaatttcatgtggtcaaagcaattattgaaccgataaaagagattggcttcagtttttggcttctgacttgctttcgatcgagacatttctttcgtaggtaggctgccttttccatcaccttgcttatgcctccttaatacggagtattgcaagtccaacctactgtttcatatttgacaatataggctgaccatataagcttttgaggtaatgagaaaagacggacaattcatttatccttcaatagaaataagaggcacacaatcaaatttggatactcctttattgtcttgatctcaatactctaagtctcaatattttgaatagtcaaatggcagacgacggtaaaaatccatgtcctcttttataggttcgtgtagttcaaaagttggatttgtcggtacagtagttaaaggttaatccaaaggaattagtaacaagaaaatgttctcactttaccttttaacccctttaaataagctccaaatactttgtactgaaacttttgagatagtaccgcttgcactgtacatatagtttgtgccaccactacatagtggtgtaaccacgattgagtaatttaacttattgaagccacttaaaagatttacagcaaatcttgtgtccactttaaggcacccaagatcaattcaattattctcttgcctacttcatagagaatttctgggattatagtttaatttcttgtttgacttcacacaatggagtttatgttgcaataaaagtgttttcgcggcagaatgaaacctttgtaaaggcaatatcctgatcgacacatatattatagagaccccaggcaacgtaaatattcccatttgttactgcaaaggcatttccttttggatattaatgggtgaaattgttccttgttgcactagatctatgtaaaaactgttcgaaaacgcactactacgagaaagattttcgtgtgcggtcaaaaccggttttcgcgtgcgggtgagcagcccaccagcacccagggtctgcaaaaaatcaagattttggcgtgcgggtggcgcaccagcacgcgaaaatcagattttcgcgtg

SEQ ID NO: 68688 - DNA, 1122 bp, Oryza sativa
tatcttatcactttatcaatatgtttgcataatatatctttgctagtggttttatttctttgcctaggaatcttcattgggatttttgtaggggataaacaatagttgtcgtctccaccctacacatgaaattcccattgtacgcttattgaggtagggaaaatgtttgtacttagcttatcgtcttatttcccatgttcaaccactattcccattgtatgtctatttcttatgtgtacaatgggaatttcattgtatgcttattgaggtaggaaaaatacttcattcaagaaatattaatttgttgtgtccaccctacacttgtggaaagttctaggcttgattcgatgaagacattggaagagcctaagttgatcgctgaggagggagaggtaatgcattgttgcttcttgctcttcctagcaccaacgaccgctgcataaccttgttaacttaaacgaatcaaacacaacatgcctgccaattagttatggaaggaaaaaagtaataatggtttaaccctacttacccatcctcaccgatcaggaaccaaacataacaagattaaggcagcaagaagagaataataagatcaggaggagaagaagcgttggcggctagcagggtttaacttaaaccacattcgaaaccatcaatttcttcttgcgcattccttcatgttgtgagggtaaagacacgactgtgttgtttcaatctcaaccattagtttgctgtaatttcctggccttccaggatgaagattagctgaggcggtgttggcatcgcttccctctatcgaatgaggcggttacactagcaatgaggcaaggaaagaacgattgatggagttatttgagtggaggaggccgggatgttttgtacgttgggcttacgaccggctgcgttactagtttgttgtggtagagttgcgcgcctggactgattttggcttggctggtggcggtaggtgcctagtctacagtgaccactgtctccatatcctaacaacacacacataacctctatcgctcgtttctatgccacacaatcgaatgaaaactctactcgagtactttaatgtgaaccgacaatgtatgacaccaaccatcagtaactattgca

SEQ ID NO: 68689 - DNA, 9269 bp, Oryza sativa
gagtaactcggcgacatgttgcaagtatcaatctatatattccggtgaattacttatttataaacacgatcactatagtggtgatcatcatttcatgtgttcttatatttcatgggagattcgattcaaatgaattagatttaatcttactatttctttagctaattgtgacatcaagctatcaatcatggttcgaatatttaatacctaatttgtaatttgtaatagaaattaatatttgacttaactatcttgtgcataattatttgtaggattaaatatattctcgtaaatcatatctattgcttaaatgtagttcttttctttaccttcttggtgatcatttatggtttggcaagcaataggaatcataacaaccagcatgatgcaaaagttttaaaaagttcgaaattttagtgatttttattgttgggaatttttaggatgttacaggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagtccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtgacgtcgggcatggccatcccaacagacccttcaggtacttaccactgcaggccgattccagcaggatactcgaaggtcgaagttgagttggtcgaaggcgcgtacgaggacctcgagctggattaccctggaggagacggtgagacgcatctacgagacacatgacatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaagatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccaaaaaagaagattcctatagaccccactgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtaaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcaacattacaagacgttcatactgttgccatacaacacagagttagtttaattttactgtcttcctacataccaaatttcattcccgtacgaacttgctaagtgtttcatatgtaatgcatcccacgcacattgcagattccactaggtgcttttattcatcgacctggaggcctgcaccgtcaacgtatatgactcaatggataaaaaagagtctacatttgacaaggttttcgaacttatagacaggtaccgtcataagttcctttgttaattaagaaaatcttgttatgttaattgctactatgaattatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtaagtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatatctatatacatatgcatttgcataacatatatatgtataaatacatatatattatgcatgtatatacatataatataatataatatatatatatatatacatatatatatgtatgcatatatatgtattgaaacatatacatgcatggtttatatatatatatatatatatatataaaccatgcagcaacagggccatgcaaaaaaaaaaaaaggtcagctcgatctttagtcccggttggtgttaccaaccgggactaaagatcgatctttactcccggttatttcaccgctatctttagtcccggattggtactcccggtttggaaaccgggactaaagggaggttacgaaccgggactacaaagggtttctccaccagtgctaatagaatgatcaacaagctgcaaactagagtgagccattggaagcaaacatgagctcgacaccaccaagtaacgagcttctggtaggctcgagcttggctctgtcaaagctggattatagcacaatcgcagcagaaagaatgaaaaggttgtatttctcactaacagtgctgacaagaagctgttcaagctttgaaaaataaagcttgcaaagtggcgagtttgcactgggaagctcgcatttgtcaacctttttacaaggccatcctgctagcgtgcgagagctggttcaagtgccatcaatccataagttctttatatataaattgtcgtgtattatgtaattttgatgtctaaagaaaagatcgtagacgtttatgaaattaccattttttatttcgtaaggacacacaattgctttggcccaacttatatgaacactattcacctgttacacatagtgacgaaaacggatctgaaacaaacggaaactagctagtgtgcgtagtgtctggcacttcttttgtatttacgatggtctcccaccactcatgtaccgtcgaggttggttgccagtaaacagggcttaggtggtcgcaggccgtctaatgtgcgatttcattctagattctctttgtgtatctgtattctgccagtaggtatagagccgtctcttgcaccagtcaaaaattgggcgcttaattttctagacatgaacacagtagaaatagaaggcattggaacaatccctacaatctaatagaatcgatgaagagctgtgaactctttcaaggccgcaatggccccaaatacgagctcttcatcagctaattaagccagggccacgatccgatccagcctgcagccatgggcagatccggattctggtccgttgcccaaatctcacacacttgtttcttcaatttctgtttgatctgccgcaaaaggcgaaatggctaatgaacgactctattattttttttccttttagcaaataactaaaacgacttgattaatcacgggctcaacctagttcttcctgatttttcacacacttgttctcttttgtttgtatgtattccacggaaggcccatcgagcaggcatgctatgtggtctgccccaagcccatttggacgttttattttatttttgttttaatattcatttgcataaaattttgatatcttaatatttctatggaaatttctatctacaaagtttatatgtataaactttgaatatataaagtttctttggtgttatacactatgtataatgtcaaaacaaatgaatttttaatggacggaaaaataaaagtgggttatgcagacaattttttttctaagccacaaagtatggctaatcaggggaaaagagagacgtgggttgagaaaatgcttgagaaatataaatggactaatacttgggccatccagttcacaatttttttttctctgtttgtacttcttacaccatttctctctgtttttctttgctcaaagtacacctatattactacaaaatatgcaaaaaaaaaaaatgcagccattatgttaccaagagattattttgtagtaaactgacgaccaaaaaaggaccaagtttgaagtggcagagcttcagttcccctacctagcatgccactgttactttatatatgctaataaactgacgactaaaggtgagcatatataaactgatctccattgaagagaatggcattgtgatgttattgcaaggcaagcgtagaacccgttagaatttcatgctctttgaacaaatatatatacggaaactatagaatggaatgcattgggacaagcgatactacgaagtgtacaagaattggtagagcagtgtatttgtcatccattgagctagagtgtcatgataatttagtgtcatttgactaaatagaagaggggaaagccatcaatcattgaagaaataggagaatttttataagtcggtcaccgaaatgaggagtagctggctgcgtcggtggtgcataggtggcggcgtcctccagttgtgaacttgtgaaggcgacggcgatggcccaggtggatcgagcggcaccggcagcccttgtggatccagtgggcaacgacgacaataacgacgtcgatggcgatgggctgggtggattgagcagcaactacggctcttgtggaaccagcaggcaacgacacgatgacctcagcgatgacaaccccggcggcgatgatgacaacctcgacggcaatggtccgagtggatctagtgggctagggttttgggtgatggtgcaaatcgggtggcggcggatccttctagggtttctgggctagggttggatttttggaatttttttttgcgatatttttgtcgcaatcggttggtttaaacgccctaaatttcacatactattacggctctacccacttgtaaaaatctgcgaaaatcgattttagctgcatggaaaaatggattatatagtggtgtgattagacacccgatgagccccaacagggccagccagaacattctaattacattgagcatttactgcgagaacaagtacgttactaggaagattatatttttaatttctatagaaacatcgatatcctacagcatgtttgccaatggtcgagcttgggggccgcaggaatagggatggatgccctcagccctcattcaaaattaaaattcgtaaaattatttattgttgatagtataattattctactctaaaatatgatgagtcgataataatttcagatttttcatctttgcttcaaacttttcttatcatgccagcttgattaactagctgttggtccgtaggagtcctgtctgattcaatgttctttctttaggattaacctttttggcacagttaggttcttctacttgtcctttcagaaagtacaaccacaactcgttactagttatctaccatgtgcaaaaaaacatatccaaattaaagtgatataattctttttgcactatgcatcaagtgctttcgcttataaatgttgcatatatcatgttacatgtgaagtgatgcatgctccttctgttagctgcttgtagggtaggctcaagcctaccagaagctgcttgtagggtaggctctcgttacttggtggtgtcgagctcgtgtttgcctccgagggctcactctagtttgtagcttgttgatcattctattagctagtatacacctttagggcttattcggaatataggataggaaaaacgaaggaataggaaaaatataggaatatggtaggattgtatgcgtaaaacagaggattggaaaacataggaatttcttattctccgttcgcaggattcttacagcaaagaggctagagtggattctttttttcctgtgaaaacatgggtagggaatagtattcctatggaattcaagatagctaaccctttcaaacgaatgcatctaccgtacccagttcaaaggaatcatcaatcctccatttttcctttacatttcctccattccgaatgagcccttagacttggaaggcactgggaatacgactagcactattgagtacaggtaagggggctttcaaagcccatctccttctgcccgccatcctcaccctcgcccttgggccggttcatcaagttagctgggaggtacatacgccatattcactgatgcagcatattttattacaattattactgttgtttgattcaaaactgtttttccttgcgattcaactatctcgcgcaacaatatttaatttctctttgttttttttttccattttcagttaagacgaggaagagcagagattatggtatccagtgatctccgtgactccgtgtgctttgttaaaattaatggagaccatcagcggatgatgagcgtatactactacgtgccgatgtcattttagtgctactactacgtaccttactacaattccggccagtaaagatgcattttggtgctactacctaccgatgaatgaaaccattcaaagatgtagtggtgctcttgagacgtacatcggcacaaaactaaaaggaaggtgtcggaaaaaacgaaaagtaaattatatgtgaaaaacactttaagctggctgtacgatctcgcatagagtttttgagagcccgtgttctgtatgccatgggaatagaagaaaggaaggacttggtagaaaactattattaactagataaatacatcgtcgtgtgttgctacaagaaattaagttgtataatatgtataaataatgtgcaatatattttataaaaccaaaaacaatatggattcctatgttttacgtaatttgtacatggttgtaaatatagttgttaacgccaaaatttgataatcccgaagttatcatcggcaaagcaaacatattttatttgaccaatacttgtgaattttgagcctaaaaaactattcaaattgcacagttttatgagagaagaaagagataatttgtgccatatatatatctctattatccgaagggtaaaaataattgtggtgatgtgacttcatgagaaaagatcgagaaataatattttctacacttagtgaggattgtatatataggttgtttgctaattaagaatgaactttagttagatctggttcatgtcactccctacatagtaatatttcagtctgccaatgaacacaatgctgcatattggtctaccgtgagttcacttgtcggtgttaattttttattttccaagtattgaacacagcaccgtcaccaagtatacttatgacttgttcggcatagctccaactctgtttttttttcctgaactacctagcttcaatttttcttttgcagatagagttgctgctgcatatatatatatatataacagttatcagggtgatattttacaccaaagtaaaaatgattaagccacattaatttaatgtataaactctattttctagaagaatttaagagttagaaccatattaaacagacctaatatgaactaccaatcgggggccatatcaccattcatatcattactctgcccattcatatatgtaaacacggaaatccaatttcaatagttgaagagatttgtaccttgcagttaagagtgatcagcgggctggctatcctttttcgcatcttctcttaatttatcttcctgcatacatactatgcccatttgatactatgtttttttttcaatgtacactgaacacgcagttaataaactggatgatacactactggagaaacgatctttggagggtcgagcgatttctacaatagtctcagttctaataagaaccgggactaaagattgtttttagtccctgttaaaaaaaattgatcttgaccaaccggaactaaagatgatttttattcctggttcatcccctgtcagaagcttgtgagagggccgaggatctttagtcccggttgacactaccaaccgggactaaagattaccactttagtcccggatggtactatcaaccgggagtaaagatcatttagatctttattcctggtttgtactaccaaccgggagtaaagatctatctttagtcccggttggagttaccaatcgagagtaaagatttatctcccatctgtgatcggttaagtactagataagatcagataagtcccctcgatctctcctccc

SEQ ID NO: 68690 - DNA, 1465 bp, Oryza sativa
  unsure (1)..(1465): unsure at all n locations
ttaataaaaatatttctatgtgttgctcgtatttgaaggggcaattttttgatagaacacatcnctatacattgataattccgatgcacaaaaatggttgagaagacaaataataggatggataatatcctccacaataacatgagaatggaaattttagagtctgtgatttgtcatacttatctaaaggaaaactcccagtaggattaagacatcaatttaccatgattgatttgtaccaaacctaaatattatcaatttatcagtatgtttgcttaattatctttatgggtgtttttatttctttggcgagtagccttcatagcaattctcataggggatatgcaatatttgacgtctccaccctacacttcccattgtatgcctattgaggaagggtaaatgtccgtacatagattattgtattatttgtcatgttcaagaaatattcccattgtgtgcttattccccatgtttacaatgtgaatttcattgtatgcttatcgatgtagggaaaatgcttcattgaagcaatatttgtcgtctccaccctacacttctcaacagttccagggttgattcagacaagatattggaagagtctaacctaattggcatggagggagagttattatattgttgcctcatgttcttctgggcactgacaaccactacataacctagtaaataataacgaatcgaacacaacatgtttgccaattagattttatggaagtacaaaagtaataatggtttagccctacttacccatcctcaccggccgggaatctaacgtaacaagaaaaatataataagatcatggtggagtagaagtgttggcggttagcaatgtttaacctaaatcacatgcgaaaccaacagtttctccctgcgtattccttcccgttgtaaaggtaaagacacggccacaccgtttcagtctcaaccatcagtttgctgtaatttcccagcgttctagaatggatattagctaaggcggcaagattaaggcaacaaaaagaaaataataagatcaggaggagaagaagcgttggcagctagcaagttttaacctaaaccacatgtgaaaccatcagtttcttcccacgtattccttcccgttgtaagggtaaagacacggccgcactattttaatctcaaccatcagtttgctataattttcttacattctaggatggagattatatgaggcggcatcagcgtcgctctcctccctcaagtgttgtgcttatagtgccaatgaggtaaggaaataatgatcaatggagttttgtttagtggaggagcccgagatgttttgtacattgggctcatgatcagtagaggtactagtattttgcggtagttttgcgagtgcgtggactgccttttgctcagatggctgcggcaagtgcccagcccatgatgaccactatcttaagggtatatttgggagtgagggttg

SEQ ID NO: 68691 - DNA, 2745 bp, Oryza sativa
tcgtcgtggcacggcgtcgtgtcgtgacgaggtcggcgtcggcgtctgcaacgagacagccggcagcaaccgagagggagagacagagatcgagatcggagagagatagctgattagatcgagggaggcggcggcggctctcaccccagagatgcggcagcggaggaggaggcggaggcggcggcgacgacgacgagcgcgagacgacggcgagatacggcagcggcgtcggcgcggggatgccctaggcagtggcggcgaaggagaagccgagagagatcgatcgggcaaaaacttctaagtgttggtggagaagacgagggcgcgcatcgggaatatatatatatacccctagatatctttactcccgttgttcttatcaaccgggactaaagatattttcccgttatttccaaattctttttaaacccggttagggttaagaaccgggactactgataagcgcactgaatattattttccattacatatgtgtttctaaaatagaagataatgcattaaaattatttaaagtacaaagagtaatgacaattacttcgaaaaattattgttgtctgtaataaattaagtggataaaacgtaataagcaaatatatgatttaaaattaataaaaattctaataatcatatatacttagcatatgaatgatattaaattggtaaaaactctaattaacatatgtatatacatacggcatgatttaaaattaataaaaattgtaatcatcatatatacttagcataggaattatattaaatttattgttaaaaactctaattaacatatgtaaatgccacatgcatgatttaaaaattttaaaaattcgaatagtcatatataattagcatatgaatgatagtaaattaattgttaaaaactctaattaacatatgtaaatgccacatgcatgatttaaaacttttaaaagttctctagtcaattataattagcatatgaatgatagtaaattaaatgttaaaaactctaattaacatatgaaattgccaccaacgtgatttaaaacttttaaaaattataagtatcgcatataaccagcatatacatgatttaaacttgttaaaacctctaataatcatgcgtaattaacatatgccatacatcaattgatttatatggataatcaatacatccaaaatagtttacatcgtgtacacaataattacggcaatacatcggcggtgacggttgaccgcacgtactttctcctcactattgttccctccttgtgatcgctacgtgagtaaggggtgtcttcatttgataggaggatgctagggtcaatcgtcaccgtgaaagggggttgcccatccaactgatcgtaattatcgtcagtcttgtcttcaactccgacgatttttcttttgcctgggagaaccacgtgacgcttaggctcgtcaggccctctgcccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagagaaccatagtcaagttcccatatgtcctcgatggcaccgtaatacgtaccagttgttccatcatgtcccatggcatcgacacgaacagcgctgttttggttcgtgctcttcatatcttgggctctcgtgtagaatgtgtacccattgatctcatattcctggaatgtcgcgatcgacccagatgatcccctcgccaggaaggcaagttgttagttgatcgactcgttacccatgagatgttgtcgtagccacgcgggaaaagtatcaatgtgatgtcgtgtaatccatgcataggacttaccgatgttcctggcgtgaactagagccaagtgctcttcgatgtaaggagctaccaatgaagattgttgcagaaccatgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgactctggacgagcacggttacgaacatacttcttcagaatgcccatgtatctctcgaaaggaaacatgttgtgtaggtacacaggcccgagaatactgatctctttgacaaggtgacaaagcagatgcgtcattatattgaaaaatgaaggtggaaatatcaactcaaaactgacgagacattgcaccacatcattctgaagggcttctaatctatccggatcgatgaccttctgcgaaattacgttcatgaatgcacatagctttgttattgttgcccggacattgtttggaaggataccccttattacaactggtagcagttgtgtcatcaacacgtgacagtcatgagactttaggtttgtgaacttcttctccttcgtgcttattattcgcttgatattcgtggagtatccagacggtacctttatgctttccaagcattccaacatactttccttctttgccttggtaagagtgtagctgggtagactcaagtaatgggttcctttttcctttggttccgggtgaaggtccccgcgttgttccata

SEQ ID NO: 68692 - DNA, 765 bp, Oryza sativa
atactccttctgattattacacttattatatggacaacaaataaaacccctttgcctgttagcttcggccactctcaaaaaatagtgcacgctgttaataaactctttggaccgccggtcagcgtacatccattgccgatccatctacatgagtcgaaaaaaaatcgtacacaaataattattcttacaataatgacagtcatacaataattataagataattacaaactctttcaacagtcatacaataatgacatatctttattcatacaaaaatcataaaatattacaccaaataattcttatttactatttctaaagttttaaactaattttaatgtgttttacttcttttaattttcattttagtttgttttctattatttaagattaactttcactatattttccttctcaactattttataaaaccttctttagcaaatcaactaaatttctatatattctttcttccccacacaaattttctctctcatcaacttacaactaaattttggagacaaaaaagtgtgcaaaacatagttgcaaatgtaatatgacaaaaaaaatattggaggatgaagttgcaaaccttttaggcacctccgatttgtatgtaatcaccaaaataaattcactagaaattttggcatgacctcccctcttttttgaagaaattttgaagcttgctcgggcagctggaggaggaagaagacatatatatatatatatatatatatatatatatatatataggggtgggac

SEQ ID NO: 68693 - DNA, 2141 bp, Oryza sativa
caatgggtaagatcatctcccatattttgcatgcgatccgccgatccccagccctgcagaacggcagaaccttcctggtattcaatcctgctgaccccccacctttgtcctggatttcttgagacagttaattaattctaacaggggctttagcagtttgcaacttgatctcgtctgcatccggcctgcaagttctaattcatatgaattcatgcaattagatttgtttaaaataaaagttcatctcttctagcaaattaaatgatcaaaatagttgcatggtcttactggtatatatatagatagtttcacgcacttccaggaactctgtaaaagatattattgtttttgtttatttcacaactatttaaagaaacctgatagattttcttatgtatttctaggtgaaatgagaattttaacctagctgattgaatatatatcttttcactgcttatgagtcgaaaaaatggcattacagttcaaccatttggcaaaaaatagatgataacataaatattgctgctcaggattactagaatgtcatattgtgataataatgctgaaatttcttacattaatgaagtaagtagtgcgcctattggttggctgcttttgcctgactttcctgaaaaatactgatacgaacttctggataattctgatattgatatcatgatatgtctgcactaccaaagtacctacttcaattcctgatgagagtgcacactaattttgaggaaacgattgcaggtccaactataactatctgattatttgttaaatgcattatcataactggttagtcttttgaatatttttttgacagttcaattcagatatccagatcaacttgattcagggttgggcatgcaatgatggtcctaggattacccgaaggtatttattgttagcaagttttgattgctcttggagaaatggataattttgattagtcatgaatctttactgatttgtattaaaaaaaaactttacaactgtatgacatacattacaatgtttttgtaccgatataatttagcaatcacattacatctcattttttttgttcaaattaaaatttagctatgtttggagttgtgttggatccagttttttttaactaaattatattgttgtaccaacatgcaggacggggataggcgtttgcttgctaagccaatcaagtacttttatgagatgcaagagcttttctcaggcagtaatgccaatggctctcttgccatagaccagcaaacatgctacaacattgatagaaaatttgatagcagtgaccatgaaggcttgaatgatatgtccacctatgcacatcctatcaacattgctaaagaagactctgacacgttaccgtcgccaacttgtcctgataatttttctccaggaacatctcgagttagtaaaaagagaccaagagatgtaaagtccccaagtaaaaggcagccaaagcctaagagtcgtttcacagatgtcactgagaaaattggcaatacaatggaccgtttggtgaaccagcttgctagtcctcctccacccccaatgccacaacttcgtgacccttatgctacaatgtggaagaggatggatgcattacccattggttccaaagataaggttgttgttggaaattatttgggacgccaggagaaagagggggtgcgaggatttcttgctgcttcttgtgacacaactttggagacaggtgtaccatttcatgtgcgaccgagatggtgtgtaggttaaatggatctaactgccagcattcgagtatgttgctgaccttttgctaagttgcaatagatgtactaatcagttatattggaaccttatgaaatatcttaggtccgaacaagtagttacttttgggaaaggattagattagatatgggcaaactaattagcttatattgaaatgatgcatgtgaatatgttaggttcaagctgggagctacgtttggttattagaacaactatcactatacagcaatgatgcaaaagtatggaccttatgctctgaatgtgttatgaaaatttctctagtgactgagtattcctcttcacctatgatatttttatttatgctaatgatgtggttttctatgtacatttgtgtctgagtattg

SEQ ID NO: 68694 - DNA, 14026 bp, Oryza sativa
ggggtggtaattctcaccatctaattgattgggggtaaccatattcaactttggcaccaaccaaacagctactattttgccacaaagttaggcatgtcatgtggtagtcatccaaacaatacccttaacaaatttgccacacttttgtttatcaagtatcaaccaaacaactctattttgccacaaagttaggcatgccacaatatcagcaaacatctaaccttaagcatggcaaccttagtcactaaccaaacaaccacaaaattagtatgctttctgtagcatcgtatcaaaccttattaaaactaggaaggtagcccgcgcatatgcgcgggcatcatatttaactgtgttagaaatttgattaggaatatttatgattactctattgtaaatatctttaatttttcaataatttgtgtggtgtttctctgaatgctagtaaccatcgccgacgtataaattgtaaactaaaattacttaaaacaatgcagttttggttttataagaaaaaatatatatgaaactatatatcatttgtacataatgtgtttcttttttaatattaagcataacttaattttgtactttctaaactctgagtaacaattttcttttgtataatatatatgtctttatgaattttaggatatattaattgaagatattttctattaaaaatatgcctaatacgactacatataattatgagctgaatatgttgaaatattgatttagttgtatgtatatagtattgcctacatataattatgagctgaatatgttgaaatattgatttagttgtatgtatatagtattgcctacatataattatgagctgaatatgttgaaatattgatttagttgtatgtatatagtattgcagtatgaaactaacagtttagcggtaaatgtttttctcaatgagaaaatatattagaaaataagacttttatcgctcccaagttgtagtttagggttgtatactttgaactgaaattatgttagattttgtttccaacataatacagaaaaattcaaattttctattatattttatttaaaattttagttattttctttatttcagtactccaaaaatattaaaacattgctatttaggatgggtatcaatttttttaaaaaaaatgttaaatttaggaaaaaaaattcagtcttcaattatttttatcatgttatttttttatagatttccattccatcaagcatctcttaaatattttgatctctgcaatctagaatggaaatataagtgggttaaggctatacaacttggcatgagataaaggtatcccttaaatgttttcaatgtgttgtatatgacaaatagatcctagacggggtacacgttatgacatgaaaaaatgatataattacaagctttttctctaatctattagtgacatcagatatcatatgtataatttagatattatgatcatattaggaacgtttatttatctctaaaaagatcatttatttataaaagtgcatctaattatgatcaagtataagtaaatagcccctatatgcatgttaagagaaattaactacttccactgttgaggaaaaatatatcaatatttactacaccaaattatttttattgaattcaaaattgaatatgtttttataatatgattgttttgtgttgaaaatattactgtgttttttataaactaattcaagtaatttcacattgacaaaatttaaaatgacttataatctgaaatagaaggagttggaagaaggtgattagatgtctagcatggtataaataatgggttaaccgtttatgaaaaacataaggtgatatattttaattttttaatgagaaagtttagtattctattttatttattggaggcttaaagatggatagatatggtccacaatgtaagtcaatacagatattaaattattgatttaattgaaaattacaatagtgtagaaatatcataaatgaatatatgatttaaaattttatgagtgttttaaagtctagtttacgttgtttctataagtgctagcttgaggagaaagagaagaaaagcacatgacacaggggaaactggttagacttgttaggcggaatccatttgtgggagttttttttatcacaaagataatgttggatttagtttctatggaggtaaagaaagaacagagaaggaatggtagggagagaggaatcggaggaatgggaggaacgggagggggttttgggattttcttttaaagatagatctaaccatataaaatagtggatccatccatttaagtggaaagcgatggttagatgttttattttcatttgtcatacttatagatttttctaatgtattagactgttacgtggcgagatcaacttagaagtgtttatgggcgtaccattaggccctgacatttgtagttagaacggcaacacgatctaattttttagataagaaaatatgagtaatatggattttgaattttatatttaattataaataacacaacaattgacaaaaactaagaataaaattataacttgagagtcgtgatcatttagatgtccgaattttttttgatatattgagtgttaatgagaaaataggataagttagctagaaaataggagaggatgggagattcggaggatggaaggagtacgtgctacctttttttaccttatgtacgtaaggtgttggtggtggggataccagatttattttctttgcattggagatctaattgttaaaattaacgggtccaccattttaaaagaaaatcgacggtgtgattatagaataccacgtggtgatttaagagcgtttgtagaaggtcatatggcggcttgagagtatttattggaagtttaattaacttttagtatataagtcccttaaattttttagaaacgctagtaagctgtcacgtgacactcatataaaagcttgtaggtcaccacatgtcatatctctcaattaaaagaattattaaaaaacataagaaaaagaaaaagaaatctaactgtgaattttcacttaaatcggtaagatgtggttttatatatctattaacactacctcctaagctcccctagtgtacgtacgatgtgcggagtagtagtactgttttcagaaggtgtaaaggaaaagtactgtttgcaaaaaaaaaaggaaaaaaaacaatactaacgtggagtacgtatgtatgccgccggaaaaaaaaaagaaaaaaataatagtaacgttccctgccgatccagacctcttgtctacggtgttatcctctttgtttttctatatattattagttagagcaaatatggcaattttttttaaaaaaaagtagggacgccagatttattttttttaatggagatctaatggttaaaattaatgggtccaccgatttaaaagaaaatcgacggtgagattatagaatgccacgtggcgacttaggagcgtttgtaggaagtttcatggatttttagtatataatagatagatattagggaaagcttaatggcactgggcacgctcgtggtggtgattaattgactgctgatgaggacgaatgaatgatgagggaggtgttgttataaagatagatacacaacaaagaaacaaaattttacccagaaaacccttatagaaagaaaaaaactacgtccgttgacatgcgattactattatggagttattacaaacacagagggtacaacggattgttgcacccttcctgtgctggttacataagtatataaagcgggaaaaatacaagagttataatagggaaagactcgaaatagtaataatagaaaacaatccaaatatatattgctagctgaaattcaaataatatatttaaccgccatagtggcctccgactacgtccatgtggaggagatagggagagaaagagagaggagagaggggagaggggagaggggatcttggaagagggaggaagaagatagctaggggatgacatgtggccatattcgcagtatccatggtggattcaatctgtctaggtccatggtggattcacatgcagcgtcctggagtggagaaaacagaaagggacactttcaatattctttacagatttcgtcgccatgtcgtcagctccaatattctctcttcgtggccctttacgtcggtcaaacacccttttctttcagcgcctttagaaaaagtgaagcgcatagatgcttttacgcctatatgaactcaccaaattgggcttgaagaatcattcggcatcgagaccgggctagctagctagcttagttttggcggcgagcttaattagctaggaactaaatggagctcatcaccgcgtgcgcgcttctcctcatcgccgtccatattgcgattgtcatctcctgcccggagccactcgcggccgttgcattagtcgacgtgcccctcctctacctctgccgctacctcctcatcatacgccgcggtgtgatcatcgtctccggcgccggcgccggcggcggcaggttgcgccgcttccgcctcggggcagccatggcgatcatctacatggccatgtcgaccctcttcttcctccgcattgctcctctcacgccatggtggggcgccctcgccgcctgggtcatgatcctgctcatcgtcgaggccatcttcgccttcttcttcccctaccgctgctgcttcaacgaaaccgaaggcgatgtccagaataatccccatgtctgagagagagagaggaaagcttttgaattatgatacgcatatcgtatgtcactctcgcgctcatcagatggtacatgcgatatcaaactcgatctactttctcaaataaacttacctagctagtagtagctgcgtcccgtgtatccgttcgtgtatgttagacttaatcttgttgtttagattttgtgtgtgtgctagttatatgcatgtacatgtgagtgcgttgagtcagtttgatatgcatgctagtgaatgcatgcaaaaggtcctagtttacaggtgcacgttggcctggagttgtggtagccgagtcaattagctggagctgtctcatggatggtggatggattagctccatgcatgtgtgttagttaccaggtgatgctctacatgcaaggagatgagggctgcatgcatggacagaagtggttaattagtggctaagtcaggtgagtggtggccggttagtgccgcaaaaacgtggctagtgagctgctgaacgtgtgtgctatttcaagcgtgtaatcagtgtgtgattaagtgtgtggagaatataaagtgaagtgtgtggtggttcgctggtgtgcagcgacaagaaactgtgtattgttcatcttctttgtgtgtgtttcatcgagtgaaagggagagagctgtgtgtgtgcaagtgagtggctgggccaacagtgtagcggtgtgtaagtgcagtaatcagctgttgggtacaatgtaagtttaagtttgcacgtctttcaattcattttgagatgaaaatgcatactaattcccattttggactacaatgttctgtgtgtttcgcacacatcccgcgggccgttaccccaccttgtctgccgctcacgaactggattttttactttgaaatcggttttaaaaacttattttacaataaatagatcctgaaaaatacttatttcagatatagactacttggcatcaatatcattgatgccgtggaccaatctgatgacgtcaatggcactgacgctgaggatctatttgtaacaaaaattaaaataaatctatttgtaataaaatatatatatttataaataggtccttgaagccaacaacacttacgccgaggaactatttctaaatattttattttgacaaataagttgtttttatttcttttaattacaaataggtcttttctagttttttttccaaaaaggttattggcgacgctgtcgccttttacatcagggacttagctttcgatgagagacgaggaggacgacgccaatgttattggtgctattagattggatcatgacgccaatgttattggtgctattagattggatcatgttgccaatgacaaattttcaatggcatggataggtttgccgtggtaagagatgcagaggagttggcctggacacggcggtcggacgccttcgtctcaatcaacgcaaaccacggaaatactctggcaagttcagttgaagtccgtggtctacacttgtaagtctggatccacgagcgctgcaccgcctacatggagcgggtgcagatgtggagctcctgttcactggcttggacaaccaatggcgtggcggccaaccgttaacagccaaccatccttgatgcggcgtcgatctacacgcttatcggtagggagttggccgtatgacgacgacgatggtgggagggaggcagctaactatagtgcgatgccctcctccctactcccgcccgcaccctgcctcctggcctagtgaggatggggaatagaggggagagggggagagagagaggaggaaagagttggttgttcacatgtggggccagtgtagatcccacgctgacttagcgcagctactgcagtcaaagcgtcacgtcggatgaaaccggaagctatactaccttgggatggaagctgatacagtcttgcaagttcggagacgagttatacctggtacggcggtgaagggatgagacaccaaaagtaaacttactctaaaattgatcaaacgggatggattccaggcccaagtacaggacggcccaaatcagtcggcccggcccacgtacggaaccaacggtctagaatcactcgaccgaaaaacgccaggtgtcagccccacgagctcccccacgttccactcgcgcgcctccacgtcagcacccactgtgggccccacaccccccacgctttccatctcctccacactcttcttcttcttctacctctccactccctccccccaacactcgcctccactccacctcgaaacccacaaaaatggcgtcgcccacccacgccgcctacctcgcccccaccgcccctccccgccatctccacctcctcctccgcctccgcctcggcggccgccccgccgtctcaacctgcgtccgcgccaccgcccgcgggggggatggcgggtcgtcgtacctggacatgtggaagaaggccgtggagagggagcgccgctcggcggagatcgcgcaccgcctccagcaatcctcctccgccgccgccgccgccgtgaaggaggaggagggagaggggaaggctgcggcggcggcgggggacgtggagaggaggacggcgcggttcgaggagatgctgcgggtgccgcgcgaggagcgggaccgcgtccagcggcggcaggtcatcgaccgcgccgccgcggcgctggcggcggcgcgcgccgtgctcaaggacccgccgcccccgcctcccccgtccccgccttccacgccgccgcaggagcgggaacagcagcagaagccggcggcgaccgcgatccaggccggatcagagagtggcctggtttcccgtacggctccgggggagtcggatcgggcatccccgccgccgccggtgacggagacggcgaccgaggcggcgaaaggtatggggtgattggtgcacgtgaggttgcttaaagatcacaagtactctttcttgtgaacgcattatcttttcgatttcttttttactagctttttgaccgtggctaacatgataattgagctaaaaaggacaactcctttttaatctgacagaatgtatgaaactaacaatccaaccataaatcccttcctgaggaatagttgaaaaactgggaatctatttttaatcttttttatgtgtataatagaagtgtttgatttatgtcaacaaaaaaaagtgtttgattcgattgataggtgaatggatttagggaacttgttagatatttatggaaaattttgattgtgtgcactgccatttttgtctcgccattggcaatagaaattgtagctgtgcagataacacacaggtgcctgcagtattggcatcttgttttgttatccatgcatatttcttcatttatctgggtatcaaacatgaatttattgtcgaagtgcgatgctgattccaccaaatgacttactcccgctgtccaataaatgtagctaaaagtagcataaatgcaccaaaataacacctgtagacattaagcatatagaaaaaaaattatcagcatttctattagttgcaagttgcatctgcatttttttttcagacatacatgtattcttatgcgggatacacaattaactgcagtattttagttagtaaggtattgtaaaaccatgctgttcttaatctgcaatctgacattagcaatcagtttcagtgccggactctggtgattcatctcctttcaagaagtcaagttccaagctcggtactccaggcccggacttctggtcgtggttaccacctgtggaaaatagcactaaactaggagaaatcgacactgggttaaaaccatctgagaaattagactccttcgccggtcagcctgatctgctgatggaaaaggaacagtcagaagacattttatcgctcccgttcgaaacctctttcttcaagaaggaagaccgatctcttcctcccttccagtcgtttgctgagcctgaaaatgtggaatccgagcccagtattactgctgatgcagaggagacattcgaagatcagttttcgaaaaacgcagctgaggcagctagagctcttagtgcaagcgacgagaagtcatcacatggggtgcgtccagatggttcattgtggtggaaggagacaggtgtagaacaaaggcctgatggtgtaacttgcaagtggaccgtgattaggggagttagtgctgatggagctgttgaatgggaggacaagtattgggaggcttcagaccggtttgatcacaaagagctaggttctgagaagtctggtcgtgatgctacagggaatgtttggcgggaatactggaaagagtctatgtggcaggtaaattgctgtctcatttggtacaatacaaccatttgttccttgttcatgaaacctacaggttacaatgttacatcataagcattaaattatggctattgtttctattgaaataagattatctggcttgagtgatgcagtcatgtgtagagagatgtgtctcactgtcatgcgttgatttactgaagtatttctgttccgacaatactgatttactaaacttcagatgtaatatgatttgtactgaatgatcgccccattactcgttagaacataactgagtactgcattttttttttaatatttgcaggatttcacatgtggtgttatgcacatggagaagacggcagacaagtggggacagaatggtaaaggggagcagtggcaagagcagtggtgggagcattacgattcaagcggtaaagctgagaaatgggctgataaatggtgcagcttggatccaaatacaccactagatgttggtcacgctcatgtttggcatgaaaggtaagagctgctaaaatagcttctttcagaatgctttctgtccgtactcttatcttgcttttgtccgtagtcatatcacattcaagaaccaacatttcctcttgttaaaagaaatgaaaagagcaaatatttcagcaatcagattgtttgcaacatacatcatttatgctagtactgttgtaacatacgacagcttagtcatatcaatcaactcaatacatttctggctcatcctctacaggtggggcgagaagtatgatggctgcggaggtagtgcaaaatacactgacaaatgggctgaacgatcagagggtgacgggtggtcaaagtggggcgataagtgggatgagcatttcgacccgaatggccatggagtgaagcaaggggagacctggtgggcaggcaagtacggggatcgctggaatcgcacctggggcgagcatcacaactgtactggttgggtgcacaagtatggcaggagcagcagcggtgagcactgggacacacacgttccccaggacacctggtatgagcgttttccgcactttggcttcgagcactgcttcaacaactcggtgcagctccggtctgtgaagaggcagactccaaaaaacactaagcctgaaaaagattagatatttagaatagaatctactcaattgctatcataaaaaatagttggctacatggccatctttcatttttgatcttgctgaagagcccatgcttgtaaaataagattgaatggctgatttcagttgtccggttttatgccaatacctgtaccgagctatgttatcaaaagttcatatgctactatgcaatagaaaggttccttcttttagtttcaggaattgctcccctttgagattgtttgaatagaaaggaattttacagggatttgaattcaaattttatttcaaatcctaacagccactgaacctaatgccaaatttgctcctgaaatgcaactgattaacagttttacatgtgccatcctgccacgcaagcgcgtaggacatcgtcagtgcaggtgacacagtcacgtttcttcatacaaaaatataattctggagaagtgcttccatgttcttcaaaattaaaaaatgagacgaccagaatccacaaagataatgggccaaacaaagagaagcttatgccactgtcagataggttattgtgcaatggaattgcaattagccgaacctataaaccagtcgacatccgacgcccgttgacattctgctcttcatggcaaaaaattggcaaacatgactttgcaatctggtgatctgtagcaaatgagcctaaaagaaaacagaagtgaaataaactaggtttgactaatgaaggttgagatataattaaaccccaatttagtacaaaacgaatatgcacatattctctcacccctgatccctcttctctgacgagaattcttcaagctcctccatgcctcacacttcatgccatcaaaaggcaaaaacaagcaagaaacatctcctgctactatatatctcctacacatctacgacaagaaagtttcacacataccatcgatcgaattcaaggcttgaattcgaaagttcatggagagccatctcaacgagcagcagatctccgatttccgagacgccttctcgctgttcgacaagaacaatgacggtatgtttttcatgtttcctcctctaattttgcattgcaatgcgtttttacatcctaaaattcaggtttctccgtgacaacactgaattccatggactctgcagctgaatgcctctgaatgtagcagcacaaccagtttatgtaatgtctgggtctggacttgattgcaaagtttttcttacttcatattgtgaatgcatgggcttgaatacttgatctgcagttaattgtacatatatttttggatatcattttgttctttttccacttagtctgactctgaagaatgatgaaatgatctgcactgaaaaatctgtaacctgaaacggttgtatgtctgatgttaggttgcataagtagggaggagctggccaccgtgctcacacgcctgggcatggcgccaagccaggaggatctgcaagacatgatcgtggccgtcgatgaggatggcaatggcacgatcgagttcgacgagttcctcgcaataatgaagaagaaactatatgtaaaatgcaactgaaacatgaagaattaaattacaagtatcttttttatgatcttgcctgtaaatagctgggaaaattgaagttcttcttttcattttaaattcaggagaatgacaagggtgatgatgaggaagaactgaggaaggctttcaggattttcgacaaggatgataatggattcatatcacgcaatgaggtatggtttttgcgcaattttatcagcttgcgaattggaatttgtagctaagaaattggtcgattcatgtccatagttaagcatggtgatggctagtcttggagaggagatgacagaagatgagattgatgatatgatgaaggcagctgatagcaacaacgacgggcaagttgattacgaagagttcaagcgagtcatgatgagcacgtaaacgatttttgattctcttcagccagaaattgtatctggaatcattttggatgccatttgatttcatgggagtgtgagaggcaaagttgtggtatgcctaatttttcatgtagtgtgtgcagtgtgctatttgtttgttgaattgggaaaattggttacatcatgccatgtttcatcagttttggtgcagtattatgctgtgtgactgatgactcttccatcatatcatgaacagatggaatatcacagaaatattcaaacctcatgtaacaatctggcgttacaagccatgattgaacaaggaataatgttgtattgcataattatattattacctccgtcccaaaataaatacagccgtagaaatccgtgtccaacgtttgaccgtccgttttatttgaaaattttatgaattttttttaaaaaaatagtcacacataaagttctattcatgttttatcatctaataacaataaaaatagtaatcataaaaaaaattcaaataagacgaacggtgaaacgttggatatgaatagtgtaaaattgcacttattttgggatgggatggagggagtagaaaaaaattatgtatacaatctttgttcttccaaagagactaagcacacaattcaacacagctgaaagttgtaacattcttcttcatttcggttgagcatataatctgtacagctgattctgatccttacatagcctgcatctacctatattgctgcgtacaactatttttcatgtggtattcacaacagctggtaagacaatcgggttggcatctacaaatgattcaccaattccttcgatcgaactcaccaagcaaatgtacactcagcagtaaaatttggaggacttgttataggtcacgagtacgttagatttttatcatgtgtcggttacggtggctcctgaaagtaaggatgagctaatacttcatcgacacttaggcggtcctcctacaagacaagggtaagtatatgttaagagatggaaccacatcaatgaataaagtggtcataaaatagaactgcaaggcatgggctggcctgatagtggcattaacataattattttcaagtttagcaggatgcaaataacagaaacagtaggcagtagcttgtgtgtagttctcatcggtgcattccgtgaaatgggtgctcttaattccattgtcatcttcatatttcaaggagaagcataataaatacaatgcattatgcccacagtttagtatctttatgtacaatgtttcaggtcatagttttatctagagatgcacaggaagagttgaactttcccgacagaaatgattcagaactgtggtggttttcacaattgtatctccactcttgtgtgcttctagaatgtaagatattattctgccgcacttgtacttataaattcttcaaaaaatatacagggtgcaagcataccatttttctttacagattggggttcaagaaacttacaggatgccatattagtaactggcgtgctagtcgcaatgcccatatattaggaaagctggagtgcaacagcaagcataaaaatattagatacaaagatgaaaataatctggactgtaaaagacgtggacaacaaacgacaatacccaccccattttaagaggatctctgatcttcacttgatgcgcaaatgattcttcagagcatttccaagaagccggccgaaactgaccctaaaacaaagagaaagaaatcattgttagcaacaatctcctggaagcttattctacattaaagaaataacaacggcatatccaatgagtttcctttcaagcctcaaagcaaggatgtatagttactatgtactacctccatttctggttataagacttttgactttggttaaagtcaaactactctaag

SEQ ID NO: 68695 - DNA, 15437 bp, Oryza sativa
ttgaaacaataagatgcagggtaaagttttaagatgccatctgcgtacaagaaaaatgacaaacacttggtgtgcatagaaaaacttagtgcttaacaatttgctacctgccgtcatatgcacttgactgccttagggtcttgaccgtcttgatcaccaagcacagatccaccaacaccaagtgaaaatgtgatggtgaggtcgctgttgctgatgtgtggcacgcacaagggacatgtaacggggacgcacggaggatgctagccacaccgcgcgagtcggaactggacctggattcctagggataggccaccggggcggctagggcacgtctgcaccggcgtggaggcgaccggtggccagcgctgcaggggctcgggcctgttttggtggctctcgtcaacgacggagtgctggggaacgagactagattggatgaagattggaagggagcgcacaggcctacacgtaggagatgagcgtgtttctcaatcggtatcacaactgcttctggataaggagaagtgaacccaggaaattgagaaagaaacatgcaaaaagatgtttctagactcaattgatgagcccaggaacttctttttttttcatgtttttcaggaacgatataaatagattagatgcaattcttttctttttaggaatgagagaaacagataagatgcaattcttttttttaggaacgagagaaataaatgattgccatttttttaggaacgagagattttcttttgtaggaacgagtgaaatagatgattatttttgtaggaatgggagataggtgagatgcaatatattagctaactcttctgaatgctagaacacgtgtacacattttaagtgctagaacacgtgtacactattttatctgtgccattgcaaatgtgtctttttagataaatactactccctccgtcccaaaatataaacatttttagcctaatgtaaagtcaaccatttttaactttgactattaatagaaaaaaataaaaatataatcatgtaaaattgaggttactagatttatcattaatcaaactatcttaatatgtaacttttttatttaaaatattttatttttataaatataatgtgaaaatagcatgcatctcgaagactttgtcggagtacaaaaatacttatattttaggacatgagcattaaaattcgtctatttgtaagggatgttgtgcgtgaagctccacaaggagatctatgctgctgccctccccggcggctgcgacggcaacaccaacagctgagagcccgagaacaacgcatcaccattagtctttgtctttagaaagccagccgccggcaacaccaacagtagagagcccgagagcgacgcgtcgctgttagttctatctttagaaagccgcactcgacacgttaacactacaaattctcctagcatcggaccctataaatcaagtttgaccaataataaacgttggaccgtacctactaattagaggctcggtgttattaagaaatgtgataaactaaaagcatatttgtccgtacaatgcatggctccccttagttttgtattatatgatatgaaaaaaaacaatcgggtaaaaagaataggaaaaaaaagaaccattagtttcatattatatgatatagatacccttttaaaataatattattctgctgaataaaaatgaagggagagctagcagagggacacagtcattaggggatcacgttaatcacataaggaatttccttaatttttatcagtaaggtacaaaattactaatgtagtaattaaccaattttgtaaaaaaattgagatgtatctttttttttcaataaggaaattccttgagttttttcatgcgtagtttgcctccaaatacttcccgccaaactcaattttccctccaagtagtaccgcaacattagagtaacaaacctgctaatctctctccacatctctctcaacgaataagctccctatataatccccattcaacctggaatcagttagtcagtcttctgctccccactatctctcaccagagcactcctccatcgcctcctccaagatcgcattctcaactgctcagccgcgcagggcctccggccatggctctccccctcatctggccatctctctagactctctcccctatttcttgagttgtggaatctgcagactcgaagatccaaaccaccccatccttttcgcctgcgcttggtgagggcaggtcacaggaatcgacatttcaaccaaaggattcctctctacagtttgtgtaccttctctctaaaattcctgatgcttatttctgagagttagatcaactagggttaaataaaactggatggcttgctctctgttagagctatatacaccatgtgttcgatgaaaagcaccggtaccaccatctaaattccatgtttatttctgtacaagaaacaaaattagttcccactgatgattattgaagttctgatcaaacatgcagttatttgataaaccgtggtagcatctgctagacaatctgaacaggttaatgacatatgttcagtgacattgactacattattgtgaaatgaattaattggatttatgttgccagatctatgtaattagttgtgtgcaaaatattcctgtttagatatcttgataatgctaagtaccgaatcaaaatgtatgctccgactaataatcaaagtttatgcaaagtacagaagcaggggaagattcttgtgtgaaatagtcaattttaggttactgcattcattctcacttttatctccacctctaccatgtggaactgaaaatttgttatgctcgtatctctggctgtacttccaaacccaaacaagcaggtcatatgtgtgttcttgtctataatgaatatagtgcccctgtcttaactgaaagtttagtagtacttaccgcatttaagctcaattatatgcatccagttatatcatattaagccatttataatttatagttatctctttgaacaattcataagttttcaatagatgtagttttccaatttctgcaaagcatacgattttcatgtagaggcggtcaacctgtagcttttctcttgtagctgccatattacactctgctttagctttaacatttaagagcaattgatgatttatttgctttccagtactgtgggaatggaaggtgctgagaaaaaggaatatttatttgtttggttcttttctggattcttctctagctgaaagtgctacatccattatatttttgtcatgcatatactacacttataactgtatagtcttctaatcttttactccttgtgcagagatagttgtagttggtacaatattcccgtatagtcaagcatacatacacatagattaattcgtgctcttgaaatacagtaagccaattttgcaggcaaaatggctggaaagaaaaggttgaacatagtacatagcagctgtcaccatggaaatggagagggaagtagcagcggacaatcattgccacaagtcgagcctcctctaccatatgaagacgaggtgattcatgttgagcagcaagatgatgagcccctcaacatgcctggtaaaactttaactacctgaatcccaaatagtttgtgattgcatatatatggttaacctaaagttagtgagccttatgtcaattaattttgtagtacaagatgaagaggtgaagaagcgcaaggggacaaccttgcgatatgtttgggatcttccacctgggaaacgtatagttgtaaaatgcaacagattagggcaacctatcggggatgaaggtggattgctaggacagtttttgggcacattagcaagaaatggagcttactgtccattagataagatgacctggagaaagatcaaagcagatgaaggagatttaacaatactacaatttgtccaggtacctcaaacgctaaaatagcataagtataatgctctgtttgtattactagtcattacttttttcctactctcagattgatgcatctgttcatatccatggcaactgaatgttttcgattcaatgtttatatgtattttacagatattcaatgctgagttttcttacttgctgttatcccttgcctaaccattgacgtaatcatgcaaattcaaatacttctactctcattattcctatgtatttcagacaaatttcctgtaccctccatcatgcgttcaatggatactgaaatcaattggaagagattggaggcgatacaaggctgcactaaaagataaatattttaacccaaagaagaagcgttctgctctgtataagctttgtccagacgatgtagaaaaagaccaatggattccacttatcaaatattggaagtcaaaaaaaggaaaggtaaaaaatctgctccacaatctgtactattgtctcattgacatatattgtactgttgttcctaccgtaaacaacattggaagtgtgaactcaatgagactacattgcttctgtaataggccctcagtgcaaagaacaaaagaagtcgttcaatgttacagaaccctcactcagcagggacaaagagttatgctcgttggtctgaggacttggtgagccaatttgttttgttcaaaattcatctatacatgttcactttactttcttacattacctttcattttcagagacaagatgatccaaataagaagcagccacatagagcaatggtttacttagcaactcacaaaaaaaaggataaagataaaaatcaacacgtggtatgccatatacacataatccttccataaatatctaatatgtatgttatctaccttgtacagtgggcatatattttttcacttgcaggtcacattggagaacctcatcgatgaacaaccagagttggcacaaaatgaccaaggaagagttgcatgggaaggtgatgcgctaaataaagtattgggcaaagaaaaacctggccaagtgcacggaatgggattacttcctgttcctaagcaggtttatggtcgtacatcacatcatctcaagaacataaacatcactacagtgaatgactcatcatcgaatgaagagacacatgttagaggggaagtgggggaattaaaaaaattagtcaaaacactgggtcagcgtattgaggagttggaaaacaaaggaacaagcaatgggaatagtgaaccaactatggtaaacgttataaatacctttgtccttaacattgaatttttagctacttctgatttcatttttgtagatgcttgtaaaataaaaaatttatgtgattcacactaaaatcttaccccttcctgatttcattgttgtaggcaacatctcagagaacttttgatgatggtattgaagagggagtagtacggactaatagaaaggtaatgtcaaagtaatgcattctatgtttctcaccatattttgtgcaacaatatttaaatatgtgcacatacagagggttcgatgcagtagacctgatcaagacgactcaatgagtaatcaaagaaatatatcaatggtattttgtcgtttctaattgataaattttatttgaacactcaatacacatactggcatctatagtaaatttttattgtccattccactatagaacaaaagaagatgtgaggaacagcaaaatatgcaccatgacaatattctggatctttgtggcaaaaaggttaggatttgttgttttcattcatatggtgcaatgcaatttatatatggttttacatggattatatatcatggaaccagcaccaggaggctgataacaacataggatcaccatgtcaagatgattcatcatcacagccacaccttgctcatgatcttcggtgggaggtagttcttgaatgcctattaaaattgtacttgtttctcaatgtgttttatccatctcactacgatattagagtgaaatataaacacgttgttgggagaactcctagttaggcaatgctacatctgtgaatgcatcatttgtgtgaaacataaacaaaatctttccaaggagtactgctatatttttatagacattaatcaactgaaaattaagtagtagcttctagtgctcaagtttagctttggacccttcatctatgccatttagtgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgatgtagacccccgattttggcaatcggaaatcttctgtgtttatccgtaccaatccctggatcagtagttggtacacacatacatagttggatcacaacatatcacgaatgaatttaggctaaaggagttaaatacttacattagggccaggtaggccaacaactatcagagaacaacagcggaagacaaaataacataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaataacaatgcatatgatagagggtatttcaaggaatggcttcaggtccttttgcataaagctaattttacaattcttttcacaagcctaaaacctagcatagactgatcaaattttagtaccagtgttcactttaaacaacgacggttctgtccaccatccattgtgatctcaaggatagcttcccgccattgaatcgtcatggttttctgaggatgtccaccttccctcctctcgggatgtggctccatcagcataaaattcatcatgcaatatcccattccccacaagttaagaatttagagtctagccaagtgtaatacatgtcccggtgctcaataaccgcgagcgcggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaatcatgggtacaaggattttaagggtaaacaataatcaaggcatggcataatcacaagtaggatgttcatcattgcatgcaattttatttgtaaacaaaacaatttcgcaattaggatcaacatgttcaaggaatagtgatgacttgccttgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaaccacgctaggggctaaggtttcttaatctttctattgtcaacgtggcctatttaggagttaaccatcatagcatttatgggatacatatatatttggctaatcggtggtttagtctatcaaatggcttatggaaggattatggctaagcatgcatccatctaaataggacagtcatatactagaggttatgttgttagatggatttaggatcaatcaaataattacagtgaatcatttgtattatttattttattgatggaagctttaccttgattatgaacatattttacttgtcacaataaattataaaaggttaataattatccatgctctatatgttaaattcgggaagtttataatattatagttacatattatctcttaatgaacaatccggagttacaattgaactatgaacatatgaggtcaagatttataattagtacttatctactattcatgtttgttatatactcccagtttaatatatgaaaaagataaattaattgtgtaactataatgggatgtacaatatatgtgtgcaacaacgtataaggttttggtcgcctactctacatgagcttatttagaaagtgtactacccaatgctccaagtgattcctgaatatattgtagtttaattatacattagctagtttctatgagtgatattgtatatgtgatgcgataagtttaagcactggttctattgggttactaataagtggtaatcaatttaggcatatataagctattctatatggtattgcgtcgattaatttacttagtgattcctccacatctagctctattattattctcctaagcaggttaaagattcatctatgtgtgtttatattttagttgcataatcataaggctacacttgatttaaataacctataagccatggccatcgaatattaaataagtactagtattttcctatacatccattcatttgagacatcacataaaattagtttgtgtggttgttacagtggcaagacatgttagagacaaatattattacatccactctactgtacaatactaattttatttattagcatatttttaagttgactattatgcatcatcttgatattaattatttaatatttataactatattttatcaaatagtgaattatatatcattggaaagcttatgaatttagatgaatttaggttcaagtttcactcaaattggagctaaatatcgaacgaaatcctagaaatattatatgatttaatttagtctatgactaaatgattaaatataatacacggctaaaatccctagtaactaaatccgaatttctaccgtgaatcgattacttatagggattacccaaaaataatctataataatctataagaattcatctatttgtctagttattaatcacatctaaattactaccgcgaattgatttctcatagaaattaccaagaataatccataatttatattaaattttgcaattctacgactataattaatctataattaaattctaattattttaaattttctaaacttccccaaactccctctaatttcctatttatttccttttcctttttctccctttcctttttcttttcttttctctttttcccttttctttttctctttttctctcttttccttttcttttctttctctttccccttttctttttctctttttctctcttttccttttcttttctttctctcctaaatttctttttccctttattctctcttttccttttcttttctttctctcctctctttccctctctttctttttccttctctctctccctcccggtttctctcctccttccttcttctttctctccctcggcttctcccttcctccccctctctcggctctctctctacccggcggcatggcgacaaacaggggggaaaggcagcggctcaccgatggcggcggcggcgacgacggcgcacggcgcggcacagcgcggcggcttcgtggcggcggcgtggcggctcgaaggtggcggcgcggcggcacgacgacggcgacgcgtggagaaggggagggaaaagggagaggaggaggggatggagtggggagaggggaggatggtgggcttttataggggaaagagaggataagggggagagggaagagaagggaagggcggtggagggggggtgaggcgacggcggcgatgtgacggcgcgcggcgcgcgggtggagatgacgacggcgcggcgcggctcggggcgcaaggcggcgcggcacgtggcagcggcgcggggcgcgaggcagcgggcgcgcggcgcgaggcgacgggacggcgcgcggcgcggcagcggcacggctcgaggcggcgatggaacgcgcacgcggcagcaggtggtgacagcggcgacgcgacggcgcggcgcggagctcggcgcggcacggcacggggttcggcgcgacggcgacggcgaggcgatgacgacgcggtgcggggcgcgaggcggcggagtgacggacgagcggcgcgtgggcgcggggcgcgaggcgacgatgagacggacgagcggtgacgggacggccgacggcgacggcgcggcagcggcgacgcgacgcgagcggcgtggcgcggggcgcgaggcagccaggcgcgcgcggctgaggaggctgaggagggggaaatagagccagggaccacatcgagcacctagagtgcaatgaacagtgccattttctatttaacccgattttagtttatcccttgtataaatttcattctataaatcctaatttttacataaataaggtttgcccaatatatgttttaatttagatgaaagtttaccaaattttaatattacccatattttattcttatatatatatttctattgtattatttaaatgaggtctaattctaaaattagcctagataattttggaggctttgagggttctaaaatatcctagtgtggcccttattattacaatagcacattgaatgaacttatagcaatatattttacacggataggttgaatctatttattctataaatagtatattaagactcggtacaacattaatctaattttaaacactcacatattcttgtttatatataaggattaatttatttatatgaccattattttatatgagtgattttcatgtcatgagtaactcggcgacatgttgcaagtatcaatctatatattccggtgaattacttatttataaacacgatcactatagtggtgatcatcatttcatgtgttcttatatttcatgggagattcgattcaaatgaattagatttaatcttactatttctttagctaattgtgacatcaagctatcaatcatggttcgaatatttaatacctaatttgtaatttgtaatagaaattaatatttgacttaactatcttgtgcataattatttgtaggattaaatatattctcgtaaatcatatctattgcttaaatgtagttcttttctttaccttcttggtgatcatttatggtttggcaagcaataggaatcataacaaccagcatgatgcaaaagttttaaaaagttcgaaattttagtgatttttattgttgggaatttttaggatgttacacatctaccccccttaaagaaatctcgtccccgagatttagtgggactacggagacattaaactattttggcttaaatattgttcgacaaacaaacatgcaaatcaaaagtaggaaatcccgggtcttcgtggcttctggatgtcatgagtcgatgggcgaagcgaagcgacactctttgtacttccgccgtcttggtcagcaacggacttagttgacaatcttggggcacatgatccgtcttttcgcagaggaagcacgtgatcttcgttgttgggcattctccgtttggatggtcttcgtcacagtaggggcattgagtaatgcaattactaccgtagtgtcctatctctccgcaacgactacatgccttaatcttcgaaacttctttggatgggtctggaactctatccttttccgggccgatctgtgagggcagtgtttcttgttcttcattggtgtcttgagtacaacctatcgcataatgtccaaattgtccacaagaaaaacaacagccatctctctttcgttgccatagttgtagttcttcaacatcttcaggcaaatcaccgatttctattcccattttactgaggttaagttcagcatatgttattcgtgatgacgcttttcttttccgttttcccttccaccaatgtggtgtagttccttgtctacgaaattgctgatacataggttttggatagagtgaatgtggcatcggttttggtggtattcctgccctcattttcctttttgggtgtcgaggtatattccttacttgtccatttcctagctttttcttagggcaatccaaggcacaatgtccttcctcgccacatctataacacgtgacatttatccttcgttttgctggagtcaggtggcacctttcattcgaagaatattgctttaggtgattcagattgatggtgtagtcttcaggctttagtgaggcttggactcgtcctttgttcctggaagcttggggaggatcttcaaagagtagcatgggctggtttattcccatattttggggtcttgtagattggaggaattcttgtttttcgatgtcgattggtccatgtcttcacgtcctgtggtaggtttctcttgttagaagttagtaggttgaaagttagtaaactactatactagtcatcaatagtagcatgacaatgctgaattgttgtttttcttcttcatttgttcaatccttcgttccttaatatttattatgaatcttgccgacgagagttaaggtcacaccctttgcagttttactatccaatgatacttcaaattccctgtacaagggcaaatataccttgatatatagtattccttgtccatattttcccacaagttattatttcctcgaggtttctccatcataggctaccccccttaaaataagaaattttgaaagcaatttaaaaggagatatgcttttgcgttcacaaagaagatttttttttttcaaaatgattttgcagaaatatcctttggaagtgatgtttgcaaaacatttaaaatattcaagagatgcagtttctcaccaaatataatttgaaaatagatttttcaagcaagattttgtataatcatacatatgtttaacaaaaagcaacatggcaactaaaaacttttgtaatcaaatttttttttttaaacaacatttgattttatttcgcaaaagagcactcttgccaatagggccaaaataccatatagattgtatgcatggttcaaagttgaaacaacaataattttgaacacctcaaaggaaaactcatgaaagaaatttatttttttactattattattattattattattattattattattattattattattattattattattatttttaaacaaagctttaggcaaataattattggaattcagcttggaaaaccttttgaaaggaggctttcgaagacatgcactgaaaaattggttttgaatgaagttttattttggaaaactttgcaatacattatttggaatcaaaatttcacaaataattttcagagaaaattttcttttcaagctaatttcgaccattcccaaaatttaatataagttcagtgcggctctggggacaattttgcaattacatagtttgaaacaaacattttcttcctttttgaagtaatttttttttgtaaggctatatttcaaaatgcaaaaattaatttgcttcgcaatattttctaaagacattttataaaataaagttcagaggatttaagccatatgagttcgacttgtccttggaattttgaagcaaccctcaagctaatatccaataaattcaaatctctttcatcattcgtccatgtactcttatccaaataagggttccttttattgaatttccatatctacgtagcatcttatgttccttcttgatccataatctttagatccttgtatgtttagtattcttgctgggctttctcataaatacgtagtctgtttcttttctctttattgttctttatgaacttccatgtcgcaggtcgagcttctatggtcactaacggcttagtcgagacttcacttctactatacgagtgtgtgactagagcaaactagtactaacaatcatgagttatcatgattgatgagttaatttcgttcttttcttttgtttttctttactttgtttttcatataatcatgatgcaatcgtctactttcgaggatgaggtttcggcacaatcaataatatccctatagcgtcttaattgctttcggttcttattctaaaattttgaaatgtggatgagaatgtagaaccaatatttttcaatcacaaatcaagtgataaaatcgccttgtcaaaggaagggttgagatgtaaggtatcaaaaatatttttttctttttggcgtatcggaatcagatatttttgaagagaggtaagatgagaaacaatatttgaatgttttcataacctcttttttttagcattttaaaaatatatttgtaaaatataaggtcctgcaactaacggccattctatctagggtctcgacctacagtcgataggctctgataccaaccctgtagacccccgattttggcaatcggaaatcttctgtgtttatccgtaccaatccctggatcagtagttggtacacacatacatagttggatcacaacatatcacgaatgaatttaggctaaaggagttaaatacttacattagggccaggtaggccaacaactatcagagaacaacagcggaagacaaaataacataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccataataacaatgcatatgatagagggtatttcaaggaatggcttcaggtccttttgcataaagctaattttacaattcttttcacaagcctaaaacctagcatagactgatcaaattttagtaccagtgttcactttaaacaatgacggttctgtccaccatccattgtgatctcaaggatagcttcccgccattgaatcgtcatggttttctgaggatgtccaccttccctcct

SEQ ID NO: 68696 - DNA, 675 bp, Oryza sativa
  unsure (1)..(675): unsure at all n locations
agccactcctcgccgccggcacaaccaccaccaccgggctttctcaccgacaccaccggcgacggcagcggcagcctgacggccaatgttctgcacaatgtcaatctcctgcatatcaatcacactcccaaccctgaaatggtggaatacctgctagtattccactgcagatcaaacactttcctttggttggcttgtagagtagagatagggtacagtctgcaaacagaattggttcatcggcactggatataggatacagcttgcattgcaacagagtttgcagaatgcatggctttactaaagagggatcacccttacaatttttgcgctgttttattggactgaaaattaacacaaatcaatgtacccagtgacttgccatcagccaagcagctgtcttttcggtttccagattggattcgggtaaagtttaagactccggaagcaggaattttaggcactgtattgccattagataatcgggtggataatatacatattggtttgccaaacacttggaacaggccacaaatttcgagttaacttttatttgattgaggatttcacaaccggtttatacaaggtctagtacccaagagaaaaatagcgtctgaaacaaacaaaggacaagaaagaacaanggcctgttcctgtcaagacccatgttcactt

SEQ ID NO: 68697 - DNA, 1279 bp, Oryza sativa
  unsure (1)..(1279): unsure at all n locations
tgcgcnagtgagaactgatcacctttggcgaattcgagctcggtacccgttgcacgcatgatatttgacaaagcagtcggtatatcactcggatcatgttattcagggattcacaccgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatgtaaccgatcatgacttgggtattacgtttccttttatattatgaagcggcctaaagtcctgatttgataatattgtaaaatagatttaggaaaccgataccgtatgggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcatcgagagggcctgaacctgtctaaatcctttgtctctgcatccatccacttttaggtctcgtgcgctaccccttttattattgccgaattcatgtttcgacaataatcattaaaacagcatcaacaaaaagatctaattatcacgagatttcttcagtacgagctttgatcatttggaaaggcaaagcaaggggtccatggccacgaactcctgttcggaaaaggaaaagaccaggatgcatagcatagcagtgagagagtacaattaatgatcgatagcaaaaggacgatgcgacgctacatgaaaaccaaaaaaccacaccagcacacacatgcatcaatcggcattattgacgagtgaggaccccgggcatgtaatcgtcccgtcctctgtggagtgtggatccagcatattgattccagattcagattcagctatgcaccgaatcgaaacgacgttggttgtagcgtgctgcgtgcatcgtcactgtatggtggtggttggtccaggtacgctcgctcgagattggagaaccaaccgggcgggccagacgacggtgggaccgcgcgcgcgggggccatct

SEQ ID NO: 68698 - DNA, 1050 bp, Oryza sativa
acaaccaagaacacctcatttggtgcacccaatctccaggaacgcgacctttttaactcggaacaccgtagcgctctggacgccgcagcttcacctttgcctgtcgcccggcttcaacagttcgtaacaagctgagccacttcgccacgagcttcatcaacaccttcagatcaagaatcccgaagtaatcgacgcgaggtggaccacgatgggagatcctcttcttcttccccaattccggccggcgacgccattcctttctttctccttctctgggcagcttcggcgcaatctttttcgcctagagctaccttgtgctgatctaaaccgaagcacgtaccctttctatgcagtacaagcccgggggtacaccgtagcagccgcgccgtcgccgaaccagtacaccatcgccaagacttcgccgagccgcgttcgcttcttggtgagtccctagagtccttaccatacgcatgcacgattagatcgagcctcaaaacccacatgcatgtgcaagccgagcttagccactgcctctaacaccctaacagccgctatagagcaccaaagcttgcaataaagccaccaatgggtttgtatggttgttctctacacttttcgttttgggagcttgagctgaatcgccgccgttcgccgccggtgatgctgtgaagctcgcggctgtgctgctactctgctctgtccagagcaagggcatggcttttaaaatttaaagactcccagggatgtattaacaactcgagcagtcacttacaagtgggaccaatactaatctgtaaataaaataaaacgcaagtgtcgttttgcataaaaacctaaaccacgtgctaggggctgcgggacctattttcccaagaacccaggggcttatgcgaaaaagcttagtcgctgactggtggacctgagagagtaaatgatttgagaagattggagaaaatgcaaaacttgtttcttattaactgaaaaatgacagaactttagaaatttgtagaaaattcatcctaactataaaaattgaactaaattttgtga

SEQ ID NO: 68699 - DNA, 1993 bp, Oryza sativa
acctgagagagtaaatgatttgagaagattggagaaaatgcaaaacttgtttcttattaactgaaaaatgacagaactttagaaatttgtagaaaattcatcctaactataaaaattgaaaactaaattttgttggaatcatattttcatgctctgcatataaaaatgtttaacttaacagaatcataaagatttatgtctcaaaaatccgaaatgcacttaggaccatatttaacatgtaaacactttaaaaatctgtaactttgaatgtaaattgttagattgaagtttctttcattaaaaatcaaattaacacagagcacaccaactccataaaaagcattcattttagagcatgttggatttttatgtatgttttaattttaatttttgcatatgtatgtttagacgattcgccgccgagtctcgaggagatctactttggagctgaacaaggagtggaagagcaaggcaagccacctcccctctttgatcacattgaacctatgatttggtggtttttgaaaagtttgcaaaatatgcatgtctattgtacactaatccattaaaatcttgtaaaatttgttagatcaactcctttacttgcattatcacctaaactccacaaaagaccttaaccattatttcaaaccttaggaacaattgattgtgtcacattaagaacgatgtttgaagtcacaagtctatagaaatgcttagccatgcttagtgatgagtttacttaccatttgggctcaattacatatatgaaatgatttattttgtgatctgaattaaaatgataaaatgtgatatttgttaaataaaatgttggaaaatgtggattttaagtttgggcctcatgtggtacacatatggtgtttagttgtgtgtcgatagggggagaatgtgcccagaccgacctaaggacttcactcaatgtcagttcattttgtatacagtacaaccacatgtgctagtatgggatagcccaagcttagtaaattatttatggtttagccttacattctggtaggccggtgtgtatgagttcgtataattcagaggagctttctatttaccccgaagtggtagtttaggtgactaagtgtgtccaatacaatgctattgtgccacgtggtgtgttcccgttgtgtctgccaccacggcgttaagtttaaggcgtggacctgccacttaacggttctaggtcatatatcgagtatggcttaggatggagtaacacgtatcgtgctggtgtaagtgctggtgtaaggctaaatcatgaatcttggaagggctttgttgtgagtaataaatcgggtgcttatgtatcgcgtgccatgctttttgcatgattattatttcgcatcatgtgggtaaagtgtacgtactctgcagagttaaaactaatcgattagccgtgctcgctgtcatgagcggcgtgtgaatatgtcatgagtatagacatgtgttttattcttctaaagctgaatttgaacttcaaaatgtgatgtgatttatggattatatccttgctgccatggaaggcaataaggagctatgttatatgtgtttaacatctattttgatgcccatttgctaagtgtatgcttgctgaaatttaattgaaaataaatctgaatttgaaatgttctttgcaaactaaatttgctttatgctaaaattatcccatgtaagctttactttgaatacgccatgcatgtagagtattaggcttgcttggtgcttgccagtacaatttatgtactgactcttgcgtgtattgttgtattgttgcatgtttagaattggttgcaggtgagatcactctatttcgatggggatgtttctttcttccaggatggttcttactagggtctaccctagtcggttgcaggaaagatcttttgggtagaagatgcttccgcgaacctaactattcggccaatcggccatacttatctaagttataagttgtataaacttaact

SEQ ID NO: 68700 - DNA, 2508 bp, Oryza sativa
gaagatgcttccgcgaacctaactattcggccaatcggccatacttatctaagttataagttgtataaacttaactaaaacttagaacttagaattccctatgttgagatatcatgtgcttgaatgaaagtgtttagtgtgttccttttgttagggacatattaaacatgagtatgagttaaagatatttgagatgttgtagatctttagccatttttgttaagtcttctgaatgtgtaacacatctggttgccgtcttcgagtggtttgacaggcacatctcaagctgaagttgactggcaggctaaaggcctagcaatgtctcacatatctttctctcggagcgtcgaatgtcttaatatgtttgatggaagaattgtgtatagctattcatccttcaaatatactaatgggttcggagtgcttccgacactaaatcgggcgaaccatatattcggttcgactgtctcaacgagagattcaatatggtggactcaaatatatatttggcctcatgttgttggtggttatggtgcgcttttttataactcaatcggaaactctccaaaatgttcagaaatgaacttatttatgaccttaccttgcaaaacatgttgaaccaataaaactcatggaattctgttgatttaaaaaagaatggcaaggtaacatgttatcttcttttattttactaaaatgttggtggttgtattatgtttaatgacaaccaacacctacagtattacaaacacgctattgattagcccatagagattagagtcttttcctacccacaaaacatataaatttgaaggtaggagtatttccctttgtttttcatgtcctctatgtaatcttcaagtgatggtatcttacacaattattaatacaacatgtgctttaaatattttgaaaactcattcaaacataaaaacaatgaaattactgtcatactgataccatccaacgtatcaaatcttgtgcattcaatactgcatttatatatgccttgcctacattgtttttattccctcaaagcattaaaaagaatatcaccaaatctgtttccaccctataaatagtatctcttcttcatgtatcaataccaatcttggaatcttccaagataatcacaatgagggaaagtcgagtgattacagtaactcttcttctatcgcatatgttgttctaatcataggggggaagaaattcagtatataagccaaaggggaaatactagtcaaggtctcacaaattatggggttaataaaaccatcgaggtaagtgcaaaattagatctttttgtacatacatagcatcttgttttgtacctaacaagcaaaaagaacatcgtatcaggctgaagatggtgatgtctatgattgcatcaatatgaatagacaaccaggctttaaccatccattgttgaaagatcatacaattcaggtaaagcacatatttcaccctaacatttgatatcatgtctaatatgttgctaaaaaattctgaatacatatatagagagataataattaagtatgttattatagtcataaatcaaaatacaagagttttgggggactatagtattttttttttgttgggggggggagactagaatattcactaattcagcttgttttggataaaatagtaaatttatttgtttgttacacttcgacctggcactaaagccaaaaaaatttgcgtatctttgcttcatcatgaaagaatgtaaagtacaaaccaaatcatacttaggattttttttttcatagtgcgatgtaaactcatcgtttgtaaaatggtcatgttttcgtttgtcaattagttgaaaccaagctctttactaatggagatggatgttgaaaatccatttatatcttccatatcagaagcacaactacctagctactgcagaatgccctataggaaccatcccagtactacgcaacaagaaacaagactatctcaattcagaataccaatgcagtcagcaccagtcaacaaaaaaaggtaagatttttgtatcgagttgttcatatgtctagcttcataatagactcacaaaaccgctatattactattggtctatgaaaaagctatacaaaagtattggatgttttcatatttaagtgctaataaatgaactcaatcaattttgttaaatgaaatatgtgttgctctgtataactcaaacaaatacacaaaacctagatattccctcgaccttgcattgttttagtttggctgcttgtattttctattttatagataaatttataagtactaaaaattacgcggtgctaacgtagtatgttacatggtaaatataaacatatgaattccatttatcataatcgaacaatttaaaatatatcagtggtcaaagtagagcaagcaccagtcaagattataaaatattaagaaattgatggggtattatataatggccccttaatttgaagtgcgatttgttagtaagattatggtttttcactttgacat

SEQ ID NO: 68701 - DNA, 3074 bp, Oryza sativa
taaagcccatttaaaaagaattaaataaatttaattctatttatggataattttaatatgtagatctttattttatataacttttgcaacttgaaccacattaaactgagttacaatgaattagttatgaattttcaaagattaaatcggattaaatcctttatatagattttaattgaattatgacgtaataatgaattatttttgaaaaggaatagaggattattgcgtcagcgggtcgggttcatggtggaccgggtgcacggcggcggctcacggaaacgaacggccgagatctatcagtccacggccggaccacgggagacgacgacgatgacgtcagcggtgacgtcatcaccagcgacgacttgggcacgcatgcccgccggcgaacgacggcgcggcggcgcgaaaggagagcaccaaaacgatgcgggtgacgcagcgaactcaccggtgaccaaaacaacggcggaagatcaacggacggcaacggttacgagcaagaagcggcgacgaccttcggcttgacgacggcgatggtgttccagcggtcgacagcgacggcggaggggcggacgagatcggcgacggcttggtgatcccgacggcggctttcccgagcgacgacgacgaccggagcgacggcggcgcacggctggacaaacgacggcgcaaaagctcacggggctagggcgctacagacggcggcgggcgaaggcgagagtggctgcgggtagaggggagctcgggggtccttttataggggcaaggaggcggcggcgaaggcccacggcgaccggcgacgcgaaggaaaggttagggttcggagagagagacgaatccgattcgagatcgaatccacgagtttccaaaccgaattaggcgatgattccaaaagagaaaaggtagaggacatcgagaagatcatttcccctctattgatttcaccggatcgggaaaggggcgagcgaatttggaaaggcggcggcggtgcggctcggctagggttcggccgggcgacggctggaggaggaagacagccctgataggtgggccccacctgtcagcgggcgaacgcgcgcgcgggcggctgctgccggactgggccgagggagagagagagaggttttgggccggctttcggcccaaagccaaaagagacttttaaaaaccttttttaatttaaattattcatgaaatgcaattccatttattaaaaatactttcttggctcaaataaatcccagaaaaatctaggaactaaagattcaagagaagtatttaacaaaattttatctagcccaattttatattgagatttagcaaattaaaattagatattctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagctccgaaaaatccgagaaaatttcagagagtatacttaatcatggagaatttaataaaagttaaatccatccatgctttaaatttaggaaattttatttcccacatttaacttcacttgtaaattaatgaacatttaatataaattctaataataatttattaaataatttagaaatcctgaaacaaaaatcaggatgtgacaattttctgggtaatcaatatacattttgctacgaatacattggattatacagtacatatttttcctactaatttataccgctttgagatggtatagagctatattttccatttttaggtattgactttggaataaatttcgctacagaatgatgaagcgcaaaacaaatcttgcactgaccacagccgtcctggtttcgttcaagttagcagcagtgttgttcttggatgaagattaaaccatgcttccgtctataatggaacacaatatagaattcaagttcttatatttaaggtactctctattttacatgaaattcaatatggttaaaattacgtggttcactattatattaattaagttactcaagatatataagaaaacaccaattttgcataatatgttatatctacatactatattcagaagtacatctgatgcatcaagagcaatgcttagattatcttgcatgttagcacaacattactgttggcggatggcatgaggcctttcgaccaaatctgccgaaacccgtggcaaaggctatggagcaagaatggcgagaggcgaggggtcgtgcgagtaagccagaggcgtcccaggcgaagggtgcaaggcgaaaagtatctgccgaaggaagacgacttcgccatggcaagttcgctcccgcgagggccgaaaaagtctttccgacccatcaggcctaggggctatagggccggcgatcgcccgacggcccatcaggggcccatgagcctccataacattatgtacccctgtaaatgtccctttcgtaagggcaaccatgtaaatttccctgtataacctaaaccctagtagtaagaacctgtaatggggctataaatagtcccctagggccatgtaatggggggatccggagtaaaaaattctaaaattaatacacttcgtttctttccaaccactgttgagtaaccacgtctttcgacgtatgcagttgtcgtttcgacaacaattacaataaaagaagcttactacaaatcttagatcataatagacatttccctagggtcttccaacaataccatttcactttgaatagagaaaagacgttatattatactaactttgttcccaaatacttgttagtattgaccatcactattctaactttaattgttaataacattaaggggcaattgtgtttctgcccttgctttacatgtcaattgtgattttacccctactttttaaggtttgtgattttgcccctgcttttttgaaacgaagcagccgtctgcccctggtttggacggtagtttggtgggcccaggatttccaaattaaacgaagaaagaaaatgctattataatttgtgaatgactattcta

SEQ ID NO: 68702 - DNA, 795 bp, Oryza sativa
gtcaagagatccaccaacgaagaataatcgtgcgagacgtgtgatgcagcgatatttttttctcaccgcgctccaagtcctacctctttttttttactcacctctcccacctacctctctcccagattgttctcttcaccacctctccctcaacctctcaagctcgaggcacgactactaataggcggcaaacagtggcggagctaagtttggaggagaggggggcctcagccttcttcttcctcctccagcccactctctccccccattttcttcttcctctccctcttttccccctctcctccctcaaatttccatggagtccagctgggtagcgggggctcgagccctccccccttcccccgcccccatactggctccgccgctagcgacagatccagccggcggcggagctcgaggcgcggccgtgtgggcgacagatccggtcgacggcggagattgaggtgcagctagggcgacggctcggagtgtggtggagctcgaggcatggatccagcagtcggcggctcgaagtgtgacggcggatcctgggcagtggctcgatcgtgggccacggatccggccgacagcggagctcgaggtgcagctagggcgacagatccgggcggcggcggttcggagcgtggcagagctcgaggtgtggccggagtgcgacgacggatctagccatgcagctcgggggacgggcggcagcttggattgtgggcgaccgtggctccgggcacgggctgcagatccgccggcggcggaggcttcgggagtgggcggcgctgc

SEQ ID NO: 68703 - DNA, 6931 bp, Oryza sativa
caaatgaaactagagtcatgcaccaaatatcttgtttcagaacagcatattgaacaatgcagagtagacttttacatgcaacccatagattgtcactttgtcagacagtaagtaaattgaaagccccacactgcatccattacttaagctgggtttaaatccttcatcaagcagggggtagaaccctcttaaaacaatgttttctttccaccatcaaacatgtcaatcagagagggaaaccattgaagttgattaataaagatgttttctctccaccatcaaacatgcccaccagggagggaaaccgttgaaattggttaagaacctaattttacaatgaaagaaatggctttgtgcaaagtttttaaaatagtgaaccaaaaattgtatttaagtttaaatatctggaatattctacaattcacatgcttcagttttgaactagcattgctgtgcaagtagccaagaatccagcacagagtactactaaggctgtgttcgctgctgctcgttcccagcaggaacagtgcacatggaaaacggaacggtccattagcgcgtgattaattaagtattagctatttttttcaaaaatggatcaatatgattttttaagcaactttcgtatagaaacattttgcaaaaaacgcaccgtttagcagtttgaaaagcgtgcgcgcgagaaacgagggaggggttgggaacctggagatccgaacacagcctaaatcttaaaaatgaatttggtactaaaagaacttttagagacacagcagttcaccctaattagtaattggtcctctaggaggaaaactgaagactaaagaggcatcaaattcaaaatgcaggaaataagacagattctatattcaataattcgagcacaaaatacccaaaatgtatgctctaaccaaatggtaaaaggaagaaaaggaaggaatatgatcacacaccgagtaggccctgaatcataaagatgcttcaatgtgaaatcatcaaaggcactgccaaaagtcaataagacgcctgcatacacaacgaaacattttgagaagtgcaatgcaacatcattcttacattattaggtgggtaaacacgactacagcatgccaaacatgcttctgtaggtcacaaattcacctaacaagagcatgccactcaagtgtagcaagtcatgtactgatgtgtaatccaatttcccttttatgtatcagctctaaccatcattttggttaataaatgataataaagacaaaataaagaatttctaggaaatgttcttcactaaatgcattgaataatggagatcccaaggaaaagaattctatgctgagactgataaaattttagccagatgcatgagtgtgaaatttctctaaatagttggtcaaagagccattcagccaacagcaaacctagataaagtacatgtgaagtcaatttcctaaaactattgtactgcagattatatgtcaaacacctaggttcatttcgatatattataaggcactctgcaaacattctgtgggatcaatcaatcccacacctgcatatgcgcctctgccactgaggccaactatataaccataataaaattttgctaatcgaaccatttagaatcatgaaacctccaagtaaaataaacaacaaatagataaagtttttgcaacatctcagtaaaggaaaaatataattccttacatgttcagtttgttgtgttttgcttccgacggaatctctctcaaacactttcctgtctccagatcctcaaagcagattatcatgttctcttgcatggcatacaatgaattatgtcagcatgcctagttgacaaaagttatttctggaacaaatgaagacaagaaatgatttaactagtatgaatataactagagaatagaagtctatagcttttgtaccaggtttaatatccctgtgagtgatattacgatcatgacaagctttcagacccatcagctaaaagaagaaaggaaaaaaacagatgttagtatgtttaaccatgtaatataattaacaggttagccatctcacagattatttgtttcttttttttttgaatttgacaagagccacacacacaaaggtgggggagaaattagtatacacaggctaacaataaaataaagcgacaactttgatgtacttgagaagcatctagaatggtctatggaggcatggtgtttaatttacagtactataaagaatggtgtaaacataccagctgccataagagattttgcatttgcttttgcccagctttcgttgtccttaaccaataccaccactttgatggttgaagaacttgaatatgcctgaccctctcattattgttaccggtaactaactttgtttcttcagctgtatatatcagcttcgataatgagcggccttcattacggtacacaagccatagttccttcaattctgattcaaaagattctataaacctagcaatgtgctttagtggttcttcagtaaatgacatgttattttctgcaaagatatgaggattaagttgactgtccaccgaaaaggctgtggatgactctgcccttgacaaagcttcaagagttcttgaagcatttgaaaatagttccccaaaatatttttcccgcaatccactcaagtaagcagcacgtcctctctccacctgcagtttccaagattgaaataatcaagtcaaagataaggaaataacacttatgtgttgcttagaaaactcaagttacttttagatgtttaaaataacatgcatttaaattacattagaagtttagaaccatctaatcattgtagtagacaaactggagattgtcgatacatgatggagaaactgaccatagcaactatgtctgatgcaagttcaggagattagtgacagctaccatctgccacaatgtgaacccacagcccatggtagtttactagttcatagaatcataaattcatctggtagaacaaaacagttttacctctaatactaattacttggtgccaggaaaaaaatacaaagattgctacacgatggcaggtaattcatcaggaaaagatatttgacttaccattatgcgctttaatatgaataaatcaccatctattgtgtctgaatcatggttttcatcaggcaaagttgtgtttgagcttgtgcaattgtatgagtctggtttaagtatagtgttaaagtgtgaatgatctttatgtacgtctacatcctcagagcagttccaatgaaatgccaaccagacttcaccatatgacccacggtcaaatcttttcttcagcttgtacctgaatatggtcaacaatagcaaaacagtcaaatatgtgcatacatgtccatacataagtattcctttagccaatgcaatatatactactcgagttttgacgtagagaatacttacgcacattttaagaaaaatgatttcagaggaccaaatgaatcaaatcatggctcacctcaacttttcacggtctttgtacctaaccagactaataaaagtttgccatatgaagtcatcttcataaatggccttttaatttaggttgtgcttattcttcattttactcgaaaatagatctttaatgaaaagaaaccaaggtaaagttttgagctctgctcctttatctggataaagggttacagtaccattttttgttctgagaaggcatcattaggctagaattgtttttaagggaaaattgacacaagaaaaaaaatgaacagataacttcgaggggtgaaagtttgattggcgtgttaccaataaggtaggtattcaatcagtgtgaagtttggttggcaagttatcaacttaagttggtgcgagatctgttttgaaatgaattaagcataaaatctacaggcggatctacagatgatctgaaggtacaaagctacttgagatatgaatggtacctaaaatcagatatcttgtagccaaatgaatgtgaactatgcggtttgcttccattatgtgaaacagagtcaagcaatccaaagaaatttgcaaaagcttcaggactatgacaccgtcccatttcaccatcttgatgaccaaggtaccaacaaaaatctctgtccttgtatttatcaagatttcctgtatccatatgtaaaaagaagacaaaaattgatggcatgagcatgatagggaacactaacgaccactaagcattaaatcagaaatccacagctctctcaagtactaatatgacaatggaactcaaaaccatgggtaaacaacctaatgtataagatacatgcatagaaatgtgaatgatccttttctccaccatttcaatcagaggttaatatatactatcgaattttgaataccaaaagtttaagacaggatggtaagtcactgaaacaggattacacctaccaacaagctaacccctgaaggaaagaaacaatggcacttattattgaaaagatcccacccatgtagatgctaacagaaaatttaccatcagaaaataagacagtttcaactagcgagtgatcgaagtcattgactccttcatgctgataggcttctggtactctaaatatatagtccatatcttcatcaagactctcagataagtagaaacagcccagtctcttcatttttgcttcaacctaatttcagatgaagcaaagaaactttcacaacatggagtaacgaacaaggtaacttaatagaggaaagtaagaattctaaaaggaatcttctcgattacttcttcatacagaacatgttatatgccaactgaaacaaattaccagatgacacaatccatctgtttctgttggtctatctttcaggacaggcagtggcataacaagattctcacttaccaagaatcgatggaactttgctgatgaacgcttgtaataatccacgccaataagagctgaactaacaccatcatctgctagccacatgaatatacatatcaacaaaactaaggactagccaattaaggactttgcaggagaacttgaagtaaatgttgagtgtactaagtatagcaagaaagttgaatgggtcagccaagtgataacatatactccctccatcccaaaatgatcatcatatatgtttatgcaccaagaccaaggataatttaaatcgcatcaatcaatacatcatgcacacattctcccacaatgcatgcatcgattacaacaccatgccaattacatcctagcacgcacacattctcccatgtcgcattaattgtatttcgatgaaatccatattcatgcggttatatgatgatcaatttgagaaattttggatttcattatatgatgatcaatttgggaaggagggagtatgaactaaatagcattcaatttaacaggtcaaattcggttctctaatatttacataacatagaatctctcgactgtaacaaaatttggcagcaggatgttaaaataagaggatagcatcatcaaacaaaatgtgcagtttgctcttctgtgaagatttggtatgtctataggtgtccaatatattaacagtaggaaatggactaccatgtaaatttcaatgagcttcaaatttgaagacatacttgaagcaaatagataatataatacaatagcaaattattggagtaatttgttattgctcgaaactaataaaaagctcaatcttctaaataaaacaaaatgtacgaattgcccgagtggttgtgattacaaattgccaagtgaatgtgattaaaaaaaagttattgtacattgaacctaccagacttctgttggtatggaatggtctgtaatggtgaaatagatgtcttggaattttcttcaagcatataccaatcttctaatgtaactttagagctataatgagatcccaatggaacaatcacagcagctacattgtctgttgtccctttctctaaagcaagatcaactacataatctgccaaattccgttgcgttactgcaaaggatcctaattcttggttaacaccaagtttgacacgcaacatcagatcacaaacatcctgcatagtcattttctcaaatacaccatcagaggaggcaataagaaaggtatcatttgctgacagagattgccactctgtcagttcaggtgtcggtattacaccatacctacaaaaacaataagactggtcaattcaacctatccaagcaatttgtatatcaattgacagaagaataattcatatattgcaatatcacaggccaaaagttacaagcctaaatattgttcgcattgctaatgagtgtaatctgtatgtattgagaatctggtgtgttagacagttcttaattagagaaaatcaatgattagttattgtttacttatttgatttctgatttctgtacaatattgtgaggtatggaatggttggtcctcatctggctttttaacgattcctcaccatggcttacatattcatccagtgagggcgatgctaagtggatttgcaagggctagggattcctcaccatggcttccatattcatcccagtagcatgcaattctactgccatgaagtatctattcagatttctttgaacagtctaggcccaaaattcacttcttaggatatgcctgaacacagatagcaatttgcttgggccttcgtcctcacctccccaaaagaaccagaaatgctacatttgaaccccgcaagtactacattccaccacagcatactccaaatctccaatgtgagaccaccaccaattgggcaggtggtgtaacagttttgttttagtttcttaaaatgacattgttagacttaaaggtggtttctgaagaactagatccataagtcctattgcaaggcattgaatactccattagtggtatcataaataatttataactattggccagcaagtcacaacatccagccgatctgggctgcagga

SEQ ID NO: 68704 - DNA, 4888 bp, Oryza sativa
taatattcagttcctgaactcatgtcattctaacgatcggaatttcttccaaacaatgccattatatgacttcaagataaccttttacctgtttttcctactatactctctcctcttttaattatccatttctatttacaggtcatttatgccatgtatagagtaacacacaccatctcaagcataatagaaacataatggaggctttttgagtgaggtaagcatggtcatttttaggtatagcttggtttatgtgagtacaacaaataaatttctgaaaccggtaaatgaaagacataggtagaaattacagaatgtgtactaaccgtttgtaaggcacatcaccaatagctcttgatagtgctagctcaccattaacacgatgcacaccagcccactcaagaacataaccaccagcagcctccacacggcttctctcatcttctctatcaggatgatgatccttggtcaactccttcacattatagaacggtccatcataatttgctaatgcaaagtcatcacgattgttggagtttctctttcttctccgttttcctgatacaacagaagttttcttatcaatactactccacagtgcaagagacacaagcaaaaaaggatgcagagatgaatatgcaaacaaacaagaaaacaaggccacaagggccaacagtagcagcacaggaagcaacagagatgaatatatttcccctcaaaaaaacagagatgaatatgcacagcgacaattgcaagggccctgttcatgtccaagtggctgcattaacatggacgggctgagagtttatccaagaagaagttggtatttgagacagagtacaggaagtctttggtctgttaactggtggtaatagagttttcagtccatagaaggaatcccatatcgctgtactgtaattcactctttatcaagcaagaaaaatatgtctatctccctaattttctagaatcaatccctcaatctctctgaccacgacccgtatatgttcccctggcttctgaaatctaatctccttcaagttatatcgccaatccttcatctgcaaagggtttatcccattgcgaacaaggtttcacacaaagaaatatgatttgggcactccctgttgaaatgatgaaatattttgagcatagatctttccagaacttcaattcatacatgcacccatatttatcttggtgattgcagcctacccagattgttattcagtgacttggcagaaataattccacaaagatgatataaacacgaataaagtactactgaatgaacagagcagctaatcaaagaattaaggctgctgtgcatccaggtaaggtaatgacatgaaatgatgccaccttaatgcatcatagcacagaaggatgcggtaaagaagcgaaacttgaataatcacaaggccatgatgataggagcaaaggaaacatatgtattacaactcacagcataggcaaaaacacctgattgtgctaattcatttatataatggaagaaagaagactgactcttttgatggtacgagtcatgactttctgagcacaagaaagcctttgagtctcccacatttgcagctatgatttggccatcgactatcaagatcacagccgctgttgaaccaaactcaaaattattccgtaaagcttcctgaacaacaaaaggttcattttcagttataacgaaaacatgtgatgcaattcaatttgtaggtcaaaataacaccttccttggagaatgtcaaatcaacatcatgaactgctctcaataatgattccttcagaacttccatgtggaatgatcgatctagaatagcaggtaaagcccaacatgacctgcattttttcagtacagaacaacttaaattaccctgaaaacaaggtttgcatccttctaaatgccattcaaaaatttagtagtttaagatcaaggaaacaaaaatttcattttttttgttactacaaaatttgctagttgatatatcataataatttaagcctgcctgctccaacatgttaaatgatgtaaaaccttgtcatacaaacggcagaattagacatggaaaatactattgtagcaagtaagcaacatgttactcactttgttccataaaggaaagaatctagggaaacaaacaggaattcaggaccaggatataaaatattggtcgcttaacgctaactgaaatttccttcttaaaccctgattagctagtaagtgaaccaagtgaaaaaggttcacaggtgataaatggattatccaccatcaaaattgtactacggcagatgtcatacttagagcagagtatgttatacagacatcaaaattgcatgtgtggcaatactaggcatgtactagcattactggagatattacataggttaaagatcatgggaaagaaataaaaattttagatgttatgttagagttctaaacatgtacaactgtataggcagtatttggcactgggggtggatgtgctaatattgtgaaagtaaagcacatactgttttacatcaaggactcagaaacaaaagaaataatgttgaagtgcctattcacattaccatgcttgttatccaacataaacaaaacatagatagaagaacaacataccccttgctatgactggactggtcctccttgtacagattaatgacattattaagaatagtaacttctttatatgtcagctttccagtagattttctgaacatgatggagtatataccatcaagaagaaaataaacatggagcaagaaatactccagcaaaagcttagaagccatctcactagcctcagccccattatgaccatcaaatactgcaaccactccgacgtccacctctttaatcctcatatgctctgtgttttttggcaggatagatcagatcaaattgcaaatgaaaagagtgcatcttaaagcattaaacacaaaatagggaacaaacaaagcacttctaaaaagaggtctacatgtaagatatttgatatttcaattgaccgaataatagtagcctgtgatctcctgatctctacacatgatacaaccatcttcagcattgagcaaccatcagcatgtagcctttacggcacgcaaaagacattttccatcgataacctcggttggaccaagcaaattgtatgtatatgatacctttctacaaaacctccaacacattaacaaatcatgatccctctagtgtaagtaaaacccagcttcccacagtcccagttggattttacgacttgttaagaaaccactctcttcagagagatgccattaaacatttcacaggacaaagcgcataccgtagaagacctgattttgcactaggttccctgcataatctcaaagttctgattcaatctcatagaatctctcaaaatcctaagctggttttcgtactcagtttgcccatctcatactcaaccatgacacgaaagtgagaatttggatatcgaagcttgtggtatatacctatgaaggggatgcggatgccgagcgcgcagacggcgcggtcctcctgggaccgccgcctgcctctgtcaaccgccacgtggcaccccctcgggtgcggcggcggcggcggggaggaggaggacgacctccggtccccatccccctctccgccgctgccagcggagggtgcgaggagcgtccagcgcgggcagtgcgcggactggaacaccgcgggcgccccgccctcgcggtacacggcgaggcaggtcgccgactcccccgcgcacctccgcggcggcgcgacgaggacgaggacgacgaggcggaggagcgcggctcggagtaggcggcggcggcggccggagcaacccagccgcatcggggagtcgccgccgctcgccggagttgggggaaatggtaggcgaggctttgcgtgtcccgagctcgtggtgggccccaccctccagcctctatgagacgaagcgtcgttacatttttgggcctgaacggggccgcgacctctccatgcggcccacaaatgttgggccggaacgggattgcggggtacctgcagcccatatacgttgggctggaacgggattccaaggttcgtgcggcccatgtataggttgggctgaaacgggaacgtgcagcccatattaattagtgaaaatccaagaaatgttattattcacgaacgcccaagtccaaaaagttccatcgatgattgcgagtttttgtttcatatcatacaaaggactatatccgtaaatatgatcgccctcattaagtgctatagaacgaacatcatatttaatagggcgggatgagtgaaaccctagcaattatagtaattctagggcaaagtcgtttgtacaatgatatatttcatgaaattcacactcatcaaaaagtatttatattggaattagtggcttgtcaatgaaatatcttggattttctcaattgaagtaagccctgacgggattccggtgtacctgcggcccgtaatgttgggacatgaatgggcttaatgtggccgtacgtaatatagatggaaaaagtacaccgaaggtccctcaacttgtcatcgaattacaaaatcgtcccctaaacacaaaaccagatatataacattccttaacttacaaaacagtttgttttacatccttcggtggtcttgcacccggttttgtcctacgtgacgggtaagtcaacgtgggcctcacatgtcaggacgccatgtcatcagctccgtctttcccctcctctcccttcctctttctctcactcatctccctctgggtagggcggccggcagtggggaggaggtcaccgggacgaggaggtcggacgggcgatcggcgatgcggaggcggcgacacggagagaatgggagggaggcggc

SEQ ID NO: 68705 - DNA, 1738 bp, Oryza sativa
tcctccccaccgccggccggcttgcccagagggagatgagtgagagagaggaagggagaggaggggaaaaagagagttgaagacgtggcatcctggcatgtagggcccacgtgggtcccacgttgactcacccgctatgtaggataaaaccggggtcaaaaccactgaagggtgtaaaacgaacggttttgtaagttaagggatgttatatatttggttttgtggttgggggacgattttgtaattcgatgataagttgagggactttcggtgtactttttccaatatggatcaggttggactatcatgggcctgggaaatttaggcccattacgctatgaatgaaattagcaaggcagagcgatagatcgttcattgatacaacaaattcaaacgtttttagatcgaattgaagttggtttacgtaagtttgtccgtgcgtaaaatatagtcttttcgttcgtgtgcaagatatagttaacgcacttgtcaataacttcataattacagctcaatcttgttatttaaccacaatacgcgttagttgctttcaagccaatttaaacccaagtatccacatcgatacaccaggaattggccaatttggcacttttttgtggcaatttggtcaatatacaaaacaagcaaaacttttgacatcaagcacacaaattaaaaccctaataatgatcatgtaaacaaggctctcccagtagtggataactttcaataaatcagtagtgtttgagacgcataggagagcttatcatcacaatctcttatcctctctatccagcctcatcatgtgttctatgagctcatctgatagtcaccacaagcccattaataaacgattcaattcaacgagttcagatttattttctcttagcatgtggctctgagtctgacacagaagcttgcagctgaaattccatcagaaaaaagtgaggcagacagccactacccatgaggtgagcatcctttgacgttttcttgacattttcagatggatatgccaagctagaaatgaaatttaatggaaaaaggcctaactttgtcatgtctgcctggatggttacacctatcatttacctaaacacaactttagatgtgatatcatggagatcttgtgttgtaagttgtaacatgttgtttttataggtgatgaaatccagctttgttgttgaaattgttaggcagaccaagaaaaagatttgcatgaagccaaatacaagtgtctgatatgaaatcttgcatcacaccatcctttcatttcattttatctttttgaccatgtatcgtactagtactatataaaaagcattacctcgtctaacttcacatcaatataattagtagaaatcgtagtgattcatagaaacagctccatcgtttgctctttggcttctcagccacatccaaaatttgaatttttaaaccataattttagagttgattttgatttttttttcatcattggcttttaaattgctaaaacacaaatataaaaattttacccacattttcctctctaataagtgctacggcttataatcaattataggcgaaaaaatgtggctttttaaatccttttttttaacattgcccttttgattactaaaaaactatatatatatatatatatatatatatatatatatatatatatatattctgaagtgttaaaaattcaaaagacaaaaaaaaaactctgtgccttcataaatccaagccatgg

SEQ ID NO: 68706 - DNA, 968 bp, Oryza sativa
gtattcaagtttatgggggtaattcgatcgacgcaatagttcaggggtaaaaattattagtgatgaataaaattaaattaaatagtgatgaataggttttttgtaaaaataaatagtgatgaataaaataaaattaaatagtgatgaatagcgttttttgcccaattattagtgatgaataaaattaaattaaatagtgatgaataggttttttgtaaaaataaatagtgatgaataaaataaaattaaatagtgatgaatagcgtttttttacccaaaaagtgagcgcacggcaacaagtctagaatgaacaagatttccctaaacaatatatagattcgtgcaaatccaatcacgaataatgcacggcctgctcaccaattaatggatttccataatcaagttccactgtgtctcgccggaaacatccatgcctcggtttataaggtagtgtaatgttcgttcggtgagcgaggtgggactaaatccgcacaagcacagtagctgcaccgtatgggcctcaaattaagttccgcaaaagcgaaaggcccgcagcccatatgtgtgctgggctcgcacgccggctgagccatcgtcaagaatctgccacgtagtcagagtggtgtggccgtacgtcgtcctgcaaattcttgcatgcgaatgcgatgcatgcattggacggacggactgcgttggctgtcgttttgccttcgatgccacgcgacggtccacacacatacacaccatgcactggtggagaaaccatctttcgtcggtcggccgatttccacaatagcctcggatgcaataaaaaccggggctaaagatgatctttagtcccggttcaaaagggtaacgggcatatttgatctttagtcccggtttgtgttaccaaccgggactaaagatcatctttagtcccggttcgaatgctgtcagggcctgtcaggccctcccgggatctttag

SEQ ID NO: 68707 - DNA, 660 bp, Oryza sativa
cctgcagccccaacaatccgatgtgacagttactgaatcctaagttctcatcacctacatgctaggctttatgcacctaggaaccaactctagcaggtggatgcaacatccatacttgtagacgtagagaaagaccacactactagaaaaacgatttttcatggcattggtttataattttcgctggcggagaaatgccaaaactaccagcaaaattgtaacgagggggtaaaggacaccgaccgccagcgaaaatggatcttcgctggcggtcgcattataccagccgccagcgaagatatgtctattttcgctgatggtcacttaggtgcgccgccagcaaagatagataattttcgctggcggttgtgtcatacagaccggtagggaaaatacaattattttttctggcggcccacttaagcaaccgccagattttcgctggcggtagaaggaccgcttgcatagatggaccaccatctattaatattgaccacgcggcccaccaccaccaccaccagtccaccacccacccgccccctctctccagctcccctcccttctctccctctctcctccctctcttctccaccgacgactacgctaggcgggtgcgcggcggcgacggtaggcgggtgggcgacggtggcgggaggtggc

SEQ ID NO: 68708 - DNA, 3998 bp, Oryza sativa
aggcatgtgccccgtgcacactttgaacacaaattaaattattttaggacccgaagactaaaaaactgacggttggtatatggtgagaagaatacggcaataggatattggccaagttctcaattcagttacatgaaggtaatgggcagttatacaaagtggggtggatatgttcagggtccaaccgtctaagaaaattctccacaaatgggtaatagacattttgcttcagaagcttatggcacagtggcttttattagggacatcctgatcgtgaatgagaacaagaagcttgttaatccaaaccccgttaaagcctatgcaggatcctgtaatccaagtaaatatacctggactacctatacatttgtcgacaaatttttcctcaaaaattgacagatgtaattatagttcaatcgtagtgtaattacactgtaacttatatgtaattacactgtaacttgcatgtaactacactgtaatttatatgtaagtttcacataattttgaatcgttagatctattataagatttattttgatgagaaaaaaaaacaaatcatagcacacacatatgtgaaagaatttgttcccatgacctctattttaccaaaataacatgttatggagagatttttaaaagttacatacaagttagttacagtgtaattacatgcaagttacaatataattacactacgattgtactgtaattacatctgtcaaaggaaaaatttgtcgacaaatatatagcaaaatcgaccttcgatagttatggaattaatgcttactgtatgcatgtatactacggtggaccaggtaactacagctaatggtgtactctgcaagctataataacatatgtaattgtatgcaaaataacgggattcaagggctcaagccaccaccatggatacaccttctagctataatttcttcaattatttgcaaccactttcccactagatttttttttttgtaagtagtaaagatctccttttgtaatgaacaagtgggctatgcaaattaacagaccaagataacacacatagacaacaggtagagaatctgattcaaggaaaatttgcacaatggctaactagagaacaaaaaatagggtacagacctgaacagcccacagtaagaaccaaaagatcaatcaatggtccacgtgtaaaagaattacaacagataaagctgtgacagtgtgaaactttgttcctctcgccgtcctaattaccttccctgtgtgacttacaacctagtcttagctctgaatcaagttccttccctggagcgtctcatgctctcatcaatcaacttgaatgtcttctttacaagtttctggtctagggccgtagttctgtagattttgaagacgcggtccacacggtcaggcttgctgctctggaagtagagctcttcaaacttcttcttgacaaacctgtaaaacgtcactccagaccataagccacagtaatgatgaacgtttgatactatataacattagaatggaaaaacttatcaaggcatataagtgcaccatgcagcaacattacaaatggccaaatgcccatgttcatctgagagggcgagtagtgcactcactcatatgcatgttcaacctcctgtttcccaggtgcaataggctggtagtctttaaaccactcgcacacacttaaaggaacctacgtaaccagcgtaaacataaatgttggtaacatttagtactaaactatgcattggtacaaagagcaggccttaccttttgtattttcttctcgaatatatcaaatttgttgagaaacagaatgaatgatgttttctgatggtcaatatagcaccgtaattagtttcaaaatgagaaaaaaagcatgagcacaaaagttgcagagatggatgcatgcagacctcaaaacatctttgctttaaaacccagtcaaagagttccttgggctccatcattctgttttttgtctcatcttcaaatagcatctgatcatatctgaaatgaacaagaagcctatgagaagaacttagcagattatgataagttcaacaatcaaaaaaattgtacttactcgctaatggcagcacaaaagattaccgcattaacaccttcaaaaagatgaatccactttctcctctcattcctctggcctcctacatcatacaacctatatacctctccacctcttttgttttctccaacaggactgcagaaagaaacccagttaactagatgattcaactcatcttaaaacagctacattcagaacctctcaggtcatatcttagaagtgaaaggggagaaaaaaaggacttcaacttgtcgttctgtacatagtagagcaaccagcaaaaaaatgtgcaaaaaatagtgtcagcagattacctaaattgtatttgtacaacaccatttgtccgtactcttgcataaagcacatcctcctgcaaaatgactcataatattgacaactataatactgcaagcattcttaagtatggaagatcaactaccagcctttcaaacgaaccattagacaaggtacaatcacaaattatccatcagactgctaaatgcagaaatatggagtcatatcttcacttagcacacacaatgttaattggaattttgatgcagtgtggacttaaacaagtgacaaacaattttctatgcttaagaaatgacgggaaatggttgcaaaagtggatggtacagtgatcatatttgtggtttgcaacttattgaaggaactggacaaaaaaaatatatgctagtgtcataagattaatatgtgggaactcaaaagctcaaggtgcttagataagtagagttttattcacagcagttttgcaccctatgtttcacagggacattttttaccttcgttatgtagactgcgtaataacggtagaataatagtttctcctccctaatattgaattttaaaggatagcctccaatattatttaaaagataaggataaacatatgcccatcttttaaaactatttggcaacctctgactcagtacacatagttaaccatttgacaacctctgactaagtagactaaaaatcaacatgaaatggtgtcagcacaaatatctgagaatatgtaaataattgtctatgaacatggacagcacacctttgttggcacataacctgcttcagctaatcgatccaaattttccatgaagtattgtgcacaatcaggaagttgcagaatacttccacgtaagtaagtttcctacagtatagagcattgcttcagcacacctggccaggaaaactatataacttcaaaagatttgaatggctatttgttttcacctgaatggctgggtcttgccataacctttttacatcgagtacaagttctttgttcagcagtggataatccaacctgccatcaatatctgatagtttttctccaatttcctgatgatatgacaaagtaaatgacatctaagaaacaaaattggttggtaaggtgtacagtgtgaaactggtgatatttgtctttcaatgcctaagaaaagtcagttttcctttaaagttccaaagcaacggaacaaggtaaatgcacaaaggtatactttttttaacctggttgagaaaaaaattgaatcttataacacccacatttgataccaagttatttttagcatatcaacaattgtctgaagcaatcaaataaacaaggaagaataaatgttacaaaatctcattgttcttttctactttgttcagtacattgtacggttcaatagatatctttttcaagttttcattatagaatgaccgtgtaaaatataagactacaatagagccgagcacagtctacaaggtcttaacaggttaaaacatagagccgagcagcttgactacaacagaaatgttgcaaatcaaaatgtttgtattcccagatttaacaagacatgttcatatgcacagatttagctttaactgttgagtaaagagtaagcacaaa

SEQ ID NO: 68709 - DNA, 9224 bp, Oryza sativa
cctgcagccctgtttttacccccctctctctccccacccttgttctatacggtataccgtatacatacatcggcatattcaggactacctggagcagaattttgtgaatatatatagcagtagggaacaagaaataactgaaatggtactacaacatccgttctaaaatcgacatccatgtcaaggttattccatgacacacttgtatgtacacctactactagtttacaccttaattttaattttaacacgcctagaaatgttttaagatatgaaaagaaatacctcaaggagatcaagcaggccagcactcgcgtatactcttatatacatggtcatcatatgcatatattcgcatgcttcccgtgcttgtagaataagtgatttttttttaaaaaaaacattttatatatactatgttcctaaataagtatctaacgtatttttttaagatagagagagtatattttttggaatatcattttaaatccatattttgactttatagtagtagtagtgtataacatcacaatccatttagatatatatccagctatttgaaaaaaaaaaacccacataattgggctggagaatacacgcaccagcatgcatctctagccacctcgctgactgacctggctgacctgacctgcagtttccagttccatgcatgaactcaaaaatggggggaaaaacgctgtgctgacctctccctgaacatgtggcacgcacaaatcccttaatcaaattcatcgagatgtgggacgaaacgaaatagtggtagtaatacgtgtgcagggcaacattattatgatatgtttagattgatacggagtgcagaattaattagtcactttatttatataacagacccctgtggtgtgtgattagagacagacagcatcagcatggcccatcacctgacacttattttatagtacctctacacatgctcgcatgcacgtaattgtatattgttcgcaagattttagttactccgatcactcacaagttcccaaaaaggaatcgccccactaaaatatactgcaccacagctgactggtggattaaactatagtgctagctacacgtagcacgtattttgcttaattaattgtgtacaaatatttatgcattattcgtaattttgtttcctacaaaatgtaaacaccgcacactccctccgttactttattgttggcactattgaccagtgagtatcatttaaaccttaactgctaataatttttaatagtcagcgtatgatgcatactagtaaatgttactcgatccaataatataagtatatatcgtttcaagtctttacgatgttttttttaataaaatgaaggatcaaattaagttaaatataaataatgcgatggcgcagccaaatgtcatcttgttttcttcgcaaccgatgctggtgttgtcggcggcggtgcagcttggcattgctgtcgatcacctcctcccttggccagcatagcaagcctcctctccttgttcgtcagttgagttgatgccaccagcttatccctctcaatgcaaaccatcacgtgacgtgcatcatgcggccggccggctcgccggatctagctcgagtagtcctagcttgttgatgatgacacagcgagttaaatttgtatctggccggccacacaaactccctctcgtccgtaacaattaatgtagattaggcaacaatatatatatggtgagctcgacagcgataagagggcaagcctgagtacgatcgatgttggggtaagctcgatcggcaatggtgtcgggaggacgagcgcgtgcacagtggccgccggcaggagggagaggacggcaagtgctattgtatttggtgataaccacatgtagagctgagacacccgtgccttctgcaatacaagggtggctctgtgggatgggcaccaacggtggagctaagtggtgagccgagaccactactagctaggtaggagacgagcattgtggatgtggattgccatggtaggagtgaagtatactgtaggaagatactcgcctcctggatctggagtatgctggtgggtgccaggaaaaaccaaccgtacccatggaacaaccgcctagcagctggctggcgatactgtgagctcactctctgcatattcattcagagtgatgtgtctgacttactgacagcctttctacgaagtaccagactctccactccacacacgtgcctaaaatggcttcttcttcttccataatcttgacacggccaacggaagaaataactaactaacttccataatctcatggcgataaactttgcttatactcctgtccttgtccattgataccccgtctgaatcttcttctcttacaaacttgcacggatttccacccctcttctgtgcattgttactactactttaaagttggattttttttttgtctatgaaaatttactttgaattttatagctataccgaattgactcgctgaattgttcgagggtatctgttaaatgcagttgaaacatcaatgatatgttgttaatgaaactcagctgatagtgtcaattattattatgataatgaacaaagcagggagtgtgataattccaccatgaggagcgcacacacaggtagacagtcaaagacgacgactagctagtactccttccgttccaaaagttccaaaagataaaagcttttttttatccttacacgatttatgagatgttattttgatcaataatatctataaaaataagatacattaaataaaaatagctgtatattataatagtttatttaataataaatctagtaatatcaattttgcaagattgatttttttatactaatagttaaagttaaaaatatttgacttatcaccgtactaaaaatgcttatattttacgccgagggagtacctgttttgttttaattaaaaaagagaagaaaatgattaaaacatgcatctaccgacacatcgtctgacatttgactattggacggcctcctgatcacattcacatctagcattgcagggacaaattataaaccacaataatcctcctccttgaacagtgagagatgatgagtaggagctgattaataagctaatctgttgtagatgatcatatcatatataagcgaaaaagcagtactcactaattaacatgtaaggattaaggaataatggatatagctaagagagaccaacagaagcaacaaaagaagaaaaatgctgtgacttgtgagcccagccaagctatcactatctctctctctctctctttgtgcagatgagaatgagaggagacgatgagacgagagagagagagctattaagcagcagaagaagcttaattgcatggctaatgatgagaaggaaggagagagagcaataagcactaaactagttaattaatggccgtcatggctctcatccacttggtcgtcatgatcatcggtcgctctcccaacgccaacgccaacgtcttcctcgtcgccgtcgccgtcgccatcatggtgcgcctcgtcgccgtcgtccttcgtcctcccttcctcgttctgctccccgtcgaacgggaaacccggcggcgcgcaccgcacgtctgggtacttcaccaccgcgtccagcagctccgagctgcccttcgcctcctccccgccattgccgcccgccgaggacgacccaccaccgccgccggagccggagcgggagtagaggcggtcgagctcgtcgaagtaggggcacgtcttggcgtgcgccggccgcttcttgccgctctccttggccttgcggaagtacttgttgatgttctcccacttctccttgcaccgcttcgcgttccgccggtagcccgccgccgccatgcgcgcgctcacctcctcccacagggggcccttcagccctggctcctggaacctatcctccagccccgtccgcacccggatcagcgcctccacctcgtgcttcggccaccgcgacgagctcagctgcagcgacccctcgccgtcgtacgccaccacctccttccccacgccgtcctgctcgtcggcgcccggagcggggttggcggcggggggtgggagcgtgatggtctcgccggagatcttttccaggtaggcgatgatggcggactcgcgtgcagcggcgctggcgcggtcctgcgcgcgcgcggcggcctcgcgcgcgaacttgtcggcctcctggcggcgccacgcctcgtcgcgggcggcgcgctcccgctcccggcgctccatggtgtcgaggaactgacggtggaggctctcctggtgctccatgaggcgctgcaccaggcgctcgaagaaggaggccgacgcgctgagctgctcctggcgccgccgcttgcgcttgcggcgcgccgcgtccgcccccgacggctgctgcgtctgcggctgcggctgcaccacggcgtgcgcgtcctccccggcagacgtctcggacgtgttgaggtgcggcgggttggcggcggcggcgtcggggaggtcagccatgggcggcgcgagcatggcattgtcgtccccggtgaggccggagccggagcccgtctgggggcctccgctgccgggcttgtagatggcctccagctcgctgaagagcttgtagttgacggcgccagcggaggcggcggatgcggcggcggcattgtcgtcgggcttattcttgaagtaatacgctgggggcggcggcgcaggggagtcgggagtggcgggtttgtccttgggcggcgccctcttgctgctgctgctgctgtgtatgtagtcgatgtcgagtggccgcctgcacagcaaatccaacaaaacaaaatcaatgtcagcaacagctcgctccacagctaattaatctgcacaatttggctgcagctctgttgctaattgatttgcaagaagaatatggcgtgcgggcggggcggggcggcgaggaagaagaagaagaaatgatgagtgcatgcaatggcgaattgaggggggcggttgggttggcttggcgctttttggtgagtgaggtaatcatcaagtcgaaaaagggggagacgaaaaggtgatagctttgcgttgttgtggatgtggctgtgaattctgttgatggagaagaagaagatgagatgagaggaggaatcgcgacgcatccatcatcatcatctgtgtgctgtgcataaatcagagagggaggaggaccctgcgcttgcgagcgatggctccctttctcaatcatgacactattattggccgtcctctgctcccctctcccgagcaaagagagcatcctaagcaaaaaaagctctcctccttttcctctctgttcttctcttctccaccatggatggatgcatgaatccactccaagcacgcactcactcactccaatttcaactcaattttaggctgagtaaggataacttgtacgtaccaggtcggttctttgatggaagtttcctcgtcccccggccaccgccggagcctgctctccgtggccgcctcgtcatccccgccaccacctcctcctcctcctccatgaagcatcatgccgctgcccgcgccgcccccgtcgttcagcgcgtcgtccgttccgccggtggcgccgctgccgccgccgccgtcgacccccagcttgaagctcatggcggcggccaggaacggagggacgcccggaggggcggcggcgccggaggcagcgctcccggcgccggcaccggagctctccggaacggccgcctcgacgtcgaggccgagatggtggtgcgggtggtggtggtggtggtgctgcggggcccacctagccgggggcggtggctgctgctggtgcttctggtggtggtgctgctcgtggaagagctggaggtgggggtggtggccggcggcggccgcctggtggagcagctgctgcgtgaagggaatcccaccggcgccgccgaagtgcgccaagtggggaggcatctgaggcggcgggtggtggtggtggtggtgctgaggcagggcgtggtggtgcagcggctggtacctgaacggcgcgcccagctcctggccaccggccgccgccgccgcggcagcagcagcggcagcggccgcctgggcgggctgcggcggcgcggacatggcgaaggcgccggggtccatgatgtactgctggaactcagagacgccgccgtagccggactgcatggcgcctgcctgcagcttgctactccactatcttcacctagcttgctaccgagtagagagtgtcactcaccttcacttcacctagttcgctgcatcaagtggtttacatgccggtcgggtaattaagaaggtttgacctgagctaaggaagaaaatgcagccagccaaaaatctcactcacccctcacaacggtctgagctggagctggagctggaggtggaagaagaggatgaggcagggcagtgcagagtgcaggggtgaagagaggaggaaggaagaagggagagggtagcacaggcacagggaaggtagtcaggtttggtttccattttgcatctctggtggggtgctcggctttatctcctgcctcttttcgaaaggggaccctgctaatatccatatttgtatctccacccatccaggccagcccagggtgctcattattattctccttcaggtccttgtcccggtttgaatggactgttgctctttcaggaaacccctcctcgctttttctttaacaatcctgtccgggttttggggcgactcctttttttttttttctctctctctttcaattcctatgttcctatctattactatcgtcttctctcttttattttttacgctgctccagttattagtatttctttatttgtttgtaccaagggctcattcgaatcacacgatagaaaaaacataggccgagtttagttccaaaatttttcttcaaacttctaacttttccatcacattaaattttttctacacacacaaactttcaactttttcatcatatcgttgcaatttcaaccaaactttctattttagcgtgaactaaacacccccatactttagggaagatataggaataaaaaatgaattcaaatgtaaaattgaggatcgaaaaacagagaattatatataatgggagaacttgaaatagaggataagaatagaggaagatttataaggaaatgagaagtaatctaactctacttttccccggactcttctttttctagctgacgagcaacacacctttgtcccgttgccattgccaccgaatgcggcccaacacgccacaactacgtggcccaactccacgctgtcgattgtgctgtccggcttcttccgccgcctagcttcctctaggaccccttcatgctcttcccctcctctctgacttttgcgtctgcccaactttgagagtgagcccgtcggccgctatgtcgttgactctctcatgcatcattcactctacgtcgaaaaccgacctaaaaaaacaataatagtactacgaaaatgcagttgtaagtatataacaactttacaatatatacactatgggtatgttcggtagctgtttctgtggcagcgctacggctgcgatgcatactgtgtgtggttgtggctatattgcttgttgctacagtcctgccagccgaatagaccctctagtaattcttgtgtttgttcaaactgaatgttagtgtcagtgtgtcactaccattccaaatcgagatgatgatttccacacaaaaaataaaaacagcagcgtcctatgaacactgcaatatttaaataatgcatgaacaaggggagtaaagtgaaaaagacctgtccataaaaaggaaaaagggaaataaaagtagagaagaaaaaaaaaggggggtttagtacaggctacagaggggaagcaggtgacgtcagcgccactggcaccacacacgtgccatgcacgtgtgaagacaaaggacgatttggtaatgtattggtgcatgagtatgatgagatgcctagggcactgcagttttattactagtactaatcgctctgcttcttagaaattgatgatccctgtctgccaaacccagattttccatctctaatgatcttcttgaatcatctgcttgcttgtctgcatgcacgcacctcttcatcatcgtataattggtttttggctcaacgattcaacgaattacgcataacagtttggagaggaggacactgtcactgaggatgcagcggacacatgagattagaggagatcaaccaaatggtgacggactcattagattggtggtaggcctcatgcatgacgactcgatgaatcgatcgatcattatcgttgtgggatacacagtacggagtagataaagacgggcgtcaagtggtgattgggctacacagttgactaccggtccgtacgtagtacacggtggcatctgcctccactattacgtggcatgacatgctactttacgtgggtcaaatcgacatgacatctggccgccacgcacagctcgaccttctcctataccatgcgagaaccaacatcttttttttttttttacaaatgttattacttaataatgatatttataacatgatggcattacgaatgacctcatgctttcacgtcggagctaagcggctttattaaacgggagagtggcatcacatacaggatacatacgtcttgccgaagatatgggggtccatgcatgcttaatagaaagtgcctgtggcacaaaattaaagccaccacacaggatttatatctcatcgcctatctttcttatacattcgttctctttcattgtcctctatttaattaatgacgatactgatgaggatgacaatcaacgctcttccttcgctcgtccgaccaccattgcccctatctccccgtagctcgggcttcgggcactaccattttctttccctatggatttgacttacataagcccattctcattatacccaaaatgttcccacttaccatcggtatcatcctccatacctccaaccatcacaatcgtcaccaccacccatttacggatcttagacaacctcaatggttggtttgctctgggcgatagactaagtgaaaaatctaactagtgcgatggcaaaggggataaagtggattggtgaaacgacggttttaataatagagaactagtgacatagcggcctagtcaatagcgtctataacgaaagatcgacgacttatcaatttgcacattcgttgcctt

SEQ ID NO: 68710 - DNA, 3459 bp, Oryza sativa
atctcctacatatccttaaagcaaaccatcctggaaaatgggttcaactcaacccatcccttgaaccaaacgcatgactagagactgctaggaattaaagttaaaattccaatttgcaccatttctcaaaacatattgctgcatttgtatctccacgttctagctagctagaagatcgattatgatcagctccaacaaaaccgttcgaatagaggaagaagacggatgagaagcctgcacggcgctatctatgctctacacacactacagtagagtgaaagctagctagagtccaacgaaaaggaaaaagaaaaaaaactaaaggctatatagataggagtagctgctatatatgcatgcgcaagagacgctagctgccacaacgagctgatgatcgatcgagctcttggcctccgtgcctcacaaagtaagctacgcctacctacgggctacgtatacgtacgtacctgtagaaatcaagaaaggaggactcatcagtcaacctctaccaagctaattaaattcagctcaaaattaaaggtccaacatccaagaaaataagtttagcgtggcttagctccattccgctgcttggagtctgttttagccgccgtagtttctctaagcttaagttttttcttattttgctttttcttccctcccctagcataaaccagtctggctgattgcgtggtgtaactaaaactctttttttcctaatatattgatcgtgcaattcttctgcgcgttcgcgaaaaaaaaaacatccaagaaaatagatccttcggcaaagtgccaccatggctgtgtttagttggtgtgctaaatttttctaagtatacagacacacatttgaagtattgaacgtagactaataacaaaacaaattacggattccgcatgtaaactgcgagatgaatctactatgcctaattaatccatcattagcaaatgtttattgtagcaccacattgtcaaatcatggcgtaattagtctcaaaagattcatctcgcaatttacatgtaaactgtgcaattggtttttttcgtccacatttaatgctccatgcatatgtccaaatatttgatatgatggaaaagttgaaagtttgaagaaaaaagtttgaatcttgcatgtatcaatcttcgtcaagaaaaaaaaatcgctcgactaaatatcattgcattggtttcttatgtactatcacttaaataaatatagcatttttctttataaaagtggtaagataaattagtatgagatagatctctctacgaacatgcaaattcaactcacttcatttcgtattataaatcgttttgattttttttaatcataacttattaccaacatatatacaacaccaaattaatatcgttgagatgtaatattgaatatgtttgtttttattaaaaaaattctatattttcctacacatctactagccccacctaaagaaaatatggcacatgcacacacataggattgttcatttggggactaattagggaaagaagcaacaatggaaagcagggtcgatgttaattaactattgatatcctatgtgtaggtactgatttgaggtatagacctgacctaccaatcgagagttggagacagtattgtcatccatggtcaatgtgtgtagccggcctgcttgctgctcgatcgatcgatcgatctctgtccatatttatcgtgcttatgcatgacagcatacttcatatatatactagctattgcagcgctcgagcagagaatttgtcctgaacgtgtacagtatacaatgatctgtcatatttaccagctgcatgctagctgccgcaagcatataggagcacaccggatgtgcgtgtgtgtgcacgcagatcaggcggccccctagctagctgtacgtgcagcctccatagacagatctagaggggagagaagggaggccggggaagaagatcgagaggaagacgacgaggctccctccaagctaaagctaaatccacctctgtttgtagcattcatattttaaatttttagatctaaattcatatgtgttcttaccctaaaaaaatcatttgtgcttgcctcaagattacaagatcgatatgtattgatccgtggaagaagatctgtcaggcggagcaagctctctctcgttgctgaggtagcagtcaagagtactgttggttgggagtttgacggtgggccttcttcgtggatgttggctgggcatattggatttccctccttttgagaggagcttcatcggtacgatgaagacggtggctagacaaaatgaaaatacttaggatgctaatgtagaatcgaaacacaagaactaagctaatcagaagggggtgaatggttggtatacctaaaaaccgaaaacttttagcgaaaataaaagttaccctccaattcgacggatcacggtctgaccgaagtggatgcgctggtctgaccgcctgatgaacgtcggtctgaccaatgtagatcgatcggtcgaaccgccgaaatcgcttgccgccgcttgtctgtgccgccggtctaactgcccttgcgccgtcggtctgaccgccgcttgttgccggtctgaccgccagtgggatgccggtttgaccgccgaaacccggtgaaacacaaatcgaagaactctcaaattagataacaactttattacttctctctgtgtttacaaagtgcaccaacaatactccttacaaaaatctcgactaaactcgaaaccctaactaaactagcaactcaattgctctcaaaagcgataccgggaagcctcacgctccccctctatttacacatgaggtaggcagcctaaagccacgaaccaaactcatactaagagtcctaaacaccttaggaaaccctctagtacaagacacaaactttacataaccaatcataccaaatttggactccttccaaattcgactccgcatcccatacgcacacaatacctccatcgtatgccatatgaaatcttcaccaaccacgtgcatcaactctagccatgaaacaaacaaagaaaccatattccgaaaccaagctatccccaacttgactcattagtagcaaacaacagtattacatacgtatagtatccatctagaagccatataaccatgaaacaattacggatatccaaagaaacaacccgaaaccgaaaccgacacagcgtcggccggtcagaccgcgggccggccggtctgaccgctcgatcaccaccggtctgaccggcatacacagcccggtcgaaccggtcacataaaataacagtaaatccaatcatctctgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctc

SEQ ID NO: 68711 - DNA, 2581 bp, Oryza sativa
  unsure (1)..(2581): unsure at all n locations
taacctttttacatcgagtacaagttctttgttcagcagtggataatccaacctgccatcaatatctgatagtttttctccaatttcctgatgatatgacaaagtaaatgacatctaagaaacaaaattggttggtaaggtgtacagtgtgaaactggtgatatttgtctttcaatgcctaagaaaagtcagttttcctttaaagttccaaagcaacggaacaaggtaaatgcacaaaggtatactttttttaacctggttgagaaaaaaattgaatcttataacacccacatttgataccaagttatttttagcatatcaacaattgtctgaagcaatcaaataaacaaggaagaataaatgttacaaaatctcattgttcttttctactttgttcagtacattgtacggttcaatagatatctttttcaagttttcattatagaatgaccgtgtaaaatataagactacaatagagccgagcacagtctacaaggtcttaacaggttaaaacatagagccgagcagcttgactacaacagaaatgttgcaaatcaaaatgtttgtattcccagatttaacaagacatgttcatatgcacagatttagctttaactgttgagtaaagagtaagcacaaacctggttatctggggatataacatactttgaggaatctgattccacttgtgagagttcttttgctccttcatatagtatctgttaacatttaacacattactcgacaaaaaggaaaagtatgaacgcatttccttatgaacagaatacaaatccctagtcgaatctcctacataatccccactttgcaataagaaaaaaaagacacaccctttccagtattgcatactttaattgtctgatagacgtttgcatggataactgatgtgtagctcctaagttctgcctcatcaaagccagtttggaaaaggagcttaatctgcaggtgaacagtaagaatacatcagactaactagcggcgtacggattatgattctccatggaatataacattcatcacctgtttaaatatcgtagacttccctgattctcccgcaccttaaaacagaagcaattgagagagagaaagaaggatggatccacattgagaacaagttcaaactaaaaatttctaggatacatttatttatcttctttttttttggaaataacatgagaaaggtttttttatagaggtaaataggaacaacataaacaattaattttctgaaccaatagatactaaaggtagcacagataattgtgacaaggaaaatgaccacttaaatttgggaaagttagcaataccaagaagtaagagcttgtggatgtgttgctctgcttttgtctcttgcaaaattcgcctgtcaatgtctgcagactgttaccagctgaattagaagaaaccaaatgtggcaactctcaaatcaagaattgagttagcatttacttgttcaataagtccgagtgctaacttacttttgcatttttggttgtttcagcctcacttaaagaatgagatctgctacaggatgagcccatgttatcaagcacacaggtaagcacggacattattttagaggtatgctctcatgcctgagcctctctctttccaggaagcacgttgacgtctagatctcaggatccatgagctgcatacatgagcagtaagctcgagcgaaatgtggccagcatttgaaaagaaaagattgtacagagtaatggtttgcatagttcaatattgctgacccacattgttatacatatccagaaatattatatgaaggaaaaacattagtaaccattttccgaccaggattcatttccgaccaggatccatttcaatcactgacacttaataaataatacgtgaaaatatttagaaatacatcaatatcattgtttaataataatacatcaacatcattgtttattaataatatttttccttgcgacggtggggaatgggggcaaggaaagggaaggtggggggattggatggtttgagtgactcggggagggaagtggagcgaagcctcccgggagataagatttgcgcagaggcacgcgtggcctacgcattggcaccgctggcctccatttgggccgtcggcttcacatctgacggggttggtgtcgagggctcggggccccggtttttgcgttttgagggaaatgcgttccatatgtttccgacgaagagtattccagaataatacctactacattttttatttcttttgatgaaagtaggtaaggtgtctattttgattggtaataaagaacatagtttacataaatattacatatgctctagcagataaatagttaaaacataacgattttttaccataacngtggggggagccaaactagaaattaagaaattaggaagtaacatttaaccaaagtgcattctattgtaatagattgtcctggcatatatcattttgttttttaattcaaactatagttgatttgatttactaatacctanattaaatatctatatattagtctaaatatttttaaaataaaaatataaaatttttcagattttcact

SEQ ID NO: 68712 - DNA, 1252 bp, Oryza sativa
  unsure (1)..(1252): unsure at all n locations
tgtcctcccacagctcctgcggctctgcccgcactcccagtggcccgcgctcccccagctcgcgtgcgccgtactcaccagtgtactccccctacccacacccagttagcccctcctacacccccggacacaccccagttgcttcctcccgccgtggcccacgctttatccgcaccgcgcggaagcgtgttgttggttcttccaccgtgttccgtttccactacccagctcccccaccgccagcggcccgtgctgctgtcggccctcgacaggttccgccggtcccttcgcgtcagccgatcgacatttcttcgactgaggagccgactacaggaggcagccaggccgacgaggagtagaggaggcagtctacagcagccgcccgtgtgttaggcccttttgttccgccgccaactctttcggagtcgtggcaaggtagtgcgtgcgtgtgtttgttgtgggtgttgttcggtagtctggttctcctaggtggtgtgcgcacagtcaagctcggcgtagctctgtgacttgtccacacccgttgtatcaggtgtttttatgatttgaaaaatccagtttatgcttagtgtgcgctatctgagtggctatttacgttgctccttgccctcctaagtgcttatttgattcttacnccgccctcttctgggagtttagatggctagccgcccccgccgtgcagctcgtgcaccagcccgctttggttttgaagatggtagagccgagccagaagcaaatcatgagcagtctcaccacagcaaccgttcgcaccgtactgcttcccgcaatgcagaagttgagcaaccccgccgcagcaaccgctcgcatcgcacggcttcctgtgatgtagagatggaacagtctcaccgctctcaccgcactgccagtcacaattctggagaagaacgcctcccttccccacctcatgtggaaaacaacatgcagcacttaatggcagtttagacacaaatcttgcaaggattagccgcagccgtagccggttttcagcatactgcgcatggaaatggccaccgtcacatgagcaacaatagatccaagctgacagactttctgaggtctcgtccgccagagttctctcagaccgtcgagcccgtcgaggctgacgattggctgaaagatgtggatagaaaactcaacttggtgcagtgtactccggttgagaagacgctctatgcctctcaccagctaagaggacctgctgcagattggtggg

SEQ ID NO: 68713 - DNA, 1084 bp, Oryza sativa
  unsure (1)..(1084): unsure at all n locations
aaaatggtgaaaaagaccataatttccaaaaaaaaaatgaaaaccccataatcctccggcagcggtgcggcctcctcctcctccttgtcattgccgtcgtcgctcaagaacaccgctcatgccctcgttggcagcggctccgccgctgcgctcggcggattctgtgctccctctgggttgcaccaccactaacgcccctccccttcgccgatcttgggaggaaagaaagggagggaagggaagncggatccccaagggggggggcgaggcggccctgccgccggatccatgcgggggttggcccccgcccgccggatcccacgcctccaccgccgcagtgccgccgccgtcacttacgcctgccgctgccatcggaaggagagaagagggcacagatgagtgaggccactattgttgactgatagaagaaaaagagatagagaggagaggagagatagaggggaaaatttaaagtgggtaagagggaaaagagggagtgggtatttttgcatgcggcactcttaataggtccacacgcaaaaatgcatattttcgcgtgcggtccatttaagaggactgcacagaaaaatcgattttttcttgcggtcctcttaaatggaccacacgtgaaaatgagcttattttcctagacgcgaccagttatggtccatctacaatctaaatgggtcgctgtacagaaaaatcgtttttcagtagtgacgagaagggaaaagagtagcaagtgataagtctagattaggtatctttatcaaaatgtgtagaaagaggggaaacgcatggagatttggtatataatcaacttttttacttttacaaatttcatatatgtccaatttttacccttacgagatttatctccatattaaagtgatacattatcagccttagagtatgatgtctctaaaaatgatgtctcaacctcaaggttccaaaaaccgtcctaaacttctgaagaaattaaatgataacttcatgaggaatacaattcagatccctagtttcgatcggttcatccagtacttgatcctcccattcatccatttgaattcaacttctatatcaa

SEQ ID NO: 68714 - DNA, 7990 bp, Oryza sativa
gaggacggggaccgcgaaggactggctggggcaggaaatggagagcgcggcgggggaggcggccgggagccaggtgccgtggtggcggagcttgccccgggcgacaaggcggaggccgggcggcggcggcttggacggatcccgccgcggcgtcctgaagaagcgcgcgaactccaccgcccacttctgcctccgccgctgcggcgtcggtcgcgccgggagaagcgccccgctgcggacgtcggcgtccgccatggcgacgacgaggatgattgggagggttcagggcgttggggttttgatgcgcacttttggtgtggagctgttgagtggatgtaacaattacctgctaaactcagatgagtacaactctgtaaaaaaaaaaagacatacgctagctataaacatgtgtgtccatagttaggattgaattttttttttttaaagatgaaggggtagtaattagacctccttcaatgttcacactgttcccctgatgaggcatccataatgtactccaaacagcaatagtttaaccctgacgagtaaaaggagtatctatttaagtcatgtacaacgaggcttatttacggattttctccgttagtgtgtaagtaaatttggtaacatgaaaaaaaaagtggatgtgtgtttcatgtgaaaactttctatatgaaagttgttctaaaatattagattaatccatctttcaagtttgtattaattaaaactcaattaatcacacgttattaccacctcgttttgcgtgaaccacttaatctttatcttcaactttatcttcagaagattcaaacaccaccttaggctacattctatttttcaaacttcaacttcaacttcatcgttttctgttagcacgcttttcaaactgttaaatcgttttctgttagcacgcttttcaaactgttaaatgatgccttttttttgcaaaagttttctttgtagaagttatttaaaaaattcaaataaatccatttttttagtttatatttattaatacttattaatcatgtggtaatctgatttctcgttttgcgtgcgtcaaaaacctctctcaaaacacgagttgactcttaccttttttaaaagaaattttgttgcatggagtggagaaatggaaagaaaattaactaaatatattaggtgaattgatagttaagacatattgttgtcttaactattgtaggaggatagtctatgtttgaactaagagctcatgtcagactctatctttgtacagcctacgcctagatacctcaagagcacactataaaagggagtgcaatatatagatatcttgtgtattatctaattagaaaaacaaatggcatgttcctctcttttctgctactcttttctctctcccctaaagatcggttgctatccatcatacgtttttttaatatatgactatgttgacttttgacgtgatatttgactattcgtcttattaaaaaattatataaatgtcatttattctgtcgtgacttatttttatcatcgaataaagttacacttttacatatttacactaaattttgaataaaacgaatagtcaaacattatgtgaatagtacctactactccgtcccaaaaaaaacaaattcctagctacgaacctggacatacatttgtccaggttcgtaggtaggattggacttttttttgggacggatggggtacaatggataggaccggtactagcatgctctccccctctctctgtctctctctctcgtcttatgtcccctctaaaacccaaattatggatgctctaagcattgctgaaccagtaaataattaattcgcaccaagcaatagcactaaactggtagtaagatgaaaaaacattgacttttttctatgtattgatcctcactcctctctcttcatgctattggataatgcaaaactttatattatcataggacccatcttatagttagttagacattgtggaacttttaacaatagttgcctacttttattggatcccaccctatctaccggttggcaaagatatattggtgatacccttactcgtcattcacagtgtgatgacgtggcgagtgtttcacccactccatgtcgacggtacagtgccacgttggacaaattcgtgcttctgttgtgccacttgtatcgtctagagcacacgggtgcctcgtcagagcaagaggactcgtgggcgaaagcacgctcgtgtacatccagttaatatgtagaggccgggtttataatccattgtctagaaaaagaaaagagatttttctgcctcaaagctttgctgcaaacctatgcacagtccacggatctataaattaattttcagaaagcatgtatgataccaatcattatggatgaaaagaagatgctgatcttggctgaaactagtggggggcaacaaagccaagagtaatggaatttacccctcttatagatagaaggttgcctatcatccataacatattttctatcttagggaatgaaaactaagcaatatgttttatctggttcggaaagaaacaaatatacaattcagagctgataattccaatacaaatacgaataactctcctgatatgaatacgaatattgaaagatctagtcccctaaccttgtgttatgtgaagttttggtgattaatgacaacatattttgaatctaaccattgctatgagtttgaataataggttatgtcctggcatcaagcaagaagattgatggcttacatgttgaggatcaatgataagattttggcctaacagatagagatgatgcctcacatattatgaattaacgagatgcttgatgagatctatggacttgttgaaggacatacaccatggttgaacattgatagaaatgaagatgatgtgagaagctagaagatggactttatcgatggatgagattacctatgaaattgaagaaattgaagacgcggggtatgaattgattacctatggcaagaaggtaaagcgcaagcaacgctcaactatgacggaccatgcggtggtgaagggcaagcaaggggcttggcaccgatgaaccaaagccacggattattgacatcaatcatttgagaaatggaagatgaaatgccgaagatcaagaagatgtgatttgttagtaattaagaagagcattgatcaagagaaagatataactaatttaggaataatgtgcttattgagttataggaggatagtcccggtgatgaaatgactttgacgtaggtaccaaataaacaaagaaaatggtgtcaaggtattcctattggtatagcttttcctttttacatttaagtttaggatgacgtactattaagaggggatataattggtcgaatactagtgctcaaaatgatttatgtttgtgtgagttgaaaaacctaagccaaaattccaactccgggttgtttcacatgtcacaacacttacatcgggtttctttgcaagtttttcaacttattttgaaggttttggaccatcttttatgctggatttgatatcccatgaaacaagctttcagtagagtccaagattatcgtaattggattccgaagtaaaaatgttttgcctttttacttaagcaacatcagactacccgatttggaataaaactatctgatgtatcagaatatccgattttttacagaacttcactctctgtcttgatttgaaaaatcctctcaagtgagtttttgtaagtgtaaatcagagtatctgattatgggtcagataatccgatgacacagagacaccgaaatttcatggaacctgagtctccgtttgaggacaaagtttttgcttctaaagtatcggactgtctgattccacatcagatagtctgacgcctcagaaaatccaaaatttcatggaacttcgttctctgtctctcatcgccttggaggtatcatgtatcggatagttcaacgtaggtaaagattcccttccagcagtcaaattttgggggatctatataaaccccccaccaacccttttatagggttagccctttcattcaaatctttgtggcttgtggatttgagctttatgctaagtgctttggatttttataggagcatctgtttatattggattctatggcttagtagaaacgatatggtttttaacaagactccaactaaatcttatagtgcaagatatgcttcagttctagggctaacttcaaatgtgtcaagaggacagagaggtcatttgccctctagagtcatacgtcatgtagattttcactacatttgaatggagatttagtaataggcttgaactttaaataagttgctcatttactttgattggtgttgttgtatcgtcttttcatctcctttattttattatgttatgcttggatttcgaatcaaaactgagatagatagatagatagataaagagagagagagagagaggatgaattggtgtttgaatttatataaacattagacttgcaaaataagttatttcttccgctctccgcacaagcaacgcaaaaaatctatgatgaatatgacaagaagatatcactccagatgatgataacaatgtgtggaactacctataggaaaataacatttaccaatcgaagaaggtatatgctcattcctctttgcacattatcaaccagttgtccctttgcaactaatttggaagagcaaatgtagcatgaagttggaggtttgcatatgattgcttctaacagtttgactaaacacaaggaatatgctacaacaaataatgtttacaagacaatcagggccaggttgtgtcatttgcaatgagtcagacttcgaggatttcatacatctgttgttctttgtatgtgcctttgtgaggagcactagcaacttatcagaattaattggttaagcctgtttagatcccctggaaagttttttcaccctatcacatcgaatgtttggacacatgcatgaagtattaaggccctgtttagttcccccacaaaaattttacaccttatcacatcgaacgtttgaacacctgcatgaaatattaaatataggctaaaaaataactaattgcacagattgcgactaatttgcgagacgaatcttttgagctaagagcaggtacaatagtcctattcaggaggctccaaaaagttttatatcattaaattcatgcataaatgagagagaattgaaaagagagaatgaaacgggcgactaatctatcgcccggcggtagcacagttgcacaggtgattccgtgataaataaaaaactagctttgtggggccacaccgaaccctatcaatcccgtgtgacttttttccttgtatcggctctcacctctcttgctctagatcgcttctttccgcacaaatcgcctactcctccacctgagccccaccaccattcatcggagtcaatttccacagccatcagaaaccgcgtatgccacggaagctccgccaccgttgccggattaaagcccacgcaccttatgatcctgttcctctcatgctcagccatcagatcgaagccagatcgatgctctccttatgaagaacgtgttgttgccatgcgagatctcctaccgccttgtggctgtttccgttgattgaagcaaacaagtagctaggagaaccacgagaagtggttctgagttttgttgtgtcagtggatttggggatcttttttctctgttccttttcccttctgctctcgatatatgcatgttgtttatttacacaaagtagatggatttttttaggagtgatgtagttgtgataagatttggatcttcccatcaacatttcactagcagtaattatgtaaagcctaatcaattcttttactagttcttgttgatatcacaagttcacaacatacagatggctacacaggtatagtttagttttgatcgtacacatttatgtggacatgcataactaattatgattaatgaggtgcagtctacataaaagctaatctattgtactagttgtctttagcattagctacaaaataatataaaggtaagtggagccagctgttggctacattattgatcttgctctaattgctctatgatttgacaatgtggtgctacagtaaatatttgctaatggcggattaattaggcttaataaagttatcttgcagtgtagaggcggaatctgtaatttgttttgttattagactacgtttaatacttcaaatgtgtgtccgtatatccgatgtgtgacacggcaaaaattttcaccactggatctaaacacagcctaactatgatggaatttatgaatatgttcacacatgccaagtcccaattttcacaacctttttcgttgaagtggttgtaaaagcaacaatggaatatttggatgcgcaggaaatagttagccaaggttcttggtgtggaaataaaaagtttaagttcaattttggctctccatatgcactagccagtaaagtcgcttgttcgcacgactatgccttcctacctattaaatgtaatatgatgattataattatattgtaaataagctattaaagaataaatcttaactattgaaaggtaaaactcaaaatgaaacgaggatgagccacatcattcgataaatattagccgttggattcactacaaaacaaaagaggataaatgaatcttgaccgttggattagatggacagtgaaaataataatttaagaggtttccggagatgaaactactagaaggaaagaaagaaaggaagggcaaagctaaagaataaccatatgaaggtataatgttatacatataatttatttacgatttgcatctattgtaaaaactattttgctaataaaccctcatcaaaatgtatattcatttgattaattttgtttctaacaattaattttaatatatttgagaaaaaaattactattaggacatgcacagttatggttgcccatataattttaatgattttcacaggattttaaatgaaatcaaacacattccttaaaaacctacaaaatatttatgcataaggtataaaaagcacgtgccaaaaaaaaagtaagggggtcatgcagccacaaagacctacaagacaataacttataaaatctgtaacaaatattaagctatttagtgtattatcataatattagttagcctgacctatgtttttttacgagcaacgagaaacccataaataaaaaagattaccactcccacataccacataatagaaggcctagagtcgcgcgattgagcgacatcataggctagttttgtaggaagttcagttacatcttttatttataataaacaatattttcatgatcataaataattaacatacctagcatgtaaaatttatcgtaaatatttatattagcatatgttctcaactttgtatatattattagcaggtattatattttattatcaatccaggtaatttttgaacaattattttaaagcattaatttctgaacctttgaagaaccttgttctgtactgttgaaagggagcacaccacgcttggaaaaaacattagttttttttttctaatattctttttcgagcttaactccagatgctctcccttttctgatcaaagttaaattactatgtttttattactcccatgttttcttccaatccttccataggaaatgtcatgaatctcctcctgccctctatatttctacagaaaatctactgtacggtgtttcgtcggtacgggataaattaaatgagtggataacgtttcgatcttatcccttctctttctactccctccgccccataatataagggattttgagtttttacttgcaacgtttgactactcgtcttattcatttttttaaaaattattatttattttatttgtgacttactttgttatccacagtactttaagcgcaacttttcggtttttatatttgcaaaaaaaatttgaataagatgagtgggcaaacgttgca

SEQ ID NO: 68715 - DNA, 2538 bp, Oryza sativa
cccgacacctgggtcggtgcttgcgaattaaatgaatttccaaaaccgcggaccggggaacgtaccgggtgtacggttttccgctcttgcacttaaagaccgtttccttggaatttcatccaaacataagacaagtacgaccacatgggtggaatgggacacccctggctgagtaactagcttatcaggggagccttgatgccgagagacatgtggattcgccggggtggtgttggggaggacccctgggcttcctggcacagtatggtctgggacctaacctgttgttggtctgggacccctctcgtcggcatatggtaaacctgtgtcggctttagaaatgccttgtaatgaaagcttggaggtctcccaacgtggctgatccccacgggctgggtgatccgggttagtaatgtcgtgtgggtaaagtgtaccccctctgcagaggttaacaaactgttcgataagccgtgcccacggtcatgggcggatgtgaggtgattcctagcgtagttttatttgactactgcttgtgaaattgctgttgtggaaaggggttcgatgtttggaaaatctgcagctgatgggatcagctacgcccgggtggccgtttggaagttgttggcccgggtggccgtttgaaaagctgttggccgggtgccaaccttgtttcaaaatctaaagactaatacattgcacatactccgaccggacgagacgcactgtctcatccgtgtcgtttaagaagcactcacttagttgtttcagaaaagagttcaaataaaatcaattgcaaaaacacccgcctcttcttgaagcctgcattaaacacttatataccctggtttgctgagtactcttcgactcacccttgctctatataaataatcccccccaaatgcttaagaagatgaagcggatcctgctgatgaggagttcttccaggagcaagccggctacgatgagttttagggtttcggcctagttcccaagtcgcgcctgtgttgtttagcctgagtcctggcttccgtttcccttttgtaatgcagttgtgagctcgggatctgtccgcagcccaacatgactgtactcctactctataataaagagacctctgttgctgtgatattctatcttcctgtgataccagcactgttttctaggactggtatcgattaacaggttaatttggagcgtcacggtttagttccagtcgggactagttcggggcgtgacatttagctagggtgaacttgactgtgagaattcgcttggatatatttttctttgagaaaatcatgagctataattaggagtctgactttcatctgaaattagtaagtgagtttttttaaagagatttcttatacgacttcttttgtatttctaaaagtaaacgaacttaaaatctgattcaacacggataatgtaccaaaatctcggcaaaaacatcttcaatttacacacagacacaaagtattatgcatgttataccgcaagatttatattttagagtactttaatgtgatgctaattttatatttgtccgaaacataatatgaaataaattaatgatcaagtatgttattgaagaccgtatagaaaaaatataggccttctaatttgggacgcagggagaatctgatttcaaggttttactgcagtgtatatatgtattgaagtttatggaactatggagcctaagactgagaggtttgaatgggttagcacactgggacaaggctgcaaacttcttcagattacgcctagcttggggaaagcctgtagatcatcgtgtaataccctgtgttctagagaatggttggacgaattcgagggcgaatttaattaaagggggaagaatgtaatgccccgagtttccaattaatatgtttcgtggaatattagaataaacgcacaaaagttcaatttttaaaccgttgtttgaataggcgatcaggaaatatttcgtggaatattagaacaaacgcacaaaagttaaatttttaaaccgttgtttgaataggcgatcaggaaccgcggatgcgtagagctcgccgagtagtgcaaaatagacaataagtttatagtaatcggtgatcgaattaatatgggccattcgatcttcatcaggatatctattaaaccaactgaaaaaaaacaaaaaaaaaagaaaaggggaagagatcgatagcccagcagctgctacaagccctagccgccatcacccaaatcgctgctgccgtcgcgatttgttcttcactactgcatttttcagccatttaagttactgatgtacatccggatgcctcctaaacctactgcatgatgcacacccaaaaggtcatatacatgacgaggtgtaaattcacatttgagtgagcaacaggagaatatatgtttcattcggaggagtcctctggaccagaaatggtactggcaaacaagcgacttatattatatatatagtcctcaaagctggatacatatggtgtcacaacccatttattcgattacaagggagacatacatcgagca

SEQ ID NO: 68716 - DNA, 13567 bp, Oryza sativa
ttcctcatcttggaactctggaagaaaccagagataaactgcacgaaaccaagaaggaggccaggagaacagaacatacacttagggaccggatcgccgagctccaagaagccaattttgaactgagtggttcttcaaaaggtaactctatttctgctcaactcattctgacttgactcagtgactaaatagacattgtccatgttatagtccaagctgccaaaattgtcgagctggaaaggcaagttagtatctggtagtttagacgtggtgtctagattacgggatatcattatttggggttatatattgcggatgagaggtgggccgctgatggtgacagctcagtacgggtattcctctgcgcctatatataatcctaagttaattccttggggagggtattcctccgtatttagccccggttatatggtcatgacgggctgtcgtaaggaactcggcagtcaggggtggcttctcgaagtatcaggagggcatcggataaagggtattagctagtatatcagttaactagaatatatgtatactatgtatactagaagtataagaatgagttgttaattcttgtgtgtcactctacccttgaattatcttagcccctgcttagaatatgattatgacaagtaatatataaattattagtggagttctctctacatgatcttcccacttgataaaataaatacgatacccttggaatactctcgggtggaaagctacaatggtatattcgtgcgcttacagataatctctgtaactataataaaccagaagtatttctggcgccatttctgggaattatatttctagtaatgtcgttaagaaataccaacaagcatttctggcgccgttaccggggaagattcataatagagatttcttgaactaatactttatatttacctctgtataatcatttcctttgcaggctaaccttggttgttttcactgttgttgtggaaacagggtagtgcatgactggtttcaacctgccggaaaacttcaaagaaaatccagaagctttcttccagagcgtcaggcaacgagtcgttgctccgcagaaagctctaccgacagagaaaccagtcgtaccagcgccaccaaccttcaagactatggccagcaagactccgcgagttcgctgctccctctgctgacaatgtggccattgggccgcaggtcaacataggggacgtggatttcgacttgaagtccagccttatcacgatggcgcaggctagcccgttctgtggcaagcctaatgaggatgccaatgctcatctgcaatagttcctggagatttgtagcacgtacaccatcaagggcgtcagccccgacgccgtcaggctacggctatttccgttcttcctcctcgggagagcgatgcagtggttctataccaaccgtgctgctatcaacacctaggacaaatgccccatggcattcctcttgaaattcttcccgatgggcaaaaccaatgctcttcgtggaaggatttccagtttctagcagacaagggatgagtctattccggaagcatgggagcgtctgcaggaatatgtggccgcctgtcctcatcatgggatggacgactggctgatcctgcagaattttttcaatagactcaccccaatgtcccgcaatcacctggacgcggcatctggaggagctttcttctctaaaatggttcaaggagccgttgaactcatagagaggatggtctccaatatgggttggagcgaagaacgactccaaacccgtcagcgaggcatgcacatcgtcaaggagatggaactgcttgctgccaagttggacctcctcatgaaacgtttggacaaccacgagaaaaggccacaaggcaccgtcaaggccttggactcacacgtcacgtgtgaggtctgcagtggcacatgtcattctgggaatgactacccagaaacccgtgaggaggcaatgtacatgggaacaacaacgggtaccacaaggaagtcaggggtggaaccaaccacgcccatattataaaggaggtaacaataacggtaacatctccaaccagccctccttgaaggatcttgtttttgcgcaagctaaaactactgattcgttaagcaaaaagcttgctgccaatgataaggtcctggaaaacataaatgtcaaattagatggctttgcttccgcatttcaaaattagctgagctttaataaaatgatagaaacccagttagctcagttggcatctttagtccctgcaaatgaaactgggaagatcccggggcaacccgactcctccattgaaaatgttaaggcgatcacgacgaggggagttaaatccactcgtgatctgccgtatcctaaccctgcaggaagtgaaaggatgtcaaaagaagcgccatctagtgactcggctgacaaagaggttcagccagaaaagaccgtgccgcaggagtactgtgacacacggttgaagccattccctcagtggagtaggaaaccgtcagtggacgagcagttcgcttgttttgttgaagtaatccagaagattcacatcaacgtgccgttgttggacgctatgcaagtgccgacatacgcccgttatctcaaggacatactcaacaacaagagaccgctcccaacaacggaggtggtcaagctgatggaacaatgctgcaacctaatactccacaagctcccggagaagaagaaagatccggggtgtcctacgatcacctgttcgattggggcacaacaattcgaccaggccttgtgcgaccttggagccagtgtcagcgtcatgccaaaagacgttttcgacaaacttaacatcacgatgttgtcaccgacaccgatgcgcctccaactggctgactcgtcagtccgttacccggcagggatagcgcaggatgtgccagtcaagataaaggattttttcattccggttgactttgtggtgctggacatggacacagggaaggagacgccgctcatcatagtgcgtccgttccttagcaccacaggagccaacattgacgtgggaacggggagtatccgtttccatatcaacgggaaggaggaaaggtttgagtttcaaccgaggacggaacaatgctccatggttagaatcaagtacgggccaaacccgcagaatattcaagtggtcgaagtggagcgacccaaaacggatagcctggtggaattcatgcaaaatttcctggagaaggaaacaacgatgaccaggaaccgttattagaggatgccggtaaaatcacctgtaccggctaagaagttagagcagctggctcagaagaagccgtcttccgcatcgaaatcaaagaaggtgcggaaggaaaagccaaagacgcccgctccatcacctccgcgcactaaactgaaaggaggaacggtcctgcacgtcagacctaaaatgacgcgaccttcgccaacaggtaaattggtatgtatccgcatatttgctttcaacaatttgaatttttgcatcatcacatgtttaaatttcaaaattgcatttaggatttttttaattttgaggaaattcttcaaatgaattttttagagcaaaccaaaataaaattttcaacgaaaattccctatgccacgaccacactgaccgttcaaatccaacggccgaaagtggggccggttgggcctaccaggggttcggccaaaccggccaggcaacgactccctgccactttttgcagggtaacggcttgtgggtcccacatgtcatttctgaccgttatgggcaccctataaaagccagccggctggtgagggaattccatcccatttcaacacattttcattccctctctaaagtttgctctcaagttcattcaagctttgatagtttccctcaaattcaaatttttagttgcatatatacaagttgctttggtgaaactaaccggcgggtaaaactcttgtcattcctaacccccgccgagttagtccgttcttgcttcattgtgtagaatgaggaggcgattgtctcgtctgttcaaggggtccggctcttcatcaagtcatcatgacgggtccagtactcgttcatcagctgatgtctcgatggaagacgccgaagctccacgacgactcctgaacgacactgacctcaaccttgtcagtgatcgggagagacaagcctactacatgctgagcgaccgggagtatgctcacacgcgagaatactcaccggagctgctgaaaaagataggtatggatgttgaatttcgttctatttggaaagctattggttggcagagatttgctgtggtagatgagcctggttctcgtttgcttactatgcaatttttgtgcactttgaaagaaatagaagatggtatttcttttcgctttttccgtgaggagttcacgctcacatggaaaggcttaagtacattgttggctttcacgattcctgtaagattgatctccagaaagaaatttctggcttctagaaaaataggttttggaaagatatttctggtgctccaatttgcaagaaacctggaacgaatgatatccatcatcctacacttaggctcatgtacaaatggattgctatgactttgtttcctagaggtgatcagagacccattaggggagatgaattaattatcatgtttgccatggttagaaaaatcaaaattgctcctgtgaaatgtatgataaggcaatggttcgaaagtataaagttctctactcctattgagtgcacttctctgattactcggatagcaaaagggctaggggtcgttagcaaccaaattgtttttatctcagccgctcgtccacatattgatgaggcttatctagtgcaagggcatactttgaaacatggggcagatggatctttgatatactttttccccggttgtacaaatgaaatcccgttgccgaatgcggggtatcatttgtacaactgccatgaactaaccattcccctgcagaccatagaagaatctcgtgcaggtggaacatacagggagacgcgcaacatgacaaggaacgaacgataaagttcatcatcctcaacacccgtgcagatgtatgaagcaggttgagcaccaactggggatgcacccggatggacccaagctccacgacatagcatcggagtctcgacctggacaagcgccagtgaggaccggtgacatgcgcctcatgacatccaatggggggacaatcaaccctccagatcaagagatgtgcctccatctccaagtgaatggcgctcaagttcctctcgttgggacttgggtgaaatcactaggaaaatagacacccttgatatgcagatgggggagatccagtacaacctcacggaacacatagcttagacgcaagaatggcaataatctgcagatgcccagttcaccaacatcaataacatgatgcagcaacagcatgatgaccttcaagcgtactttcgctttcaggggttcaatccttatcaaggaccctgagcgaaagccaagcttaggggaagacatcgctccccccactaaggtaacttgtatcccattacatatttccctttccaattgcatatttgcttcccaattgcatcttataaaacttgaaaacaacataaaaatctgcaaaatagaaaataccaaaaagataagataggtttgagtcatgctatgtaagacaagctagttctctttgttgaaatgatgaatagttgctctgttttatatctctaatatataggttcttggtaagtgctctctcaaaggttaaatataagtagccaacaattatccaggaacctaaggtaaatgggctgcacttgctgatttaagtctaagttgttgcgagatatgaaataataaatatgagttgctatgatcctgatactagtttgacttgaattccagatgttttgtttttcaaaatgataaaattgaaagttcctcatttggtataaattcctaccaaatccaaaaatatgctatcattattaaaccatatacattttggttgcttgacattccattgaactttgtcgaactcttgtgacttgtttagatacttctcatgctctctgatcaagatcatacacccacatatatgcacatgctaaactcctacactgggagctaaccaatattccattccatttccatattaccaccaaaataaattctctatgctttcatgtgttttctcctcttaaaaagaaaaatccttttgaaaaaagagagagaaaaggagggaaaggcatggttatgaaaaaaaaataaagttatgctccatcaagcatgagcatgattgaaaaaaaaatgtagccatggcctctcctaattaataaaagaaggatttttgggagaagaaagtaagcacaaaggagaagcatttttcttttatttttcccatataccatttccaccatatatctcacacattatgcatgatcttgatcttgagtatgtttagttatctgctctagtctatgtttttgacttagtaataaatgtgaatgtaagtatgccatgtttgatccctaccgagctccacatacaacccttagagtaggaatcaacaaggcaacatttggtgaggaaattcatactgatacacttagagagactgagtgaatcatttgaggaacttgggtttcttttgcaaaaatcatttaaaaacttccggaataagagttgaataaagattgggtgattggtactctgattgatgttttgtctttcaaccgcccaaggcaaggagaagtagtgtctcgtgggaatcaagggtaagggtaagccaccgtgccaaagattatttaatctgagagagagagtacatataccttgcacctatatctctcagatatgcagcatagtaacaactcctgatcaacaactaatctttgttcccttttgtccttcacttgggacgagtaaaggttcaagcttgaggggttttgttgacggtcgttatcgattagtttcgaccgtcaatattaccaaaatagaggaaaactaatgatgcttacaatgcataaatatgttagaataataatattccactagtattaggtatactaacctcttgcagggaatgacactaaagtggaggagaatcgacatcaacacagacgataaatcaatcagacgatgtcgagaactagacttatgtatgaatgggccaagaactcagaaataacatgtcgcgaccgagaaaaatacattttcccgaacgctagtgtattaatccccatcccaggaaaagccgaggtacaccaaacaaacatgatacaaaaggcacatctttattatatcgataatatttacattattacaaaggcacttaaggcctgacaatcaaaattaaacagcagcggactagcgggcctatggctccaacttcataggcgctcaactggggtataagccaggactccacctaagacttcttctccaaagcttctcttactgaagggggggaaagattgagcaagaatgagtacaaccacagtactcaacaagccacaccggcagatgcatgattaatgcaagggggtacaaggggtaataatataggggttaagttttacagaaaacggcatttaaaagtcacttagttgcccaaagccattttataaagatgatcctagagttacacagtgttattaatcaaggccgtgaaccttcacgaacctgccttaacctaaggcctacaatgattcagaccgaattggcaacccgaccctgggtcccagctcgtcccaagccaacccaggccacccattccacattttagttgttaagcaggttttaagaattaaaacactaacttgggtacattgctaggcttgcccataaccgagggcgcgactattcgaatagattatactctgatcagaggtgtacatctttacccacaagacacatcttcctcacgtgtaaccacgtgccacataccaccatggtatacggacggaagacgtgacatagttcccaacccatcctagccataaacaagagtactgacccaaccccacctacggccggaacctccgggacaggtaggcaggattgagcccctagcagcaggacaccagccctgtgacatgacatctcgactaccgggccgcagctcgtgtagcctttatttgtcctagagatgtccatcgacccccgacttcatccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatactgtccaaatgatatgagaattcccaaagtctaaagttataaaaccacctaatgttgcctaattaatcagcgaagcatctacctaaattcatactagtggaaccatgaatagagtacccactagttggggttttattttcctagggtgaacaaggtaataataacaatagcaataataataaggtcataacaaagataaataaataggcatggctaaataaaacaatgataatgcgggaatttaaataaagcgataatgcattaatttaaatcaaaataattttataaactgggattcaatatgttcaaggatgatgtgacttgccttgctcagagataacggccttccgaaccttcggcgacgaccgcaaaccacgcttcgggaaccttcagaacgacgaacactacgcgaagcacacacgcaaagctacaagcctataaagaagcaataacaatatataaaaagaaagcacagggttctttaggttataacaaacattaggagacttgaacggatcgattcggagctcgtatgaccaagacatggtcatccgaagtttaatgctgttatatggagatttgcggattattataattaggtttttcaactataaaatatgtgcaagcgctagcctggagaagacaggaaggctgcgctgttgacatgcggaccccacatgtcaacctaagggaccacggcagagcgggtacacagagacggtccacgggtcgacagaagcggatcccgtgtgtcaaccgaggcgagtggccaacaaacggactccactagacaccacacgggctgcacacgtggaaaccacgcggctaccgagcgggcacactaacacagtcaccacacgcacaagcgaacgactaccgacaccggtacacgggtaccggggtcgacaaccgcacaacgggcacggatgacaccgaaaggacgaggacggggcagcgaagaagagatccttaccaccacgtgacgaggcgagggaacgacaacgacgaacgggtgcggcggagacggccgggaatgacggagacgaaagcgaggggacgacttcagcagcgatccttggatgaaggcgagacatggccggcacgaggcttgacgacgcggagccgaggacgaagacgacgacggggctgcagcggctcgcttgatgaacgtggatgacgaacgcgatcggcttgacggagagatgagcgacacaacgagcgaaaccgggaacgacgagaggacgacgatgacgacgatcggggccggcgaggaggcgacaagggcagccgtcagcggctgcacggagacgaggatggcgtggaacacgctgctgcgatgctgatgacggaggcggcgccgcgagatgacaagccagcgaggaggaacgatgacgacgatgacgaacaccggcggggttcggtcgaaggggaggcgaggccgagggcgaccttgccgctgtgatgccggaggtggagatggtgacgtcggccggcgcacgggcacggcggaagaggctgccgaaggcgacgtcgacgaggaggaaggagaggtcggcgcgggcgacggcgttccggcgaaattcgggcgacgccgtggcctggccagggaagaggatggcgccgcggtgccggggaaggaggcgacgacgacagccaccgcacctgcgaggcggcacaagcggctgaagccggtggagtggtggcaacaccactaaacgtcgacgaggacaccgttccggcgagcttcggtagaggggacggtgaggccggtgaaggggatggcgttgcagaaccgagggaggagacggcacggtcggacggcgcgcgggcgaggcggtaggggcgactggaggcggccggcggcgtgggagatagaaggaggacggcggggagaggcggggcgaccacgggagagcgcgggagggggctaaaactggagaacgtaccgagggggttccattttataggcgcggggagggagccggccacgggaggagcggggaacggcggcggaaaagccggccggcggccatggaaggcagccgaggaaggcgcgggcgttcccgacgattgggggcacgaatcaagggggaaattagggggaattgaagaggaaggaaaggggattaattccccctaatcaattttggaattcctggtttgaatcgcgtggatttaggggaggaatcgacgctagatttcacgggagagagaagagagagagaggatgccgggcgggaggaaggagacgaccgggcgggtgggacccatcggtcaggcgcgcgtcgtcagcgcgcgcacatgcgcggcacgggcgggagggcgccgctcggcttgggcaggggcgcggcttgggccgggtggccggcccaggaggagaggagggggaggcggcctgggggacagagggaggaggagggagtgggccgaggggaaggagaggaggcccaagagaaggagggagaggaggagagggagaggaagagagggaggaagagaggactttggccgcgggccgagagagagagagagagggaggctttgggccagagggaggagggggattatttttaggttttctttttaataaactttgttaattgttgttgttgtttaataaatatttccggtgctctgaaaattcaagtaaaatttgagggctccttttagaccaaggagaatttaacaaaaattctccggccatattcgaatttttcttgtacatattttagtgtttgccaatttcttttcgaattttaattaattctattattccttttagaaaatgatttttattttgggatgaatttatcaggacgtgacataacacgacacattgggccaaaattcacaagtctgcggagaagaacaatggagaaggccgccagcagaaattgggctggttttggctggacggttgagataaagccccaatgactgttgaagggtattaccgaccattccaaccgtcacaaccgtcatagttcagctataaaaggacttcaccttctcacttcactcacacacctcaaggaatagctctcttatttctctcaagtttagtttagtagtatctagctggtggaatagaaatagaataggaatcaggagtccggaagctttcggaagagttcgggtatggctctagcagatttcctttcctcttttgtaagctttgtacttttattataatactcttctttatacatttatggtattgaaatacttttcgtgtatatgagtacctaccttacattatgttcgtgttatactaaatatacggctggcgtatctgtgagatgctttggtgcgggtataatgtttgcttatacaattactctatgtcatgacgatgatattagagtagtatctggtagtttagacgtggtgtccagattacgggatatcattatttgggattatatattgcggatgagaggtgggcagctgatggtgacagctcagtacgggtattcctccgcgcctatatataatcctaagttaattccctgggagggtattcctccgtatttagccccggttgtatggtcatgacgggctgtcgtaaggaactcggcagtcagaggtggcttctcgaagtactaggagggcatcggattgagagtattagctagtatatcagttaactagaatgtatgtatagtatgtatactagaagtataggaagagattttcttactcttttctttccacctagcttagatcatttattatgagaatgagttgttaatgcttgtgtgtcactctactcttgaattatcttaacccctgcttagaatatgattatcacaagtaatatataaattattagttgagttctctttatatgatcttcccacgggagaaaataaatacgatacccttggaatactctcgggtgaaatgctacattggtatatccgtgcgcttgcggatgatctctgtaaccataatataccaaaagtatttctggcgcctttgctgtgaattatatttctagtaatgtcgttaagaaataccaacaaagccataaccatgaaacaatcacggatatccaaacaaacaacctgaaaccgaaaccgacacagagtcggccggtcagatcgcgggctggccggtctgactgctcaatacacgtcggtctgatcggcagcacttgcccggtctgaccgaaccacatccagcagtacctgtagatcacctgtgaaatccaatcatctccaaaaccacttcgcaaataaattccaaataacaaaatcaataatttccaatacccaattgttcatcacagaataataatcaaaaacacctttagttttacacaagttgccaacaaacaatcaagaggattttcctactcgcactatgagaaatctggtatgttactgggcgaagtgcttacaagcttgctctgaatctgagtgtgatgcagtatgtaggtgcaagcagttctgcaaaagatggagaaaggtagatatgggcaaatatttggtctgcacaggttccgcctaaggtgaaaatctttgcgtggaaactcgctttggatcgacttcctacacaagaaaataagcatcgaagacatcttgctccatgggccatttgtgttatctgtggttttgaagctgaaagcagctatcatgctgttcttcgctgccccaaggcacgagagttaaggaaggaaatgaaagcctactggcacatcccaagtgagaagaagttggagtatactggtacagattggctgcttgttttgcttgattccctgtcacctactcacaaagcacaactcctgttgcttttctggcgagcgtggcacattaggaatgatgctgttcatgcacaaggtagagaagaggttgctggctcctgttgttttcttcgtacttactgcgacattctttttcctatccagcaaaatgatatagtcaacaagggtaaaggaattataggagttaacaatctaaatgttcttggtaaggataagtcagttagggttgcttgggagaaacctgaacctggctgggcaaagatcaatgttgatggggcctttatagctgagtcaggacaagctaggataggtgttataattcgggatagcgcaggtttacctctgttatcgtcctggagaatga

SEQ ID NO: 68717 - DNA, 8469 bp, Oryza sativa
tcccttatattatgggacgggagtattctctatccaagctttcatcatcctcttcctccacctctcctccttcgtccttcttttttccccttctcgtcctctcagctacagagagctatgtgtaggcatgacgacggtggagcaagccacgaaaaatggatgtagaggcctaaaccctcctcactgctggatctggcccaggtgcatgttggctacaagggtggcggccggcaccactcatgtggcctcctccttcgcctcatgcttttgaggtatggtggcacccactggatctagctctcatggccaaaaagggcaaccaagaagaggggaggccgtcgggaaggttgctggccggcatggggtccttagcctccttctaggcatgttgttgatgatgatgaaggggcgcgaccaatgaagcttgtggatctagagctttcatttggcagcgacatgatgacgacttggtgagccatcatgttcctcgctggagtgtgtgaaggtatgccgtgcaatgcatcatctgcagtcgatacccataggtatcatgtctggtacctttggtataatggctaatacttaggtatcatggctgatacccatgtatcagacccggtacctgcgggtatcatggctggtacccacgggtgccaagtttagtacatgcggtatcatggctggtactcacggatatgagacctgataccttaggtactagggtcgatgcctacaaagtatcaagtagcaacgtttcctctcattttcttcctttccctcggttcgatcccttgctgctactgttgtgaccagtgttggtacctacattgttgtaggcgctagctccagacgtgggggcgccaaacatgtggagtaggagcaggatggctctaaatttataggaagaaagcaaatacgtgggatgacgtcagccttcttaaagtgtcccgtttggacggaatcccgttctctaccagccctcaatcttcctttctcctagcatgcatggcaacatatcaaaattataaataaatttcaaaattttccatggtagttcccattcagttttaaacccaatattatatcattatataggtgcttctaacctatatcaattgattaaaaatttgaaggaaaaaaatcgagacattcggtataatgctactccatctcatcctgcaaacattcagtacaaagtatagtggatcgattttaaaagactaggaggtaaaagtgacctacaaggtcatatgccctgttggaatagttggagggaccgagagagtaaaatgacaccattgcaatttgcaagaggaaaagctggatctatggaaaagactgcctccctccatccctaagtgcagttttaatataagaattcatcattaaagatagtagtctactttcagatctctttaatgcagctacatctttttcttcttatttttagccattgaacctccctcctcattctcttcatattattattttttttagggaactgttctcttcatattattgaaggacatggtaattcttaacctcttccttaacatgtcaaaatctagggatggatggagtagaaagtctgatccattaaaagttcagggaaggattaacagaactgaactttttatacttgttatgccatgaatccgtgtgtgccaggagttagcaaacggtcagcgcaacctatgagtgaccagatacacatgacgaaggtttttccttcttagcatcaggaaaatcaatatccgcttagataacaattttgaagaaccacaaactctactctgtaatggttcaactctaaggcctaagctttcacatattcacgaatgaattgctcaactgctgaaacattaccagtcagaccagcccctccgcgactgtcaccctgttctggcattgattgaagtaaaatgtttctccagggttcccaagcttcacttcatcagtggtgtcagcagatgatatgtcttttcttgattctcggagcttgtttctacaaagtaataaatcaagacttgttagaagccttgtggactacagatttacttcaattattgaacatgtttgtggcaagctcttatataggtggttcaagtatgttaccctatgtactccagatagtacttgtgtacacagtaaagttgcaacgttacttatagcaaaacacaccaaaatcttagtgattgattatagatgacatcacaagttgatgcactagttatgctagtatgatacgtcaaaaagaaaaccatacatttctttttccaattgcttcttgatgaattcttttgagtgagccgtaactttatctgttttgttgcagaatatcagaacatgaatcctcttcttcactacagttgcctttgtcagaatgtcatacaggtacctgtgataagggaataaatttgagacaataccaattgcaacaataaattgacacaacacacaatttaatacttgtcctggcatgaaagaaggtcctagtcatactcctaaattcaatccagtaagagatgtagactgtagttcaattttagctaaataaacaccactacactcatttttagtaataacatggattacgtcagcaaaattactctgcaacgacttgcatggtggacaagaaatcttgagcatcaacagcaaaaactatcccagctgcttgaggcaggacttcatcaagcttgggtttgagccctgcatgaccaggaacatcaacaacatgaacaggctttattttgcttttctgcagagaacaagaacagagatcaagccatctgttcaattgcactttagtcagcaaatacatgtttctacataaccagatagtcttcctttcgctgaaaatatttctctgtaatgagtcgtcttaccctctccagctctgaatgaagcacaaacgtatcattgttttgttccattgaaatcacagttccttgatgtgattatccatcccgaagctaagggaaaagcaaaattagcacagagacaaccagaagaatctttctctctattcactaccattccgcgtattcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcagatagtctcaaggcaaattaactcgaaagggcaaaaatgtgctctgtctgatgttgccatacaatatatatcacagacgaattcagatcggagcatattaagtcgaatcaaggaaacaagaaaagtcaacatagatgcccaatagactacaacataacaagcagaatgggtagttcattcggaatagtaatttactgaattacactggagttccaaattggtggccattaaatgtttagtcattattcatcaatttgacaaaattccatcttcccacttcaatccaccagaagttgaataggatgcctctcagggaataagaaacacaaacacaaaaatgccacacatagtcatacactgaaatagcatgattgaaatagaaatttacctggtagaaaagaatacttttgccaccaccaccgagcccagataggcagatagcacgaaactgcacacacaaaagcagccagacattgctcattaatttatgtgcttgtagcaccagcaaaataacatagcacaggtgcaactttagatttagaagttccacttgttggtgacggtgacttcaactatacccattgagaattttctgtgttcttaagccaggaatcaaatacgtgcaatgcagctgatcagataaattaaagtcaaactaggcagtacgagttactcaaacattatatcaacatgttcccgtgacaagggtgtaaaaagataaactcgggctacgaacagtcttcgcatcatatacataagcttaattgatcatagttgttaatataaatagctatagagctcagctacccaatcagatcaacagctagttcattcatggaattgcaggggagacaacttcagcaagtttttaactccggaaacctgatttgagttttgattacagggacagaagcacagcgtacaggatgcaacaccactatttacacccaaatttggcacctaggattaaaataggaaagattgccaaaatttggaagtctaccggtttccttcgagtgggccggtctgaccgccgtgtgttgggtggtcagaccgccagttgagggccggtcagaccggcggtgtgtggccggtataaccggcaggtccgagtccgactgtgtttcgtcgggtctcgaggtttccttgcttgggaaggcatgtttcgggtttcctttggtttctgtcccgagttggacgtggagaagggcttgtagagggcaagaccaacccctatataagggacatggccggtttttcatattgcttttagtgatctcttagtttgtccatctttgtcggtttgcgccgtaaaccgtctgccgccgttgcgagagtgcgacatctctttgtaggtttgtcctgaaaaccttccattttgcccacgagacgggtagttatttagaatcggctccgctagccagtttatttgtcaaaacccatctaggtctagctcttgctagatcgaggtggttggcgactctagggtcaccgcaaggcataaggtgctacgatcgtagttgtcaacttgtcaaaaaaagttgccaacacgatttttggcgactccattggggagatccgttcagcgtcaactcaactttgacttcgccatgacgaagcagtcatcatccaaggcagaggtggagccgaccaatgtgataccaatcacattggatgacttcgaaggggaagatcgcaagtccatggaggagtacattaaggagatcacacaggaggcgttgatgagggtgtgcactaggacttgtcaaggcgtgatcatcaagcccgggccacgtcctaagctcactcccgatttggtaagcaatgaagaggtaacacaatctatccaacaacaagttgcatctacaatagattcatccatgattatttttaaaagtaagttagatgcaactattgaaggtcgatttgatgagtttttaagaactaaattcggccctctcatggccaattttatgttaaaagataaagcctctaccagtgctagccaagctcctatagatcaaacaagtaatggaaccgatggagcggcgcagacagccggtccgaccgggcctgatggccggtcagaccgcaacttcgccgtcggtccgaccggccaaacggccggtccgaccaggtattatcctggcggtcagaccaggactcatgccggtctgaccgcacctctggacgtcggtcagaccgggccctggaccggtcagaccggcgcaattatttcgattcaggggatagatccaatgactaatgctagttatttgtatcatcttagaacatttgatcctcctgtatctactgctgcaattaatccccaagttcccccacatgttcctaatgcttataatgatgttgctaggggatttcctcccgatactaggcaaggccaatataatcatattgcgccacaaacacaacctattaggccaccaaatccaccaccaaatcaatataggcctgataatatggaggaaataattagtgggattattagggataaattcgggattgaagctaggaatcgtgctaaggtataccaaaagccatatcctgattattatgataatgtaccatttcctcgtggttatagagttcccgaatttaccaagtttagtggtgaagatagtaggcccacatgggagtatgtaggtcaatttttagcgcaatgtggtgaggctaatagtgatagttttaaattgcgcttgttttctttatctttgtccggtaccgcttttacatggtttacttctttaccggcaaattctattcatacttgggctcaattagaacaaagatttcatgattatttctatactggaaaaactgagcttaggttatgtgatttgacatcgattaagcaaaaatataatgagcctgtcattgattatattaagagatttagggatgttagaaaccgatgttatagcttgaatataactgatagagatttggcttgtcttgcttttaatggtttaattgctcctcttagagaaagattagatggccaacaatttcttgatgttagtcaacttatgcaaaaggctctggctcaggaaagccgggttaaggataataaaaaatttattagaccatatgagaaaaagcctaatgttaatttgattgattaccctgaggctagtgatagtgaagatgagggtgatcatgatatgtatgttgctgagtggtcatggactaacaaaaataagccctttctttgttctaatctaatgccaactcctcgtaaagatcggcaaagtgagattaaatatagttttgatgtggccaagtgtgataagattttttattatcttttacaagaaaaacaaattagattacctacaggccatatcataccatctcaagaagaattgaaatgtcgagcttattgtaaatggcatgattcccactctcattctactaatgattgcaatgtgtttcgacgacaggttcaatcggccatagatgaaggacgattgaagtttaccgatggttctaagatgaagcttgatcatgattcttttccagtgaatacaattaatttcaatgataagaaggtgttgatttggctggagcaagccgaatctactaagggaaaaggagtaatcattggtgaaccgaggccaaagatgatagtgccaaagaagccggaggttggtgtttggaaggaaaataagagtgaagcttcaacttttaaagctcctaggaagaccaaagtgacccttgatatgcttttggaaaagtatgaaaagcaaggtggtgagagagctcgcaacaaagggaaaagaccaagatcacctcctagggagcaatttggtcactcaccaagacggtcgcattcacctccataccatcattcacaagacatgtcatggggtccttatccaatgccgccgccgggttatccttatccttattacatgccatggggggcaacaccgccaatgttcaaccatgtgcctccaatgcaattcaaccaagggtggggaggactaaggaggccaatctatgagcgtttgtcttcgccaaacaatggccggttttatggtaggaaccgggccaatgaagagaagagggaaggaaagcgtattaaggtggaggcaaggacttcggaagtgattaccatcaaagtggggtctcatgatgtgccaataccttctggagatgaagttggagagtcttcaagcaacaaacccgaagccggtaccagcttatcgcagttggccggtctgaccgggccttctggccggtctgaccgcagccatacggccggtctgaccgggccatctggccggtctgaccgccgacccgacaatagtccgaccgacgcctcaggccggtctgaccgcccaccaaatgtcggtctgaccggcgcatctggccggtctgaccgatggtctacgtccggtctgaccaagctccagcgccagtttgacaggaggtttgcaaaggacaatgcgggggcttcatcgtcatcaagtaaactcaatagggggtactatttacctcctggaacagagccgaaacctaggtggatgcctaaggatttaacggctactcaaagaagaaggttgcaacttcttcgggcccaagaattgagagaaaagaaggccgaagaggaaagagatagaaagttcaatgagttgcgaccgccaccggtttggagacgtaaatccgtagagaaggaagaaccggttgttgtagagaagaaggaagaacaatcggttgataaagatgagtcatctccaaaagaagacatggatatcaacatggtatgtatgttgtctatggagttttgtgctatggataaagccgaggttgcttagttttctctaggtcctaaagatgcggtttttgagaagcccgatgaatcaaaccgtcatatgaagcctctctatctcaaaggtcatattgatgggaagccggtctctagaatgcttgtggatggaggtgcccccgtgaatttgatgccgtactcgttgttcaaaaagttggggcgtggagatgatgagttgaagaagaccaacatgattctcaatggcttcattggtgaaccaacggaggcgaagggtatcttttcagtggagcttaccgtgggaaacaagacgctaccaacagctttttcatcgtcgatgtgcaaggtaactacaatgtaattttagggcgttgttggatccatgccaattgttatgtgccttctaccttccattaatgtttaattcaatgggacggcaatgatgttgaaattg

SEQ ID NO: 68718 - DNA, 1399 bp, Oryza sativa
  unsure (1)..(1399): unsure at all n locations
acagttttagaatagactcagttagtccaaaagtctaatcattgctaaacgtgtaggattcgaattattcaaacaggaattatacaggttccagaaactgtaagtagaaattgtgactagacacacggaatgattggtaatgttagataaatgaaataaacatctgtatggacacaaccaaagtagaaccatcttgaagtatattgcaatcttagatgaagccaaatgttttccttaacaggcttgtccgtctttcctcatacattgttccattctagtatttaccatcccacatcgagtcaatcattcgctgaacaaaaccgaaaaggtcaaattcgaaatattttgaaagatcatcgtcagccgcaaaattgaataagttattttcctttcttttttctatactttttgtcccatgcagaccagcgatttgatgatgtctgtgagaattgtctgtttgaataagaccagaagtcacccgttcgtttatgaatcccgaaaagtgcttcatttatgagtcgacctgtcgaagcaatagagtacgagtataaggcctcaaatgaaaaacgtgtacatgtagcagatattaacagcttcataatagtgcattagaaaagtgacagagggcagagtttacttgcacgcaggctcttcaaactagaggaggcagcccccttaacctcccccattagaaaaattgtgccgatatgtgccctcatgtccagtagcgtatagggaaggtatagactagggggggggggttacttgaaatgcanaaaaacaagctcatcgaatgagagtgaggtgtcaaaaaggggcggatcatctttatttaaagggtccctccaccaatcacaatttgtcgttattcaccccacccccccccccccgaaactatgcccctgtgtatatgctcntgatatgtcatccataacgaactatctggaatagtttgataatgaagaagtttggaaaatgatataaaaacaggtattaaaattgaaattagacacttctctctatacaacttcaacttttggcctgtgaaaaaggtaacgaaatctaaagatactgataaagcaatatgtcttgattttattttctgtgtgctcgttttcgtttttgttacatttcaatatttttgtgtttgattgtttatttgtttttaagtgtatgtgtgtttgtttgtctctttaaatacgatgtatgcgtaagatctgtataatttcgtcatgacaaataatatatttgagaggaacctcactgaaagatgttcgaggcaactatcatgactatgggattgtaaacaaaacctcaatgaaatccattacggtggcatatgtttgttattttccacaccactgaattctgtccaatccaattaaaattggatgatacc

SEQ ID NO: 68719 - DNA, 1242 bp, Oryza sativa
tgtgaaaacaaaggctaagatgatgtttttatttagagcagtcaaccattagatgagaaataattaattgagatctcttccatccccttctcctgtcgtgcacgtgcatacttagaaagtaaccatcggattcaatgtattaggccccgtttggtaggactctaaactctagctcccagctactaactccaactccaactgaagtgggtacgaaagtgtttggctagagtagttagctccactccaccacgtctcttgtaggcatttcgtcgaacacctggttggcgtcgcactgccgccgccatcgccatcgctcagcccgcgcgtcaccgttggtggcagcccacgggccaccgctgctcgcccctgcgcccccgcccgcacgcctcccatgcaccgcctaccgccgctggagggccgccagcgaaccgccacagcctgtgcgccaccacggcacgcgcgcctgccgctgccgctgccgtccgcggctctcacgcatcgtgccacgccaccactgctcaccacaccgtgccaccactgcccaccgccgccagtcgccgccgacgccgacgccgacgccaccgcccgtcgctgctgtagggaggaagatggggaggagagagaattggaggagatgaggtgtgaaggggtactttagaggcatttttgtgtaaatacattaaaaaattaaagggtagagggtcttttggggtggagtagagctgtggagcagcaaaagcccacctccacccccgtagtacaaatttgtggagtagctctgccaactccactccaaaaaatagaaaatttataccgtttggcacagttccagctctagataagttggcgttaggagctagagctgtgctaggccttattcttaatcaacattctaatctatccttaccatatgagcatgacccgttataatgtaggggtatattacttatctattaaatggtaaattattaaagtcatctatactcgagcaaaaaaaagatcgtgtgctggtagcacagtgcacgttatgtgcacagcgccatagacctagcttgaagaatttcccaaaaagaaaaaaaaattcaagtgattgagtgctctaaataagcatacaacggaagaaacaagggaatttaaagaaaacaatgtgtaattcaagtgtagaaggatgatatgtcccgtacaatgggaatttcattggtatgtgggaaatttcatttacagcattgtatgcttatttct

SEQ ID NO: 68720 - DNA, 3062 bp, Oryza sativa
  unsure (1)..(3062): unsure at all n locations
ctaaattggttgtgcagagaaaggaaatttagatctgaacagcaaattctatttaacagatcgattcattcagtttcaccagaagacacactgacacacaggtaataccagctgggttaattaagaacgtcaatactagaaatggtttcacagttgatagtctctctacctctcttaatcctgctacagcctatgaccacacaagaattcctgttctgttgtttatgctacttaaaaaaggtaaaactctttacgaaagagagctcagttgcataattagcgcaaacaaactaccctatatcatcggcaacaccgacaatccaaaggggaaacctgtcgattatcgatctagcattctagccaccgctgaaggctagatggaaactcatcagtagctgttggccacggaagacaattttctcgttggccttctcccccgtgtttgtcagattcacggccaaaatgttatatgatatttcctatcagctctgtcaggtcttgacaacacatcgaggggcttcatccggcaccccaatttcaatcgaaccccaaatcctccgacggctaaatggcagactcgtgctcaacccaagaaacagcctaaaatcaactgggtagaaagcaaagaagcgcacatacacgacacaattcgcagcgcaaaaagaagacggatacctttgaaggcaccacggatgattgcagccggctgccaagaaacccgaatccgactcccaagacccaagaatgacccgggggcagcaatgcaggtttgcagggtgggacggggggctgctccgatcgcttcgttcgttccttccttctccactgctgttcttggtggaggggaggttggggcanggaaggaagaagtgcggggaggaaggcatgaaaattgggaggagaggagagggatggcggatttatggtgagacggacgcgaggtcatgtatgtggtccggcccttcgctggccaccaaacctttcactgcaacgggtggcctcaattatgccttttggccctttgcactgcattattgcttgcttgcttgtttgatttcgagggttttctctaagggccttttgagttcgtgaacaccaaattttttaacatgtaaaatcgaatatacggatacatatttaaatattaaatatagattaataacaaaaaaattatagatttcgcctaaaaactgcgaggccaatttattaagcctaattaatccgtcattagtaaatatttactgtagcattacattgtcaaatcatggcaatctacacacaatttatgtaattaatattttttatatttaatactctatgcatatgtctaaacattcgatatgacatggtgaaaaatttttatttaaaaactaatcaagacctgaattgcctttgcaaagtgtcagatggtatgtctgggaaaatctaagattctaagaatcaactgctccttccattttatataatatagacataactacatttatttaaagttgttcataatagaaggtgtgtataaatgcatgttattaactagcacatctttttcattaaaatattattatttaaatcatctaccatcaagatctctaattttattaggcgcatgtaatatatttattaaggtaatccaaactatgatggtttgggtggtcgtgtggaattgagggagtacttgataattaagatataataatacgggggagctgtgaaacccagcttcttagaagttagctcgttcatgtttcagattatgtatgtagagcgtctcagaatctcaatgaaagtacatattattttggagaagcctttttatttcgagagaagctgcagttgtcaaaaatttttctaaacaggcccagtgactctgactcgtagttaagggtgcattgtccactttttaaaattgtactccttcatatttcacgtgcacgctttcaaaattgttaaatgatgtgtttttgtaaatgttttctatagaagaattgcttgaaacaaatcatattaatttttttttcaagttttattgttgacataaaaattatgggtacttccactttaatatttgtttaatttgcctctaattattggtaaaattacttattttaaatacatatttttgttaatcacataaattttcttccatcgcctcttgcacgaaagcgaccgaggcattcacttgttgctcccatgatacgatcattacactaacacgatcattacactaacgcgtcaggtacatcattcatatcatacatgtgcatagtggaataattatccaaaaaaaaacatttgtgattattattggtcatactaggttgcttaaaaaaaatttcagttaaactttatccactgggtatattaccggtacaacgcacgggtattttactagttttttttcatataaaacagaaaagtctgaaaacgcgtggaccaattttggtaactggccgaactcccattagactttacgggcaaccggcccatcacgcttttttgcgtggccgtaatcgaaaagaattcgtccccctagttgtgtccccggggagaataaatttcctaatctaaattattccgccaaaaatccgccgcgattggccaccgctggctccatggcaagcggaagcggcgagggcaagggccgccgccaccaggacaatatcccaagcgtcgtcctgctcgagctctggggccacgtcgccgacgatgaccaccggcctgacgccaccaccgccactttcacgacgagcaccggcctgccaatctcggtgaccttgtgcgccgccaccccgccaagcctctcgcacctttccgtcgactgccctggtctggtggatctggatcccaatcccttagataagtttgtggcgcccacggtgatcagcacggatgccgacctcgtcctccttcgtgtccctgtcgatcgctttgccagatttgatcactgtttcagcgactaacttagtctacaaggtgcactctcactctgaaagcgcaaagctgcaccgtctcccgagcccacgtggccgtggctttgcagacgacaacattgccatactgag

SEQ ID NO: 68721 - DNA, 611 bp, Oryza sativa
cggatttaccccttaaagcatgttaagagggcaattcaaacaacatatttgccccagcccacaaaaatactcttcccctggttgtccctttcccccttggtgtgtccgccagtaaagccagtgagtactgtagtcagtgagtttgtcccaataaaccctgcatggcacggctgggatactatgacaagccacacgggggaatatcccacaaagatctcggtcactcatgggcgtgcaaacaagatcaagtccgtctcgtatttgttgatctttatccaggtatactgtactgggtactagtatgatttcactatgtgtgctttgcaatatggtgttctgagggagggagggagggagggagggagagagagagagagagagaaagagaaagagagagagagagagagagaggggggcgggggagaagggggaatgatagagttataaaaatagagagaaagaaacaaattggcagtgacggagagaaataaagagaaatgtagagaaagattgaaaagtagagatggagaacgggatagggatagaaatagagacagagattttaattaaagagagagagagagagagagagagagagagagagagagaga

SEQ ID NO: 68722 - DNA, 3008 bp, Oryza sativa
  unsure (1)..(3008): unsure at all n locations
cttcgtctacaggtgcactctcctttgaaaggcaaagttgcaccgtctccgaagccacgttgncctggctttgcagacgacaacattgccatattaagttgcggcacggacgacgacgactcntacgctgtggcgctcttcacccctgcatcatgtcaactcaggcttcacntgtgtcgctctaccccgatggaaagccaggnagttgaacctcccatcagttgacagtgaagaagcgctgaaggggaacggtgtgccccgtccntgactcagcactgagaaggatcttccatgccacacccaaggtgattacgcttggaggtgctaaaggtacagttggctgggttgatctctggcgaggcatctttctctgtgatgtgctcgacgagattgagagccccaagctccgcgatttgccgctgcccttgccctctacgggcaactggcctttgttcctcaatcgctgcccctactattgtcgtgacatcgtcgtcaaccagagcagagacactatcaagtacgtcgagatggaattcaccatcttgaactcatctcaagatccacgctcctcgtatcacgaatgggtggccagccaagaatttcgaagttcgcatctagacatcttggtcgatgatggtagcttgaagatcaacacatggaacatgcctatcccggtcactcatgggatgactggaagcctggatgctccgtcacttccaaccacttggacactgccctgcatagttacatgaggaaaatagactacaagaggaaaaatgccgccatatccgtggagagtcttcacacggcttaccctaccctgagcatcgctgatgatgatgatgttgtttacttgctatccaagcgcaccacaagtggaaactattctaatccctcgaggagatgtttcctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcaggctgcaggccgtgcatggttggaaaacaaagctcaggtgaattttgttgcaccgcactgtaacatttggagtagatgttggtttaccgaagcttgcttttgccaatatattggcagcaaatccacatccaataaatggtgagctcattcctagcaaaatgtagcacaatatgggtgtgaaaacacaatataaggatctaaggtcggatcataataatattccttggtttaggaattaggatggtctgtgtgaccaaactactgagattatattacaacttaccaaggtagtgtacttaatttaggagaatatgattgataatgaggatacaatgcaatggtagagtagtactcaaggatcactatgcactgttgtgagttagttgatgacaagccttggggcttcttgctgtagttgggaagcaaaatggagttgggagctgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaacagaagaaactggagctaatccttgactaaactgcagcgggaacaccactccacaggcattctcgacggcacggacgaagcctactcctcagagaaaccttcatctgacccgaactcgaactctggggttgggaaaaatagagcaagactgagtactacccactgtactcagcaagtcataccggaatagaggtatgatgcaaggaatcatcaaagaagagctaaagtggttcatttgcataaagcgagcatttataaacagagattgaaagatttaaacagttgtaaaaattaagcagtattaatcatccactgtccaacgctacaccacgttgcaacaggcccaaccaaccacctataccatccaaattcattagactaaactaatgtgattctaatcacggtgaatctggttgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattaccattagaactaacagtctaaacattaatatga

SEQ ID NO: 68723 - DNA, 1722 bp, Oryza sativa
tatccctttgcacgtctgcatcgttggtgtggcttgctgagtacggtggttgtactcagtcttgctattatgccccccccccttttttcagaagtgtagtgcttctgagctgaagatggagttagaggaccaaggctcagaccccagttgagttttgactgtggagtggagctgaaaccccgctaggatcgcctttttccgctgctgtcgttctgtttcggtgtgaggactaagtgcctcttccgtaagtattttacgctttatttacgtttggaactgtatattacttgtcgttttctgtaccctggctggtcctggacagagatttaatacgcaaaatagtctagaaatttgggttaaatttctgggcgtgacaaagtggtatcagagccaacttgactgtaggttgagccaaatggtcaaaccctaaggacaagttttctgaaaaaccctatttgcaaattgtctcctctcgcccttcgacatttctttatgaaacggtttttcaaaattctcctcccagtccctccaatcctcatagttgttaaacctggaggacaaaccgtcagcttcacgcctattcggaagtcaagtcaagcttcgtgcaaagagtgagaagatcagcccagagtcaagtgaagttttcccggagttttcctaaacccaatctttccctgaagagtagtatcgttagctgctagatcgtgtgttgtttgcttgtgtgtaggggtatggtttgcatcattggtggggatgcgaccatactaggttgtttgcttaagcaacttgaatcataaaatccattcacaacagatcaataggcaagtggtttagtacctcctctctagtaacccctcctatttccccatctctctattgcctgcagcagatggtccgcatgagggacaatttcatcggatcaagaccccgtcagtttcatggggcaactcagtgcaattctaatagtattccacgtcagcctcttgaaggtcagcctcaaccccaagtcatggctaatcaaactcagacagtggaagagttgttacaacagatgcgacgtcggtaccaaatatactagatgcaacagatgcaacgacaatgtcaggagtcacgtcaatgtcacccaccgcaggtgcgagatcagatgccagcccggaacccgaatcagagtcagagtcaggagttcccaatatcggcaccgaagacccctgtcaaaatgctgtccagattcccgaagataacgacagccaagtcaacgtcagaccaaaggaaagtaagtgctacctgttatgactgtggtgagcaaggtcattatgtaaggaactgtccatggaaggtgttcgccaggtcacctgaaaaagacgagaagcagtgcccagggagtaaccaagctccaagtcagtctaccgacaagaaggatggtactttgcagcccaactctggagcgaacaggacagtgatatggaagatggataatggcaggaccatgatcatcaccggttcagaatttactcctgaagacgcagcaaggatacccaagcgtcagagaggaagaaataccttccgaggagcgcgtcagctaacccgtcatctcataaagtacggtccgcccagacccgaagatgatgaatcaggagaacggttttctgctgatgacgatgacgacaacgatgatgataatgatgagaatgatgatgcgacccttgacagtttcagggaaag

SEQ ID NO: 68724 - DNA, 3000 bp, Oryza sativa
ctcttcctccaactccagctccagtggaagccaaccatggaagaagcaacgtcaccaaggatgttcataagtctctgcttgttcccgtttcagctgccaaagtgcataatcagaagcctgcaccctgggaccaagcaagtcgatcctgtcgcaactgtcgtaagccaggacattgtttcagtgattgccctcttccaagagcagcaaaggcagttcgtcgtgattcacaagttaccagcactgcccatgacaccaatcgacacctaaatgtgcaacctccgccccaacggattatcgtcaagggcaccgtcaaaggtcgcattgttccaccggcaatcgtttcaagcctacaacaccaacgccagcaaggtaagcaatgccaggagaataatagctcgctacagctacaaagaggcagtacactccttcgccagcacccgcggcaagcttcgtcagccccaggtcacccagcagttgtcagctctagcaatgcacctcgtattgctccaatccaaaggcccatcggcaaatcaccgctcggtaaccccgcgagcaagaagttcctacctgctgcagctgtcaagagagttgttactccaccatcgaagatcaacaagcagagcaacattcccggtgagacttcagccagtaggaattaaagaaacaagtcggttaggttcgaataatggaagcaatagcagtcctagccaagccccctacgtttcaagttcagcagcagtctacaagtgtttaaccttatagcacttctctctgtacatagatgtttatggcagttatgtaatgaaaagggaatattgaataaagtttgagtcagtcagtttctcttcttttatgattcatcttgagcatgcaaaagcaagttaaaatgtgaatctgtcggtgtcacaagaaaccaagagtttctcttctaactcatcgcaattctgttgaagctccaaaacctgtttgcgagcaaatagaggaatggttaactagcagattgaaaatggttagacgctcaacacccaacatgatgagatctctttaaaggcagtatcaatggtattcggatgaaaagagtgatggaatatttgaaagtgacatcatataaagaatcttgggaactcctctaaaccttggaagccgttagaggatggtaagcggaaatttacaccctagtggtgcgatcatggatcaattacatttttccttagttcaagacagccagtataagctccaggaatcatctcaatgtttctcagaagttgaaaaagaaattgttccatacctgggtcagaagtatacagagtcaagtccagaaatgtgtagttagcagggtatatggcatagaatcccttttaacgaatcatctttaccgaagataggaaagcgaagtggttatgatcaaaaagcagaaactctcggcagtatcaaagtcaatttccggcagtcgttcagattgtagtatttttgggaaaacaattgcagggcctatagtccgtaaacccaggaagagtcagcaaaggacgatcgacgaagtgtaatgtcatgtcaagagaaggacttttgagtttgatctgttaagtgatcagtgggtatgcaatctatttaggcatacgacaccgaagtcaggctagaagcgggacagttatgccagcagttcaattgttcccagtcaggcgaaatgtatgactactcctgtaaggggggtaggtcgcagagatgagttctggctcacctcgtcgctgtttcagttgaaggagccaattgcaaggtgtcatgcagaattacgccggtcctaggtcacttgatggaattctgagggacaccggtgaggccaggtcaacagcttagcttagagaagcaacagtgaggacagttgcggttcagacgaaagacaggtcaagcaggtttcctggaattacgtgtcactcgagtcagaacccgttcaagcggacgtaggatcaatgagttacaaaggtcagatgcaagcttcaggaacaacttcatcctcttcgagtcagcatggtgaattgtcaggttatcaaaattgctaacctcaacaattcagtccaagataagtaagttccttaagcatccacagccctgtctgggtcagttgaagtagaaccagtcagtccagtcttgcaaagcaaaggaacagaaaagttgaatcaatcagttcagtcgtgcaagtctggacaatcagtcaatcagtcagttcgagacagaaagggggcagtgcagtatgcggatccgtccgatcagtcaaaccgcccgccagctccagctttctttctagccatcccagaatctcgggacgagattcctgtaaggggggtagatttgtaacgccccgattttcgttcgggaataaaaatcaattaataatacattttctagaaattaaataaaagttaaaccaatttaatcaagtggaattatagaggaaatttgaaattttcctttaaaaatcattggccgggaatattttgtaatattctttgcgccctaatgtactctccggaattttccgtgaattttcggagctcgagaaatagttttaatagcacaaagatcattgcatcaattaaaataaaaagaaaaacaattaaaatcccccttcctctctttgggcctttttcggcccaagtcttcctaccctcccgcggcccgcgcgccccttttctctccctctcgggccggcctcctccctcggcccgctcggctctctctctccctcaagtctgctttacctccctcgcccgttttcccctctctctccccgacaggtgggacccgaggccccacctgtcatcttcttccccaacctcccgtcgccccaacggccgccatggccgccggtttcgccccacgacgccgcggttcccgcgcttcaccccgccccacgagcgcgtggaatcgatcccctccacctcctccactttttcccccactctccccgtgaaaatcggcgccgggttaacccctccaccaccc

SEQ ID NO: 68725 - DNA, 9816 bp, Oryza sativa
actgtcctgggaggcttacgcccgaacttgccgaccaattcttcgtggcgaatccctttggtgaatgcggcgatgataacgtcgtcggtgatgtcggagatcttgttacgttgttcggaaaatcgtcggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggtgagtgaacggaccgctcgtcgtgacccctgctcctgcgattggatcctgcgccggtgatgctgaggcttggatgacggtagtcatgagatcggaagtgggggactcggctgccggtcggcgtatggacgctttcggagttaactgggaccgaagccgcaatcatggtcttcgtctggttcaagatgttgacgacgtgatcagattgattgagctcgttttccttgagaagggtgtcgaggagggtgatcgcggcaaccgcattctgttgaggggtgcggaaaaccggtgtcccttcaacatcttgttggccgatgagatcacgcgctcggcgccctgcttccaaagctcgctgccgtcgatcctcagcctccttcgcggtccgctcacgctcctgctgctcacgccgtagccgttcttgttcttgtgcttgatgctcctcctccagtcggcgacgctcagtctcgcgacgtgcttcggtctcccgggcttggcgttgctcctccgtctcgtcatcggccatgaagacgccgaagtagagaggggtgtagttgtcatctaggcttccgtcgaagtcgtcgagatccgggtcgttgtagcgagagctaaactcgtcgtactccacgatgtcggtggggcgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatggagacgctgtcgtgatggagacggccgccaaatcgtcggggagcttcatcaggatcggtgggtaagccccatcatcttgatctggtgacgttggagaagatgcgatctcacccaagtggtttgaagccaactcgattgagatggtcttgaagtaactttcagccgcgtttgggagtccaaacgggactgaaatccggttctctcccgactggtctgacaccgagtcaaggagagagatcttgccgaagttgttggtgacgaagtcgaggctgccgaaccgaaacgtctgcccaggtgggaagacgaggtcgtcgatgccggagacggaacccattgcactgatcggcgaaaagcttgacgcaacccctacctggcgcgccaactgtcgaaactagatttcggcaataataaaagggggtggctatcaagctggagaagtgtatgggtttggagacaaaagatttatacaggttcaggccttcttattcaagaagtaataccctactcctgtccggggatgaatccgccgagtgtcttattgattgtataatttggagaaaatcaacctctgcccctagaggcacccggaccccccttatatatgggagggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagcccaaatatcatcgccgtgtagatatgggatatccataatctccacaatcacattagtcccggtttcaacaaactgggactaattcatctttagtcctggttcaaaagtccatctttagtctagtttcgttaccaaccgggacaaaaaaaattatatctttaatcccggttggtaaccgggattagatatctctctcccacgtcattggcatctctcactctctctccccctctctctctcttccttatctcggcatcggcaacaacgccttatcccctcctcctcctcctcctcccctcttcacgccttcttctcctcctcctccactcctcctccccctcccctctcgtctgatcccctcctccccttcccctctccctctcccatctccacggcgacaccctcccttgcgtcggatcgggcgggagaggagccggcgggagaggcgggcaacggcgcacgaggcggcggcctcccctctgccagatccggcgggaggggaggcgataggatgggagggtggccgggtggcagcccggtggaggaggcggcggcggcggccgggcggggccctcctcctcctcacccccgtctgctggctatgactgatttgtttttagattttattatagatttttttagatttgggaagattttgtggatgggccagtgatttgtggatgattttatagatgggcctataaattgtggatgatttgtggggatttggggtgacggcgtcggtgatttcggctcaaaatcaatagatgcaagcagcaaagaacaatagaaaaagaaagaaaaagaactttagtcccggttggtaacaccaatctggactaaagttggtagcaccaccaactgtgactaaagatgaatctttagtcccagttatttcaaccggtacttaaaaaatgctcatcggagtctcggtttgtaacctaggactaaaggcgttgtaaactagatctgaagatcacttctccagcggtggaagaacaaagaagagagaaaggtagagatcatcaaaatgaatactccactacttttagatcatcaactgttttatttccaaagattacccaaatataaacctttcatgatatataagaaagtacccaagatttttggcgtctgcgccaactaggaaagctgacatgattatccatgaactggagaaccgttagttcttcggcctaatttcgatcccctctacaataatttggcattggtgcgatccggttaagcccctaaactcaatagaaatgtctccattctcttcattgttctgttttaccactgatatctctgtactaatttcctgctccatccatccatcacttcttacacaaatgcctacatatttcagttctttcttctggttattgttggtttttacaaatgatgatccatcataatccatgttgaacaacagtgagcgcagatgtttctgcggcataagatggttgcattcatgactgcaaatgctggaggtggatgatgacccagatgctgttgcatcttgttctttgtagcctccattttgatcttctgtgtgcaagaattggacattgtacacaagataagctccgtaggatgtaccgtttgagagatgctttgtgttgaagataccatagatgtccaaccaacacaagtgggagaggatggccacctcagaaaacctagaaataaagaagggaaaataatggacatataatcgtcagaagggttgtctgctatttatgggagagaaaaatcaacaaggagtacatcccatgacaaaaaaaaagacatgtttacaatgttctgtggtagtagaaccaatctagattttctaatcaatatggaccatatctactgatagcagaattcataaatcaacacttaagatcatttctacggatgataatactcttagtattcaagaaggaaatgcatgatattttgtactccctccgtcccaaatataagcatttttagctattaatctggatgaccgtgcgtccagattcatagccaaaggtgttacattttgggacggagatagtagtaaatgatatttacataaagccagaattaaatttgaaaacatactgttgatttgtttttttcttataaatattcggaatgtaaatgttttggcggaaatataccgtcgacctcgcataaccgttgcgtaaaaatgatgtaggcgtaacgacacgggcgatctcgcacggcaaagatgcgagaccgcacggtcttgtgcgaggaaacagctgagaccgaacggtctcgcataaggaaccaacgagaccgaacttcttgtccaacggtgccgtctaattagtgattaattacctgatttatgatgataattaatcactaattaattaaccatatgaattggcatggcagtccgggatcgccgactggttcagcggggtctcgcggtatggctgcgcaagaccgctcggtctcgcgccgccacgtactgtccacgtcctcgttttcgcgaagcgatattgataatatatttctcccaaaataattacaccccgaacaatttaaataaaaaataggtaaacaatatatttctaaatttaattccgtaaagccttgcaaaaataacacatataatgtgggatttcttcattggttttgtgcaccaaccacaaacctggaatccggatggttttgtatccagacgagacctccgtagggatagccgctccatccaaaaccgagagctcttgctcgcatcatgtatttcttggcaccactacgcttctccaacgaaaagctctggtgcaatgagagcagggatatcagtgaactgaatgcccagtactgttagtgtgaaggcaaaactggtatgaactagtctattactcccttcattttatattataggtcatttgactttttttagtttaatcaaatttatagaaaatatatagtagtatttctaaaacaaagcaaacatattatcaaaatatattcaattctagatttaataaaattaatttaatattttagatgttgctaatttttttataaacttgatcaaatttaataaagtttgacttagaaacaaaagacaaacgacttataatatgaaatgtaggaagtatctatctatttatgtatttagttgtgctattcttcttatctatctatctatctatctatctatctatctatctatctatctatgtgctatcagtcagtgaaatgaattacgaaggtctagattaaaagaacagatcatatcaagaaaagtttccaaattccgtaattgtgttttatcaatagaaaacatatattaaggttcacaaaattaatctagaaaaaataattgtccacaagtatgtgttgaaaataaaaatattcaataattttttacgtacaattttgaatacagttttaaataaataacagttattaaataatagccttgacaaacttacccataactactatatgctatgaaaattttccttttaatcattacaatttacatagaatttcaataaaatccaaatggataaaaatagttttgtaatatattgtatccacctattaatatattttgacaaacctattaattccatatttacctgtcaacccctttatttttacttataattggtcagttaagatttggagcttcagagtttaaacatttcatagaacgagattaaggcactgtttagttcctctaaaatggcataagttttgctgtttttgagtactttttgtcaaaatggatctaaacactaatatcaaaagttagcaatttagcatttatcatttggaagtctagagtagcaaattttaccaaaaaatacgttgggagcattgctctatctgtctttactagtaaaatggtaaaactttaccatgcatctaagtcatctagacaccaactaacaaacttcaatgccaaatcttttgccaccaaaacttttaccaaaaaaatttaccacagcaaattgatcttaacaggccctacaaaagaggcaatagtagtacatagtacttcctccctctagttttggttccataaggctattcccaacccaagacactagatatagtttccataaacttcacataattaagaaactaatactagacactactcttccaaacatcactattccatacttaagtttaatgctacttatctcacatgatgtcttggatgttgtgtagaaactatgtcccatgcaagacgtggtttccttctctttcctcatttattcacttgtcacctcattttttatcctaggtggcagtttatttaatgctatgacaccattctagtcattggattggaaatggcctaatgttttgaacaatgacatagtttctaaaatatatatttaactatgtttttctattatattatatagaataaataaatacatttttatttttatatagtactactatatatattgctcaagtgcctttataaactaaatatttataaaattattgatagtcaaaattataaatgtttgaccaaaccgtgttcaaaacttcaataattatggaaccaaaggtaaaaaaaaagaattaacaaacaacgcagataaggaattaaatggcttttgattaccagcttgccgccgtcgagaaggacaggcaagtcgcagaggcggaggaacatctccttcttgctctccccctcgcggccccccggcttaccgtccagggcgtcgccgtcgccggcccactccggcgggaggaagctcccccacacgtcatccgagtcggccaccggccggagcgccgcggccgccgccgccagccggcacgcgtcgccgggcgacgtcagcgaggcaatgcacgcgatgcagtccatcggcaggtcgcacatgccgctgccgccgccgccgccgccgctcgacttcctctgcatgttggatatatgtatatatcgttctcacgtctgcccttctgctgttgttgaagctgcttggcggcgagaggtggaggatgaatggcaaaatgcgggcatatatatgcatataaatgcttgttctgtggtaatgaaaataacatggtgtcgcgaccatggcgacacgcagagctagtcacctgcgtcctgtagtttctgttttcattgtaggcgagggacgaacaagcgttcttgtgttaatcacataatgacgacatcgtgtataagagcgtacatagaaaggttgacccaaccggtcggtcggtgaagagaacaaatgatgactagctaatactccctccgtttcacaatgtaagtcattctagcatttcccacattcatgctaatgttaataaatttagacatatatatctatctagattcattaacatcaatacgaatgtaggaaatgctaaaataacttacattgtgaaacggagaaagtaactctatgttaggttatatacttatggtgtactcctttttatccgtgtcactgtgttttgcaacaaaattttatgtaaaagagaagtaatgttagtatgttgttgccattattttctttttatatatatttattactgacatgtcgattctttggtcccatgactttttttttctttagacatcctcaatgtttattgtaaactaggtagtaaggtagactcgtgccatgtggtaatagtaggatgaagaggcaccacaatatatatatgtgtaaagtagataataaggtgggacccatctgaaaaattcttcaaacatgagtcatgctacaattaaaaaatagatgggaccagacataaagtgctaatacatggtagtaagtttatatttgctagttgttaaccatctccacgatgtgatgcattctgtttattacccacaatttcaccacatgtaagctctctaaccccgtatgttactagctgatttgctcgtgcgttactactgaatttttagaaaataaacttttgcattcatttttaaatcctaaaactatctacctatcaagctatacttcaccatgagtttttgatgcttactgaattagctagagtagaggcatagagctatttctgtttgattaatcataggagaagcaaaaaagtttcaccaacattatagggtccatacaaaggtgaaacacgtgatggtgatagattcagtgtcaccactattaccaacatttaaaaatagtatagcaaatagtaggcagttggtgaggttgggggtggcgaaaccaccaccactcctctgtttcaaagaagtataaataataccccttatttaaatatatatatatagtgaattatggtttggatcaacttttgttactaaaatttcagcttcgaccattttttatccaactaggaaggtagcccgcgcagttgcgcgggcatcttatttaaactatcataatttttgttattaggattttgaatatcatgacttttgtctctcggtgaaagaatttgaaggttctttccaacacatgattgaaaaaaatatataagtcagaaacatgttagaaatgcatgtgtgaaacaacgaataaatgaattttggacagtaaacgaattttttacagagtacagcaataatatgaatgttaaaatttgttaacccacatagatgaaatcatcatctttcattgcataaataaactgcagttaaccaaacaacctttgcatcagcagcttgattttctcgatcccatgcgaaggaaaaaaacatgcgcatgcatcttatttctattttattaattttattgccattgagatataccgcaactttttggatatcagctaatcgttaggtgcaccgtgcatggatacctcgtaagcaatatgatttggggattagcagatagtggtagtgtggatatacctcataagttataattgatagtatacatattaagcgtttaagcgttttagtagctttctaaatagcttatcggattggctactcccttgtccaatatatctgtaaagttcatcccactaagtgcagctaatgctaattctctcttctctcatgaagccacatcatcttaattgtttttagcccttggatgattcatcaagggtgcaaattgcatttcttctccccaaaagccacaccatacaactcaaccatttataacttttcaataattgatcaaagtacaaaatatacaagcacatgaaagaaaatcatatagtaaataagatttttttttctacagctcatatctactattttatcacacaaatctcccgcagcaatgtgcggggtacccatctagtttatagtgagaacgtttcccggactactaaacatgtaatattttatctttttctcataatttctatgattttatctaatttattatagtatcatgtatgaatttaagagtgttcataagatgtttaatggactttaacttttctatgtttatttttgcatggtatcgataggatttgaatttttcatcagacttactataatgtattcgtgcaaatcaaaagatgcaatcaataggaatcccaatcgcatactttttttcctataatctaaaggagctttgaattttaattttaaatcccaactatacttttgagctgagtacaaactttttaacggtgtattgccttttggatttcacaaaaaaaaatgaaagagaggaacatcgga

SEQ ID NO: 68726 - DNA, 621 bp, Oryza sativa
tgcgggggaacggtccgcctgtatacaaacgcctattttcgcaagcagcccagtcacccgcctatgaaaatcctctggccggatctgggaggggaggggaggggagcagcgccgtgtgccgccaccgccgccccgcgcgttgtcgtcgccgaccccgcgtgtcgccgtggccgtccctgcgcctcgccatccccgcacgcgcgtcgccgtcgccgtggccatccccgccgaacgcccacggccgctaagggggagggagaggagagctgggggctgtgagggagaagagaggagataagacttagaaaaaaaaattgtgcgatttggcgcctatttatatgctacatcaattttggcaggcggaccctgcagatataaagggttcttttacagacgcactgcttaggtggtccgcttgcgaaaatagattttcgcaggtggacaaccatctcaccccacggttgttattttcgtaagcggtcatttagttccgagaggtctacccgccttcaaaaataaaatgccatcgtcgggaaaattggtcctagtagcgtaattttccctcactggatcaaagtaagtgcaccagaggctcacaacttgcattcaagaaggccactt

SEQ ID NO: 68727 - DNA, 5527 bp, Oryza sativa
ggcctatcagtcgatcggctatcggttgactaattgtagcacgagttccaatatagtatgtaagagagatgggtggattagatattaatgatgcagtatatatctataactaactattgtataagtggctattagattggctatatatgatatttcaattttgggagctagtagatggctatattattaaacttgctctaatctcacctcttcgtctgtctagatttttaccccagctagtgaaatgcctctaatttgttgtggaattaagaaaaaaatgggaaaaagtgttccatatcatcacaagtttccagttttagtttgatagcactgaaatttcgtgttgcactttaataccgttagagtttccaccgttactcttcctactactaccattaaaaaagcatcgtgaactttcgatggtataaaattaaacttgaaaactttcaatggtatggaacaaatttctaaaaaaatatatttatatgaaacatcagcatgttacaacgaataaatgtattttgaattttaaattttagaattaggtagaggtttttttatcttcttatatcttagtcataaaaaaactagagtaaattgcacccacggtacaacaacttggcaggtgggtgcgattcagtgcaagaacttgagaattaaacgtccgagtgtaacaacttgacaagtgggtgcggtttagtacaagaacttgacaatttagtattttggtgaatcaatttagctaagcatatgctaggtgaggtttttcacgatgtcaatatgccaatacacattaatcctatggatattaccttataatattgaatttaatctttaagaattatattgcacatacaatttacattcagttacctttaagaattttttgttttcttcaccttctcaaatatcaaccgaaatataataatttctacatccagtttaattgactttcagttattagctattagagttattagttattaggataaaaatataaatatgtttatacaaatccacgctagtatattgtcaagtacttaaaattttgaatttatataaaaaatgctccaaataattaagttgtcacaacttcttaatttattgtatcaaaatcgtacctaccttacaagttattgtatttatacgatcacttataaagttcttatactaaattgcaccttcttgccaagtggttgcactagaacgctcattttttaaattattataccaaattacacccacctaccaagttgttgcactgtgagtgcaatttactcaaaaaactataatagactcagttgaaactcgtctttgccggattgccaagccacagggctaggatatcaaattaatccataccttagcaaaataaaagatgacacggtgtcttttgttttattttaacttcattagaatatgttttatattcagtaacgccggctatttctaattcaggatacatactctatgtcccattttggttctgattaaggtgcagattcttgaggccataatagtataaccagcgatggattagaactgaacttgaaaaagttaaggtttagcccgtcaaggatattatatgggatgctcaagctatagaacaatacaggtaaaggttttcatatatcttatatgtagtgtcgtgtgtatgaaaagcgaaatcaaatttggattggagtcaaatttccatatggcacactctaaattattttgtttatatattttcatgcgacgtcgccaactctcttggtgggcgtccacccgtgcgacatcgccgtggctgaaccagaaggccaccaggcaatcggcatcagacccggtgatgatgtctgctcgacaaccttagccgcgtgtaagttttttaaggctatatgtttgtagtgactatctatatatatttgttgacaaacaaatttgtcagatgtaaatatgatataatattagcgtaattacatgtaattataatttgtgaaattgtatataactttccaaatttctgtgataacatgttatttccgcgaagcggttgtcgtggaaccgaatcccctcacccataagtgtgcaatgatttttttcccttctcaaaattttgaaacaaatccgatttaaaattatatgaaagttatattatagttacaatataattacagaattatgttgtatttacatttgacaacgacaaatgtgcaaaatcgcttttgtattttttttccgctatatccacacaaacttcacaccgtttctgcaatgctgatatactaaagttctctgcatattggccgtttctgcagagcaggcggtagattatattgcgctggatgaatggatccaacgctggtatactgcatagtgcatacatattcttctctaacattactatggcaacttgtactgatgtgctttgacctaacattacatttgacaacgataaatgtatagcaaaatcgcttttgtatttttttccgctatatccacacaaacttctctgcatattggccctttctgcagagcaggcggcagattatatttgcactgaatccaacgctgatatactgcatacatattcttctctaacattgctacggcaacttgtactgatgtgctttgaggtaacattattttccgacattttcattgcgggatataatgaacgaacaacatgcatattaagaagctaacaattatcagttataataacaatatgtaatcaaactgtttcacgatccagattaataagcattgatattcaaattaagcgtggtcttcctctataggatcgatcttgcaaattactgcgattttacctttcttttgtttcttgaatagagagactcgaagccaattttctttcatctctggttgtttccattctctaggtaggatattgcactgcacccttctcagagtataagtccaaagccctggatgcaataggagagacagtccacgatcgtacacggctcaaaacggtccaaccgtgtacgttcgatgcttccatctgcaaggctataccgttctaagtttccacagtatccgaagtagatggtatcagcagcgacaaatggtaaggtctccgccgacacggagatcgcgcgggacatgctgatgaacagggcgcgccagttgaaaccctttaccgggacgaggatcccggcatcgaaatccaccctccacgcctcgtacttcctgctgcgctttgttctgtagctaccatcgtcatgagcataatggtctggccaaagcatccgctgcaccagaatcagctccccgccattgtcgaccaagtgaagggtgctctgcagcgctcggctggaatggatcaatgaactctcaatcgccatccgcatctgcggcggcggtttccggcgatcatccgaagcgatatcgagctccattattcccctgtcggtggcgcggtagaagcgactgacgaatggcagagccgcgggggaggtgttgtacgtgctgttgttgttgtcgtctattaagttgcatgcaccagccagttgcacctagaagcctaagctgatagggaaaggcggacaattcactttatacactccaacactccccctcacgcgagaccccctcaagtctcaagcgtggaatattggagtgtgctgcaattattttatttaattgcgcgccagccaggatttgaactcgagacctctggctctgataccataaaagtgtgataggctcaacacgatagattggattatcacatatggtagagtacatataggcacatgccttccatatctagcaaccgatttatagaaacaatatcggagaagattaaggaaggatggcaagggataaacacaatctaacacccccgcagtcggaacgtcgtgggaacggacattcagactggaccgaaactccaagaagatggcactgggcaaccctttggtgaagatgtcggcaaactgtgacgtagtaggtacatgtagcactcgaacagatccggcagcgacgcgatcgcgaacgaaatgtagatcgatctccacatgcttagtacgctgatgttgcaccgggttagaagagagatagacagcactaacattgtcacagtaaaccaatgtggatcggctcggaggggtatggagctcatgaagaagctgtcgaagccaccaccgcgttggccacgacacgatattctgcctcggcactggagcgcgatacaataagctgacgtttggaggaccaggagaccaagttgtcgccaaggaacacagcataacccgaggtggatttcctggtgtccggacaacctgcccaatcagcatcagagtatgcactcaagtcaacagtggaggagcggcggatgtgaagaccataatcaaccgtgccatggacataacgcaagatgcgtttgagagcagcaagatgaggctcccgtggatcgtgcatgtgaagacagacctgctggacagcataagagatatctggcctggtgaaaatcaggtactggagggcgccagcaagactccgatagttcgtgggatcatgaactggggcaccatcagcggcagagagcttggcgttggtgtcaacaggggtagcacatggcttgcaatctgtcatgccagcacgctccagaaccttgaggcagtactggcgttgactgagatgaaggccagaggactgccgagaaacagagatgcccaagaaatgatgcaagctgccaagatccttcatcgagaactccgactggagagcacggatggtccatcgaagaagtgcatcagaggaggctgtcagaacaatgtcatcaacatagaggagcaaataaaccgtgtctgatcctcgatggtagatgaacaaagatgtatctgattttgcctcaacaaagctgagtgtaaggagaaagctggcaaaccggctggaccatgcccgtggggcctgcttgagaccatagagccgcataggccggcgggaggaaggcttgctgctgggccggcgcgggcgtggtggtgaaggctgtcccgacgaagttgggccgcacgccaaggaggcctagaccggcctggcccggccacatgtggattctccctgtccatgggttgtaggccgtgggccaggcctggttggcccgtggtgcagtctatgcgccagggctgccctgtgcgacgccgctgtgtgcttgtccgccgccgccacttgcgccgccgctgccattgctcccgccgccaccaccaccggagccatgaccacggcgtcggttgttgttgcgggagttgttgttggaggtgttggtggaggtcgccgagcgagcggtggtcgaggaagcagcgaggaaggccgtggcagtaacgggcggccggtggcctttcgtcagctcatcgaggagaagctgtgcgcgagccttggcgaacgtcgggaacaggacttgcagaggcaagagggacttgaggttgtcgaatttgtcgttgaggccgccgatgagggtgaggatgagagaccgatccttgacaggttcaccgacgtcggcgaggttgtcggcgaggacctt

SEQ ID NO: 68728 - DNA, 12565 bp, Oryza sativa
ccttcaactacaaacccatcaggttgatcaatataaatctcctcatccagctcttcaataaaaaaagctgtcttaacgtccatttgatgaaaaagaagtccatgtgagactgctagggaaagtagcacacgaattgtggtcaatctagcaacaggtgaatgtcaaagaaatcatcgccttctttctgagtataacccttagcaacaagccgagccttatgcttttcaatagtaccatcaggcctaagcttcttgttgaacacccacttgcaccccacaagtttacacccatagagtcgctctgtcacctctgaagtcccgttagcaataatggaatccatttcactacggacagccttctcacagtagtctgcatcaggagatgcatatgcttctgaaattgacttaggagtgtcatacacgaggtacacagtgaaatcatcgctaaaagacttagctgttctttatctcttactcctccgaggagcttcattgtcatcctcctcaatgacatgttcatgcatatgtttatttgttctgatggtgtggtgtgattgaacagggaattatttcagaggattggctagaagtactatgtgtatccttcattggaaaaaaaactctcaaagaagatagcgtcacaagactaattgtaccaacatgtatgtcaggtaccacagatttaactattaaaaatctataagcaatgctataatgagcatatcctagaaagacacagtccacagtcttatatttaagtttgtgattcttcgttactggtacattgactttcgccaagcaccccttgtgcgcaagtaagaaagtgatggttttctcccaatccatatcttatgattcgaggtcaacaatgtctcctcgcaccatgccttagatagtctcgcggtgtccaacatgacattcttcttttaagttcaaacatttttatcccattgtcacgcacatgcattttttctatttaatattaaatgacccatgcaacgctcaggttgacagccagaggaagtacctgcttacttcctccgtttcacaatatataagtcattctactatttctcacattcatatttatgttaatgaatctaaatagatatatatgtctagattcattaacatcaatataaatataggaaatggtagaatgacttacattgtgaaacgaagggaatacatcattagcaaaatattagacacactacttgacattgaagatagcctctaatttacctcaaaaaatagagaaaaagaaggtagtagctgctagataaggtgatgtacttccgagggacagagtcagcactaacattacttgagaaactacttctttgcaaaataggaaagcagtgatgcttgtccaaccgaagcaggtttcgggccttttaccttctttttcacatgaacaggagatctgccactcttctccatcactttatccgcatgaacttcatcatcctcgttcttcctcttcaatcttaaagcatcttgtttctgtgttgcttcgtcagtaaatataaggtcgtcattcttcatggttttagccttctcgacatcatgttccaaagtgataggttgatcattaaatatagaagcatcttgctcctcttccacttggtgctggtacgttttatccaattggttttctgctgattcatgccattctttgtttgcagctcgaaaggcttttgtttctgcgtgatcctgatctttcttctctgatttcactggtttcttcatgaagaatgtcgagattggcttttcactgggtctcatctgtacctgcattttgaagtggaacaaaactaatcattgcacatccttttgctttacagaaaacacaaaaagaggaaagctaagaaattactatccagtgaagtcgaattgataggcaccacgcaaggacatggcatcatcttatcaatgcagcgtcaacaacagaaaacaagaaaaagctactgcttaattgtatatacttcacatattgtactttttgatagctctcattttagaagtaagaaacctgtagatctttcattcttatcatttatgacatcatgagcattttatatttaacggaggtattcaaggtacatcactgaaccacatttacatgttatctgaatcactccatcaggtacaagcgtggatccaccatagaatcattgaggtggtcatgtggccctaatgactattgaaagtgcagttgaaaaaaaatgtaactttgtatattagcgacagattataacacatctgagagtatgctacagctgatgatcacacgactacccgccaaatacaacaattatgggtgtcatagaaagtcaaaatttctgtataatttactctcaccattcagtaaaactcaatttcttgaacttcacaaaaacaattatttgacagaacaaagcagagctttctacctgtttgatgcactcaggaccatcaaaagatattttgcctattgcagctgtgacgggataccaaacctgcagaagaaaatgtttaaaaaaaatcataattttgatttgatcattaccgagaatcttagccactgatctttgttctcttactctcctaggtttcaaatgggccagaggtcttaagagattttcaattcaggtcaaagtgaccatttgagtagcatgccatcctcacatatgactactgatttaacgatgcagaagctcaccacattcatcccaaacttgacaaagtcttggtccagaaaattggacacacaacttagcttccccccaggaaacttgttttgtggtttggcagcggctccaaatgacgcagtgtgaccgagtcctcaatgggagggcaaggcttaatcccttgccacctaagggcccttttatggaaatgcgaatagagaacagaggagaatgttaatggaagctcgctccttgattaacaaatgaatcttgccttccatcctcttttataggactttgtctgaacaaacttaataacctcaactgtcttgaacaaaccaaacctaaactgagagaaaactgatcctgaagcagcacaattcaatcgcagtgcaggtgacttgttcggttgcttcctgcgctcagtgtaggcgattccccacataagaacttgcaataactaattgttcctatggcatgtgcaacctacttaggaaatagtttggtatgtttgacctctggtcaaaatttgtctttgctacttcagccgtaatagtagacgctaactcatgcagggaagtagatcaatcagactgtcataaatacctcgacaactgctattctagctttttacatgtctcttgaatgaaagaacattcctctatgctttgcttcaatctcttctcggcaactttagtccaataatgaaaccaggaatcagcctccctctagtattggataccatgaaaataacaatatgcccccctcccaaaaaaaaaaaagaaaaagagattgtttcgtacaagcatcatggataaacttgcctacgtaggaagtcacacatcgttaggacccacccggataacttaatgcttcatgagctcggatgctacaaatattttctacaaagaccatggatgaaggcaaagaaacaagcaaaagaaactgagagtccaaaggaaaagtacaatgaagttctaatcctcgagctaagatgaagcaagacaatgcaagtctcgtgaaatttgctttatgttcatgcacatgtatagcatgatctaactttgattcataaaaaaatgaacattttgatcattacctaaatacagcaagctaaagaggctaaagctatcaaggaaatgttggagcaaagcatagagggatgttctctgatacgacaaaaagcaagagcagttgtccaacaataagaaaggtactcataagaatatgatagatatactaatcaaagttacaagaaattagcttttattggctgaagtggtcaaggaaagtccagagaatccctctgtgcaatgaattttttttattttttagacttatatttttattttttagacttatttttttaatttgattaaaagacaattccaaaaagtatttccaaatctagaccttttggccacaccagcccgcctagtgtggccaaataactttgtcacgccacgtgcagtttgcgtggccgcattgtttggccacgccagcctcttgccacgccaccatggctggcgtggccaaacaacgctggccaaaaggttcagttttcgaaaatactttttggaatggtctattaataaaattaaaaaataaaaaatttcctgtgcaaactcaagttgaaaattaagaggcacaagtggataaagttatgaaagaagtgacttcaacaaataatatctttaactccatctaggtaaagtactaatacatcctaacaaggttaagctagatcatcattatgatgattctattgatttgaagattgctcacaacttcacacagtgttgaaaccagagtaaattttgtagcagagacaaagtttgacatttggtgaatgctaccacatgtaccaaatcacaaaacatgacacataattggctatgttggtagctaaaaaggccaagtagcatttcggaaaacttccagattgggcatttgtcgatttttatggtcggcaatgtaatttgtaaggtgcacaagatcaaggagagatggtgatagatttatactggttcaggccctcgagtgaggtaaaaccctagtccatttagcatagattggatctatgttgaggtgtgtgcaaatcagcaatggtgtggctaatggcgcgtatcaaagaaagagtgtaaccctttagggttcctaccgccaccctttatatagagctagggcggcaggcggcgtgcatggtacggtatacctcataatcaaggtacctaccgtctaatgatatgggataggatagactttcttatctcttatccctttctatacattgatgataccgcttgggcctaggccacttggcttaccctacgcagtacggcccaaaggcctctcgtggggcaccagggtaccgtgccccccacaatatcccccgagtacttcgcttgatgtagagtctgaagatgacgacgtcgttcgacaggatcaaatccagctgagtactcaccccaaaattttggatatagattactttagttgggtccgagtggaattgcgaacggccgatttttccttcttgaaggatggaaactgaacttattttccaaaatcagagtcctttcatgggtcggcccgtcaagaatacctaatggcataagtacgcccgacgggagtgttgttgctcaactttccccaaatggcgttgcatcctcctcatctgctacgttctcgagtcagattgggcgagattttccaccgccccacttctctcgccgaagctctttgctttccgcggccctgatgtcgtagtcgatggcagaatctgtgccaatcccgaaccaggccaccgcctggacaccgtcgatgatagaggaagcagtaggagtcctcccccctgcaggagctcatcaactggagggaggctgtcgaagaggacttccaaaccccgaacacagacgagatcatggtcttcctccccttcttccggttcggcctcggtctgcctgccggcgattttctccgaggtctgcttcacttttatggcattaatattcatcacctcagtcccaattctatcctccaaatagccatcttcattcatctgtgtgaggcatactacgacatcccttcccactttgcgtttttccgttatctgtaccaactcaaaccgcaacccaacaagaggaatcctatggtagttggggaagtggcaactagacccggaccaacaggatctggaattttttgatctccccctcaggtccagcaacaaaggttggcgatcaagatggttttaatgctccaatccactgccaagcctacctctatttaccgatcatgctcccgttgttaaagattgctagtactccctccccgacggtggcgagatggatcaagtccgagggttgttgaagggaatcaaatatatgatcaacaacggcttaactggggtcgccgtggcctgcaactttgtcacatggtgaatccaaccattgaaaagccacgcttacccaacataggaatacattggtaagaccgatgagacccgggagaggcaacaaatcatccgcaagagcgaggtcgctaataggatgatttaagttcttcgaagctaggactccgatcaccacggagggatgtcctcatcccctcaaacatggcatggagcgcccaaaggtatgctttgctttagttgatctttggttcacatcttttgctcaaactggtgatagacaatgatcctttgcgttcttctcttttgcagggagttgaagtactcatctccaaccctcctctgcccaatgcccgaagcaagaggcgtgtcgacgatccactgccgagtggtcgcccaactaagcgcgctaccaccgatgagcctagggccagctcatccaagaagccatccggtggtcccaaggtccacgaccgccacacggatcccggaggcctccaagacctccggcaaggggaaggacgttttggtgacctctgatccaagttcccgaaagaagaacccgacgggcttagggggttcacccgggactcctcaagcgacgacgaggacggcgactaccgcctccagggctgctaaggcagaggatgcgactgcaaaggtagcctcccatggcccgaccaggaccccgaagattggggtccacaagacccgtcaatccaccaggtgagttatgattgtgatccttgtcatttctctgattgcggtggagatcgatatatattaatgctggttgatgttaggtgaatcgttgcagggtatcaacgcaggacaacccaggtaagcttgactcgacccagggcgcagacgacgcttctgaccaagccaaatcgaggtcggctcaaccggagactgggccaagagccgagcccagtgccactcaaacctagcttggggccggtcgggtggcgggagatgctgagacggcggcgggcaacttaggctggcccagcggtggcgtatcgacagacgctgcagctgactcggcccggccgagtggcggagatgcagcgggagaggaggtaggtggtggtaacgagtcgacgggcgccgcagctaactcgatccggccgagtaaaggagatgtggcaggagcggaggtaggcgctggtgacgggtcgatgagtgccgcagctgactcagcccaactgagtggtggaaatgcggcgggagctgagggaggcgctggtgacggggttagcggccagggcgatagtgccgccacacccggcacatcgactttctcctccgcccagcccacaaactccacccaatcgccgacctgggaaagaaccgaccggcagggaaggagaggccaccggggatgaagaggatgccgaggagatcccgcggtgtccacatgccttgccatggacaaattatgtctccccccttcagaccttctggttccagggaggaagggagaaggaagctctgaaggagggcttcgatgatgcagctgataaggcctatgccactgttgatgtgaaaacacggcggcctgggagatctgcttaactccagtgcaggtccaaggctagcctcgagtgtgtcaagggcgtgccagctgatttgatcctgcaatcagtaagaaagacaaaagcagaattagtcagccgatagccgatcgaccgaaaggccgatagcgtatcgttggtggtctcagccgatggagttagaccaaatcggctatggactgattatatcaaagaatattaaatcctaaatatgcctaatcggctgtaataatgtctatcatgtttaataaattgattcggagacaatattatgaaaagtaatcgatctgacagtatttagagcaagaaagataatatactagctaatactctagtacaaacctatataaacaggttgatctatataaacatgtcaaacaatgatcaagcatgatagtgcaaaaatctagccgatactgactaaaacttgatatgcttatataaaacaatctgtctatataagtggcgaatacacatgaaacgaataaagaagcatgcatattaggtaagatcggctgaaaccccaatactatccgtattatatctaattgcaagctactttgcatggttctaagcacgactagagatgatgcatctcaaagtatgaaaaggagcatacagtctatacaatcaagcaattaaacacttttcaagatggtagatgccttagctaatctaatctagcaagacaatttagccgaaatcagcataaaccctaaagcgagcagcagccgatagagctaaattgagaagctaagaatagattaactaagacatatgatagcaatgactcgcgatatcgagcttagcatgtcaaaagcgacatgttagccccgatagcgcgggccattgagacgggttacctcttgcaaataactcgctgaaaacgaagaaaaataaaaagggtggcaatgcgccgaagttgtattggattgtctctcgtattacaatgctagggggttcatatttatatcccgagtacaaacttagtccattatggacacgactcaaaaccttctaaagacaaaacacaaacaagaccatatacagcggtctcttgccaaatctctaacaaaccaacataactaacctaattaatagatacaattgccttgttcgagctccgtctctaattggcaatgacggttatttcaatttaggtccatgtcaagcccaagttacaccatatcggctaagtcaatcttctgtccggtttacagccgatacgatactcagccgatgtgtagtccgacttggagatcaactcgattccacaccaaatccgcttcgaccttctccaaatctgatgcaaaattctgttgttaacagccacaatcatgtacaagtccgggctgctcctccttcaaaagatgaaggttaggagctatgtcccttagcccccgacttcaggacaggtgagttgtcagtcatcatgacctaaattgtgcatcagcatgggtagccccccgccagcatggtgtgatgttgataaatggcgtgtcgtgctggcaatgtccttgtgtttgttttgaagccggctagcccccgactccatgctgggaagactataggcgtcgtaggggtggagttgactcgtgttcttgatgtgtgatgcaatacattgttgaacactcggaggccaagagcgacggcgaagttagcaaggccgaaaggcaacggagaagtcgtggccagtgatgaagcacgatgagtcgcggtcggaggatgtcgaccttgttggcggtgaagtccagatctccaaagcggaactcagttccagaagcgaaactgatcgcttggacaaatccaacgatactagggctgaactgttgaagttggccggagtcatcggcaatgaagtcgaaggcgctgaaggagaaaagggtggcggtggggaaagcggtgagattcgcaaaggtgactccataagatgccatctcctcctttaagaaaaacgatctagcgcacccctacctagcgcgccaactctcgatttttatgatcggcaatgtaatttatagtgtgcgcaagatcaaggagatggtgacacatatttatactggttcaggcccttgaataaggtaaaaccctagtccagttagcatagattggatttatgtcaaggtgtgcgcaaatcagcaatggtgtggctgatggcgcgtatcaaagaaagagtgtgtaaccctttagggttcctgctgccaccctttatatagagctagggtggcaagcggcgtgcatggtacagtatccctcataatccgggtaccaaccgcctaatcatgtgggataggatagactttcttatctctatccttttctatacattgaagatagccgcaagggcatgggccactcggcttaccctatgcacccggtaccatgcaccccacaacattcaccttatattattgaatttttaacataaacataactgtgctattagcataaccaaaagtagattatagtacatcattagattggaattttgacagaaaaatattgtttaaattttaacataaccataaatgagacactacagatagatattattataaggtaaagaaataaaatcacagtacaccatcaggtaagaatttggtaaaagaatatcgtttttttaaagagattgctaaaaaaggatagcatattcagtactaatagtaatagcaaactatatgggtctgttcaatcaacttgaaatctctaccaaatttaaggtgttggacgtccgtcatttattaatcaagttttaacacaaacatagtgtgccagtagcacgacaaaaatgggaacaaatgtttcggaatgtaaattacaccaggtaaaagatttagtaaaagtacatatctgtactattataaaaactgaacatgtttccactggaattttgatacgtcacctgtgtttgagttggttgtacgttgtcgtatccaattcaacgtgactctacaataactattatacaccctcttccaacccaacccctcccagcccaaccaaaccaactcacaccaatccaccaccctgtcccgcgtccccctctcctgatcagcgtctttttctctccattttcttgtttgtcctttccttttcttccaatcatcccgatcctctccctctcgttctaatcacctctcttttctcctcttttctgtttttctcctttttttcctcttccaaatttcgctcctcataaatatttttttccttttgaaattatcattgtttaaggtatgtatacagtaagtttgttactttgtaaatgcttttcatctacagtaaaacaaaaagactttcactaattgaataatcaaaattgaatctttttttttcgaacacgcatgagatgtgcatatcatttcattaagcaaagaataaatgttcggacttacaaaaacaaaaacacaaagaaacacacccacattcgcccccctcctagggcacaagagctattgccttggctaacagctcttggagcctagaagctcccgccatacaccatagtgtgccctcattagtgatggacagaatcacatccgccatgctaggagtaacaccattggaaacacaagcatttctgtgtttccagattgcccacgtgaccaagataataagagagttaagccctttcttctcgctcattcgcaacccttttactgcctttgacaaccaacacgaaaacttgcgtgtcatggttcggaagagtggagaaatagcccagacttcaaagaactagtgaccacacttgtctgttgaaaacacaagaaaccaaagtgtgttgcattgtctcatccgcttgatcacaaaaggggcaagcggctagatgaggcaagtcacgcttggcaagacaataagtcatccaacaatggttgtgtatccgtcagccacagaaaaaaaacctacatttaagaggtgcccaattcttccatatcattttccaaggagcaaacctgaccgtctgggataaagaaggtcccatgtgcggatttggaagtgtaaacccctgactttgagaacttccaatagtgctggtctgaaacgcctatttcaatctttggttgatgaggtatagcaaaatacccatacatcaacttacggcatagccacccgatcgatttgtaaggctatggaatggtgtatataaaggattcttcatgtgatgatgcatgaagcgagcgcgaccagattcaatgccattgttacgtttgtttttttttatttgctgttaaattggtatagtttttaaaattgtcttcacatgttgcatcgcacatgcatttttgctagtcattaaaaaaagttaaagacaatgttcagttagcaaataataacatccaaaaaggatatcagccatatcacggaaatcccaataaaatgatgaaagcatgaacttacaagatctgctccttcatagggtactgtaatttcttcgagtttcacagatgcaccgttcaaccaagtactaatggagtctttgtcacccaagattactggcattctatctgttaagtcacatgcagactcagaaggtgccaaatcaaatcaaaaggtagcaagtcataaaaacattgtgtgcaacagtataataagtactcgtatatcaagacctgatagacttggcaaaaacatttttcatacatccattaccagaaaaaggtataatctgttttctcaattaaattgaactacaaggacaacttatcatataaagtaaaatacagatgcatcagtactgttaaaggcaatattgtactatcatcaatgatatatactatcttttaattgaaaatcaactggctttctccttgcctgcctctaaataagatattgtaaagtgaaaattaataggaacagtgcattaacaagctaaacattacaaacttccagtaatgtcactagcta

SEQ ID NO: 68729 - DNA, 1367 bp, Oryza sativa
ctaggatctcagatatttccttgacatacaagtttagaatttaacccgagtccttttaaagatattctatctatacatggcaccccatacccagtcggactatacatgccgtgtaggtatggggtatccataaactccacagtagccccagagacctttacagccgacgaaacaatctcttctcgtagcacagaatgataatccgagtactccgacttcttctcccctgatctcccgagtaccaaaaatcaaagactgtgaaggtctaaaaatagaaaaaaccaggtgcatcgactagatgcacctaattaggtgtagcccccgactatgtgattagttaaaaaactaaacatatagtcaagatgcaaacaacatccaaccgagtggttttataaccgaatatcatacagcaaagaatatgcggcgttcaataaagcatccagccgaatgctttagctttaatatatcaaaaatggagatatgaagaggcctgagtgagaaacactctaaagatctataaatccacacatatgataagaatccgagtaaaaactcttaaaaagatccatcaaacgtggtataaatgtgataacataacaggtgatgagtctaaatagcctaggctatgactcacgccataatcaaaataagcatataacatgccgagtaaatgactgtattaaaaccagtcatctcaataaaacccaaacagcctttgcagcctaaaaaggtgtcacgcccggaaattcactagtaatttccgaacttatttgtgcataaaatcctcgtccaggaatcagccgaggtacacaaactgacaatttaatatacagattcatcaaattaactaaaacgataagtacttacttaagaggcacttagtcctcaccatgaagaaaactgcagcggaaaataaaatctagcgaagctccggctccactcccacaggcagctcaactggagtataagccaaacgtcttctccttctggatccttattcttcaactgaggttgattgattattgcaaggtgagcatatgacatactcagcaagccacacagcaaatatgcaagtgcacaaagataccaaaggatggcataatataggttcatttgcaaaagcagcatttagcaaaacttttaagagaagtaaaaacagtggagtgattaatcagaaattttaatcaacactgaacagcacacccatgctgcacaggcccaaccattctgaacaaccatacccggctgtacagatctaactccaacccaggagctaagcaaattattaccaggtattacatccataattattgtgagaggtgtgagactaatcacgaaaaacattgctcaacccggccataaccgcg

SEQ ID NO: 68730 - DNA, 31923 bp, Oryza sativa
cctcattccatctttccctctgaatgttgttttctctgtttagagtcctagatggactcttgggtaaagttcagaggatatttggacttctccttcctgcagagattacatttttttcgcggtaagaaatctaaataataagagaacagaaacaacatcattttccatgtagcattaagaggcttaacatcaacaccgtgaatgcagggcatgtaacactcagcttgccagagagaggaacccaaaaaaaaaagatgttctacaaatgcacgagtaaacataagaacgtagagccagctctaccttatagccatttcattgatagaaatgataagttacattgttacatgattgggaaagagtagaaaaaaagaagagaagaacagcaaaatggaatgtacaaaagtgtaagaaaaaaaatactatacattggcctcagatgattaaaggccgattttcactttgattttattactgaccggcacgagtaatttttaatttcggttttcagatcgattatcagatttccccggcacacagttttccaatgagggtatggattaaaataatacagattatgtacgatttaattaatctgatttcgattgacacagctaggatgctcaattatcacttccatttcggatgcccttgctctaggcaggagttcctcagcttctttcacgagggaaccaagagtctttaggctgctgctacagccagagataaccatgatgtcctcgatttccgacatgttcctcgcagccttcgacagtgatttaatcaagttctctgcttcttctacggtgtaacggcttccatgtctaacgattagtatgaatatctcagtgataagcttcaatgtgttcaatctgttcactatagtcaccttactcttcattgacagctttgtgaccatcgattggagctccgttaagatgctgaagccgttggctgccctgttaattgcatcgataagaggaggcaaatcttcagcatccattaagtttcgtgtcatcgtcacaatcagagataaaactgccgccagcatttgtctgtccacagattcggcacgaagtgttctcacaagcacctgcaacattatgtttatcttcagtatgacaagcgtaacgatccaacacaaagactaattatcaccctatatatgatgctgataaaaataaagcaagtgtttcttttcttgcctcaaacagactatacctctggactcttaacctttaaggcttccttgaggctctggatatattcatcatcatcagtgtgatgaacacacagctgctcgaggatttgcgcggcgcttattctgtattccttgggatatctgtcttgtacaagtatttttgtgagatcaccaacgacatcatctttcacttgtaagattaacttggcatttgctttgccatgggaacatagcgtcgcaagcttttcacctaccactgccaacccaaaaatgatgttggcctccttataaactttgtgagtgaagatgagtaacaatttctcaatgaaatattccctcgtcactatgttagaaagcgtgtgctcgtgcattcgtgtgtaaatgtccaatgcttgcataaacagggaactatcatggaacgatccgagcccacatccttggcaacctagaatcctctccatactagccatggcttccacgtctcctgagattttgcggcggagttccttgccagtctggccaggagcatccacaagccggagaatcacaaccatcgaagcatgcactgttctgaaccacgcactattagggtcatcgttgtggttgagcaggccagaccgcagaggcgccatgatcttggctagcaggccctccgtcttgttgatggatcgctgacagtcctcgtgtgcagcgagcttcatgaggatactcaggccctgcagcatcagttctcggtaatttacagggatgttgccatcacaatccttagggggaccttcgagcagagaagctatgcaatggatcccttgtggaaactgctccaggtggaggtcaccagcaaggtgcgccacgatccttgcagcgtgctccctcgcctcggcattgtatgccctcgtacaatcaagtgactgcagcagtgtgtgcaggccgccatcttggctgtaggatgccgataggaggagctgctttaccattgctttctgctcttcgacctcgacctcaacctcgagaaagaaattgtacttgtacattggcgtattcaggagggagtccaggatcctcaccccagagaggaagccatcaggggatccagacttggttaaaccgacggcatatgtgaccaggttccttcctttgacgaatgacgggtccttctcacacccgatcatcgtctcttgcatgtacgccatcactgactcgctcaaactagtaacaaagcgatatttgttaaccaccaaatccaccagccttttctgctcatagcacaatgtgaaccggtaacagaagagcacaccctggagcaaggcgatggagtagacgaacttcagcgcagatttcaggttggcgccgccattgttgacctcacccccgtagtcatgctgtatcagacgacacgcggatatggcagtggtgatgatcagcccaaacatgtagagcaccgctagagggcagatgatggtggcaaacacgaacaaatggagcagccatatgacaactactactaggttgttcaggtagtaggagcgtgaccgtgatcggccatagaaccagctaatggcacccctttccgtttccaatgtatccgtagctgagaaaaagcctaaaaacgacctccaagtatatcgtagcttttcgttcagaaagatgtcggagactctgtgggtaaatttcattgttccagttagatggtgagataagtaatcaagagctatataggctggtggtaaatctgtgcatttcacacttatcaggatatattacatagattttgaacctatctagcactaatatttttttttggaaaatacatatcaacagccatcggatacttacatttttcatatgtattcatatacaaaataaactttcaaatctctatccttgcaggggaaaaaaaccgatccattataattttgaagtttgaaatggattaatgtaagttttctattcattctggcctttgtgtgtcttcgacacaacagccctgatccattatactaaaaagttcaataataattcaaagttcaaaaaataattattaaaaatatgtatttggcttcaaaattacatgggcaatccatcctaaagtgttctcaccaatgtattaggataatgtcgaccccacgatggagtttggcacttggtgttgcacaaacgaccttgtcagcggtggaggaatttggagcttggcactgaggcactagtggagtttgaagatcagtgcactgcatggacgcactgagtaatggtggaatttcatgctcaggtaggacgatatatagaggtatgttttcctaattgaggaaatgaagctcttctcacaattgagagagattacaagataaagaatacaatcgtgtttggaataggccagattgtgcatatgctcatcgcggtattagtgtggccgtttttgtattggtcatagcctgaagtttgtaccaaaactaataaagttgacaaaaggtcaaaaagcacttacaccaaaagtgagacctttctaactcgcaatgaattcaattgttgaggtttgctagctctagaattcgactcaaaaaggagaattgtccaatactcgaatagttgttaagctattgagatttgctagctctagattttagctcctgatgtcctacatgccagtgactgaatggatatgcccacatgaactttcatcaggggatgtaaactacttgccagtgactgaatatttagaaagtggaactgtcttagcagaaaatatagctccaaaataaatgttttatgcgagcttaaaatataaaattaagatattgagcagtgcaaagagactaacccagcggtctggacaagggtaattattgtgagacaccaaaaatccttcttccccagtatggagacgaagccaccaagaaggataacagtggtccataaaacaagaagataacctagccccttgacggccatagacatgtgtcccatgaacagcgcgtagttgttgatggagctaacttcctcccactctgagtcatcaacgggctccattccactagtcattcttcccttgcagatgtgcagagtggaggtcaactgcaagtctgcaacgcaacaaagccaatatgtaagcccgcatgctcagaactctattcgttgtatactcgtacataataaagcctggagatgcacgccaagaatggaaaaaaaaactgatctacaagaagcatggtcattcttaacataaatatgtccatcctattaaatttaatcagttttgattagcatcaagcaaggtaggctgactttggttttgtcaaaatctgttcagttgattgtttgagaaagtcaaaggaaaaaaaatcatatggtgaggaagcaaaggcctcggctagctggctggagttagtgtaactaaagaagaacagcccagatcagtggatcacagatgttaccgtaattcgtaaacatataatctggttgtcagcataaataattgttggtgccttttcgggccaatacagattcacctaaatatttgttgcaaatttggcctagtgccaaattgtggtggtcaacaataatattccgttttctcaaatcgaatcccaatagatcaagttgacattatatatgtgtacgatgggaaagcaaataccatggcgtctgagctgaacagcagaatagtcaagctaactgttggggactttggaacagtcagtcacctgtttaaaacaagaaaaataaaattgattcgatagcatcaaaatttcacgatttcagttccatatagcacataaagtcagtgatttcagttcccttttccgaattggttgacttgcgttgaccggctcacaaatccaaacagcccatttcgctgcccaataaagcaaaaaaagattatccatctagggagcaacatgcgagagaactgcaataccttctcgtcggcgatgggcgaggagggacaaggcagccgggacgagggacggcggggtgaggctgatgctgccggagagccgcgagcccgcgacggacgaagctgatgcggggcgaggagcacgccggcggacggagatgaacgccggggacgatggccgccggcggtggggatcgactgataaaaggttgtgcagccaagggcagtatagtaaaaaccgagtcactcggctaggtcaacacaagtcaaccaaaacgggtaagcaagcagaatgactgatagggatatataccactaataaagtgaaatgcggagtttgtatgcaataaaactgaaattactacgaaatttcgacgatattataataccaatttcacctatgaaagcgattttgggtggaatttgccgtacgtgtatggcaactttggttaagtatgcgctccctctgtgatcaatctatctatacctctatactcgtattaattaggtactttctacgagcttttacgttaacatgaaagatccgaccattagattagattgatggtatactagggccgtagatttaaactgtaaacatggacttttttaagggaaactacggtgggtgtttaaggcaccagcctgaagttttattgaaatgaagaaacatttacaggagaggggttacaggggatgagagggggagaattaaattaagaattaattacaaagaggtataaggcccacttgcggagctattgtttgctcttaacatttttacatcgatgggaccaaatgtcaatgtcgctagcacaacgccggagaactaacttagcaggttcatcaagagaattgaagaccttgttgttgtgtcgtttccaaatattccacatgacggcaaggaggatagagcgccagactcgtggagtggcgggttgtctgggtggagggatgtcccagacaccttcaagctgcggcagggaggcgatctgttgttcgtccaggccaaaggtgtgccatattgttgccactccggtgcagcgtaggaagaggtgctccacatctttaacagaggagcaaaaaggacaacgtgcggatgctactaatccacatcgagcttgtctctcattggtgaagatgcgcctcttgtgtgtagtacaaaggaagatcttgcatttgacttgagcgtggttgtcccaaatgggcttagcgaaaaggtcatcctataaccctaagaagcttaagtcgtaggctgtttttgctgtgagggggcgatttgtggacaaggtgcgtctgttttttatctctgggtctagctttaggtggcataccagggcttggatattggccaattcgtgtatggccactgtcgacacagtcggggccggagatgaaggagcaattcaggagcggtctgttagaataattgggctaggcccaacttataatattaaatctcaaaggcccataatacatgttgaggataataataccacctctggatttaagcgagaaatatctcaacctaaatagggagttattagaggctccctgttgaccagttgaggtgggggtcggaatgccacacgcgcgcgcgcgcgccgggccgggccgtgggcgaggcgaggcgaggcgtggctggctggcggcgtgcgtgcgtgcgtcacgtcgctatccttttgcagccactaacccacgttcccacgattccctccgcaacagcgcgtccacgttctttctcctgatagataaggaggccgcgagtccgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgatatctgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgtttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacattccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcgctgacaacatagtggacgtgtacatgcacatgcgttctgggaaggacatgtgggatgcacttgaggccaagttcggagtttctgacgccggcagtgagctgtatgtcatggagcagttctatgactacaagatggttgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcagttgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgagacttttgttggaaaaggttatgacagcggaggcttgttccgcttttctttgaatgacatgtgtaataatcataacgctgtgaaccatattagcgagaatgatgagtctaatgtgtggcattcgcgactctgtcatgtgaatttcggttgtatgatgcgcttagctaacatgagtttaattccaaaattcactttggtcaaaggttccaagtgccatacttgtgttcaatcgaaacagcctcgtaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcacaaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactctggagtacccgacatgcatgctggtacaatttttgagtccagagatgctactttctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatatttatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttaggcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaatggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagtgatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggaaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccggtggttgaaaaaccagtgccagctatcctaatgaactgcgatatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagacccttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaggtggaagttcaacttaacagtctccaccaaaaccctggtatatcaaacaggcacagccttgagaacatttcttatgagccttgaaatttggtggggattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgccgggccgggccggggcgtgggcgtggcgtggcgtggctggctggcggcgggcgtgcgtgcgtgcgtcacgtcgctatccttttgcagccactaacccacgttcccacgattccctccgcaacagcgcgtccacgttctttctcctgatagataaggaggccgcgagtctgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtgcgccgccgccgacgccgacaggagctggatccggagctggtgcgccaggaggaggtgccgtgaacgactacaacaacggaggcaattctgcctcaccatccagtggagggccattctcggggtataatcttctccttctactgctgttagcgctatactgtgtgcgctatgttcttggttctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacggtctagggcgtccgtgatagagatgttgggggcgagttgcatgtgagaacaaggcaaggaacagttgaaagagggcgccgcctaaaatccaattatcaaaccagaaggaagtggaccgaccatctccaatgatggatttcgaaacactacggaagtgtgtaaggcccgcgacgatgtccttccagatgatcgtgtcaaggcgcaaaagatcgcctagatcacacgaggcagaccatccgtagtgatcgcgaaagcaatcgatccacggtgcagaatcaccctcgtgcattttgaggagaaatttttggagaagacatatgttctgtgtcttgagattttttatccagcaccacctttcgctttcggagagcaaactatgttacacgcaattttgcaattgccgctgtgacagttttcttcccccgtccagaagaaggcccttcagcgcttgtcaatagtggtaatcacttctttaggaggaaggatagcccccatcatgtatgatgggagggccgagagcaccgaattgatgagggcaagccgaccatcggaagacagaaggtgaccgcgccaaccggcaagtcgcttgtcaatcctagcgatgagaggttgacagtttgcaagacaaagcttggtaacaaacagagagagggaggcataaataaggttgggggaaggaagctatggagcaaccaagaatccccgccaactgaaacgccacgtcatgctgaacgttaatggggaggaaggtgcttttacccatgtcaattccttctttttaccatgcatcccccgttcgttttcccatgattttagatactttttttttgtccccgatcgaatcacagatcatttttcattactgcagttgcaaggatgtggcaaaaaatatcatctagaccagttggttgatttgtcacctacatttattcagatctaataagaatataagtcaacaagttggtttttaaattcgatgtgtatatatctttaagccgacgatatgtatttcagtaatgacctttacccggtgaagcttttttttcttaattggtatatacaggataatagtatgttttaaactctctatcaagaaagagcagctaagctggatgggctctccaatttatgttaatttaataattccctcgataacaagataaatgatctccagtcatttcttgaccattgttctactttacctatgactttataaaatcctgtagcaacgtgctgagtatcacccaataaacataagaaaacacaccatgcatgttctagtgagcatcttgatgctggtaggataactagcgagctaaataaagctaagggtcggatgcgacatgggtgctagcgaatagagcttttctgccttgttagggtgcgtttggaatcagctgttgcatgtccgagcagtatatgagcgcgtgattaattaagtattttcttttttttcaaaaatagataatataattttttaagcaactttcgtatataaactttttttaaaaaacacgccgtttagtagtttaaaaaacgtgcgcgcgaaatacaacggagagggattggaaacacaggattccaaacacagcctgaatcgtcattgatacaaggaaagatgggaggaggaacaagagggagaggagcaatagtttgggggatgatcccctccattaatttctcattctggatctgtgctacttcctccgtttcataatataagtcattctagcatttatctatctagattcattaatatcaatatgaatgtggaaaataccagaatgacttacattgtgaaacgggggagagtagctaggaatggataaataaataatgttatcccaaacagaaaaagttacgtacggccgggtatgtgcttcacgtgaaatgggaaatatatacaatcaatgacgactaatttggcagcaaacatgcatgcatgggccagttaattaattatgctaaatggatagtttgattcgatgagcagccggacgactgaggctttcttttgttgggaaaaaaattaggtttgattgtcacatcagatatacggatatacatttgaagtattaaacgtagtttaaaaacaaaataaattatagattctactaaaaaactgcgagataaatttattaagcctaattaattcgttattagcaaatgcttactgtagcaccacattgtcaaatcatggtgcaatttggtttaaaaattttgtctcgtaatttacacgtaatatgtgtaattggttttttcctacattaaatacttcatgcgtatgtctaaacatttgatgtgacagtgtgaaattttttttttaaatagggcctgagagcaaaacacatgctgcatgaatagtagtcgctcgctcgtgtatcatacttaaagaaagtttaactaggaaaaaaaaacctacttcatatataaaatcacaagaccttttatccaaaaattgaaactttcaactaaaagttcaaaaaaattatactcttggctcaaactttcaatataaaaacccaaaacttctaatccaaaaactgaaacttcccaaaaaaatcaaaaactttgtgctcatggctctcaatctttcgatacgaagttacagaatcatggtagggtagctagctaaataaagggacggatgcgatatgggtgctagcgaatagagcctttctaccttgctgaatcgtcattgataattaggggaggaggaacaagagggaaaggagcaatagtttggggatgatcccctccattgaataatttctcattctggatccgtgctagggatggatcaataatgttatcccaaacagaaacagctagtgttaggtacgggtatgtgcttcacgtgaaatgggaaatatatacaatcaacgatgactaatttggtagtaagcatacatgcatgggccaattaattaattatgctaaatggatatagtttgattcgatcagcagctgaacgactgatcgagagcaaaacacatgcataatgcataatgcattaatttatatatatgaatagtagtcgctcgctcgtgtatcacgcataaattatatatcaatgatcgatcacatgcaacaccggcaaattaaattgacccatcatcgatccatctagctagctatgcctatatatatacgccatatgcatgataaatacgcaagctaattaagctagctacatatatactctctcaaaagtttacattaattgctgatagctcatcatcagtttgatcgtgtccggaggtgtgaggtcgtcggcgagatgagctccggcggcgaggaggggaagacgtcgtggccggaggtggtggggctgcgggcggaggaggcgaagaaggtgatcctcaaggacatgcccgacgccgacatcgtcgtggttccggtggggacgccggtgaccatggacttccgccccaaccgcgtccgcatcttcgtcgacaccgtcgccggcacccccaccatcggctagagctagctactagcctcatctgcctgccttcagcatcctgcttatcttaattaaataatcacatgcacgcaagtgatatgtactgtgcatgtttcgatcgatccatcccccatctgaataatgttggttttaccctacgcacgtgttaatgtttttctcctacgaataaataaagagaccttcatttaatgcatggtagccaactactccctccgtttcacaatgtaagtcattctaacatttcccacattcatattcatattaatgaatctagacatatatatctatctagatttattaacatcaatacaaatgtgggaaatattagaatgacttacattgtgaaacagaggaagtacctagctaatctttaggaaacaactacaaatagaacgtcccattttattatttttctttaaaaaaatttggcggtgtttcgcctctcataaactaatgttgtagcatttagtgaaaaaatgttttagttcttaaaaagaagtagaacacaattggatagtcatatgaaacaatttgtttcaacatataaaacaaattttttaaaaccattcaaacatcaacaagatccaagtgaaaatcgaagagaatgaaacactataaaaatacccactaaaacacttcgatctaactaataaaacatctaaaccatttttgttcgctggcatcgtgtttcgcaagcaggcatgctaagacagccgctagcaaaaataccatttttgtaggcagcaaactaaagaggacaatagatgaaaacattttttgggataaaacagttgaaaatcgagatgtcgtcgtatagcggcagggcagggtcgacgatagcggtcggcctgcgagggtcaacggccgtggtccggaggaccaccgctgccggatctacctccttcaccgcccctcatcttcgccgctgatggaccctaagttcctctcgacactcaaggctgttgttggcccgatctttcggtgagttgtgataactacgatttgggagaaacgttaacgatccgactacaaccgtacgagacgttgtgttgcgccttagcgatcgatacacctctccgtgggttgttgatcttgctggtgcagatcaaccctaatcctgcagcaaatcgaagaaacaagcaagaccaagataaaagcaatctgatattgccaataggaatttaatacaaatgataagttggggttccgaatacaagcagacggacggtttagccgacacgcgcgctacaaggaagtagcaatagctaaactttcatctaaacaaaacctgactaaccctggaggggttactagctatttaagggatggaggaggtcagaagggcgtcctccctctgtttggggcacagccccccttgggccccacttgggccggggtcccagacgaagttacaggcccataggcccattacagacaatgcagccccttgtttcttcaattgcggctcactgagatggaatatcacaatgaggctggatccgttggaaagaggactctgagagctttccatcaagtactcacgggacgaaaacggagctcgaatggagatttggcggccgtttgaagtcagcaatgttgcaggtggccgaattggattccagcacttggaagacttgatcttgatatcttcttgttcatccatgatgtgaacaatgattgtatccatagtagccatgatcacatcagccgcagtcgaatctatcccctacactatcgccacccgtctccattgccactatggaggaggatatatgccaaggggaagccatagccgggaggaagtcgttgctgccagatccccaccatcgtcacctgccgccatcggattcgcgccaccgtgacccgctgtcgccggatccatgcccccgtgactcgtcgccgtcggatccatgcccccgtgactcgctgctgccagatctgcaccgtcacgacctgccgtcgccagatccggaccgagccaccccctcccctccaaccaaatctaggagggggaggggagagccaggccaccgcaactgctctgatccctacagtgcgaccgtctcgtcgtcgtggtcgcgtcctggacggaagcacaccgccgcctcccctccgctgctgccgacctccactacgtggctctccttgcctccgccaagcatggccaagtcgtgctgccgctgccgccgagcgccgccatcattgaccgccgccgctgcaccccttcgctgctactagctagagagagagagataaagaaagaaagaaagaaagaaagaaagagagaagggttggatctgaggggtcgaggaaaaaaagagggagcacgtgatgtttattccctcccacgatttttgcaagcgaggctcccaacaccccgccagtaaaaaatagtttttttttactggctgcatcttaagagcaccacttgcaaaaatacctctatttttgctggcggccctcttaacctggccaccaaggacgatccattttcgctgctggccattagcccccaacccttgttataattccactggtggttttcacgtatggccgccagagaaaaaaataagttgacgccatgaaaaatcaattttgtagtagtgagcgtgaggagcgggtggagagaaacggttgagagagaggaggggaatgcataatatggaaggtgggggtgcgagggctgggcagcgggtggagcgaggcgtggggcgcgggcgcccaatattcttgttcccatcgggcgcccgagtcaaagggttttcgtaatctttaccacatcgggagcagagaagttgtttttatcgaagtaaattgtttactccgataatggtggaagcaggatggcaggacgtgcggtggggtggggagcagggaagttgtttttatcaaagtaaatcgtttactctgataatggtgggagcaagatgatgggacgtggggtgaggtgggcttgggctgatgcatgcttggcgctcggaatactaggagcatgctgcgctcctagtagtatctctatataattcatagatttttcttttgttttgtaaggagtactccctccatttcatattataaattgttttaacttttttgggtttaaccaagtttatagaaatattagcaacatctataataccagattagttttattaaatgtagcattgtatgtattttgataatatgttgttttgtgttgaaaatattgctatatttttctacaaacttggtcatacttaaagcaagtttaactaggaaaaaataaacctacttcatatataaagtcacaagaccttttatccaaaaattgaaactttcaactaaaagttcaaaaaaattatactcttggctcaaactttcaatataaaatccaaaaactgaaacttcccaaaaaaaaatcaaaaactttgtgctcttggctctcaatctttcgatacgaagttacagaatttgagaaaactttcaactgaaactcctcacgagggtgtcaagtagggatgaaaacggtcggaaacaatcggaaaaaaggctcaaccattaccataaccatatttttctcagaaacaaaaacgatatcggaaatatcgaaaaaccagaaagggcagctacgctggatgggctctccaatttatcttaatttaataattccctcaataagaagaaaaattatcctcagtcaatttcttgaccattgttctacaattttacttataaccaaattttacttataaccaaatattacttatgactttatagtaataaaatcccgtaggctgcagcaacgtgctggatatcacccaacaaacataaaaaaaaaacatgccatgttctagtgagcatcttgatcgtggtaggatagctagctaaataaagggtcggatgcgatatggatgctagcgaatagagcttttctgaatcgtcattaatacaaggaaagagggaggaggaaccagaaggagaggagcaatagtttgggggatgatcccctccattaatttctcattctggatctttgctagggatggataaataatcttatcccaaacagaaaaggctagagtacgggtatgtgcttcacgtgaaatgggaaatatatatactatcaatgacgactaatttggcagcatacatgcgtgcatgggccagttaattaattatatatgctaaatggattgtttgcctcgatcagctgccggacgactgagagcaaaacataatgcatttatatactcgctcgtgtatcacgcataataatactatactactcctatgtatcaatgatcgatcacatgcaacaccgacaaattaaattacccaccatcgatccatctatctagctatgcctatatatatacgccatatgtatgacatatacgcaagctacatatacactctctccaaagtttacattcctgatatatagctcatcatcagttgatcgtgtccggaggtgtgagaggtcggcgatgagctccggcggcaagcaggacggtgcggcggcggcgggcgaggaggagcggaagacgtcgtggccggaggtggtggggctgccggtggaggaggcgaagaaggtgatcctcaaggacatgcccgacgccgacatcgtcgtgcttccggcggggtcgccggccggtgaccaaggacttccgccccaaccgcgtccgcatcttcgtcgacaccgtcgccggcacccccaccatcggctagcctgcctcatctgcctgccttcagcatcctgcttatcttaattaaataatgatcacatgcactcaagtgatatgtactgtgcatgttccgatcgatccatcctcatctgaatcatgttttacctacgtgttaatgttttttttcctacgaataaataaagagaccttcatttaatgcatggtagccaactacctagctaaaaacaactacaaatcgcacatcccattttattatttttctcttaaaaaaaatcggacggtgtttcgcctctcataaactaatgttgcagcatttagtgaaaaaaatatttcagttcttaaaaagaagtggaatacaatcggatagtcatatgaaacaatttgcttcaacatataaacaaatgatttaaaaagaagtggttataagaggctcagtagcaccataggtcgtggattcgactcctcatgggagcgaatttttcagaatttaatggctttgtgcagccctggattcaactccccatgggagcgaatttttcaagatttaacggctttgtgctttcagtggtaggtaacgtatccgtcgacagcgaggcgcctgtgatgactttgtccactccaggatgaatttgccggcccagtcttcaaaaatgctcatagggatagggtttgcgtgcgtgcgatcataggggtgattgtgcgtgcgttgtgagtgtctgttttgtaccatgtaattctaaaaaaaaaccatcaacaagatccaagtgaaaaccgaagagaaaaaatgaaacactaaaaaaaacccattaaaacacttcgatctaactaatgaaacatccaaaccatttttgttcactggcatcgagtttcgcaagcaggcgtgctaagacagccgctagcaaaaataccatttttgcaggtggcaaactaaagaggatagccaatgaaaacatgttttgggataaaaaaaatttgaaattcgagatgtcatcgtatgagggtagggtagggtcgacgacagcggtcggcctgcgaggatcaacggccgtggtccagaggaccaccgctgcctgatctacctccttcaccgcccctcatcttcgccgccgtggaggcggatccagtggtatcgaacaccaccccagtcagatctatcccctacactatcgccacccgtctcctttgccgctatggaggaggatatatgccaaggggaaaccatagccgagaggaagtcgttgccaccagatccatgccatcgtcacccgccgccatcggattcgcgccgccgcaacccactgtcgccggatccacgcccccgtgactcgtcgccgccggatccgtgcccccgtgacctgctgctgccgaatctgcaccctcacgacccacgatcgctagatccggaccgagccacccctgccctccagccaaatctaggagggaggggagagccgggccaccgtagcttctccctgcagcgcgaccgtctcgttgtcgcggccgcgtacgggacagaaccacaccaccgcctcccctccgctgccgccgacctccactacgtggctctccttgccgcccccaagcatggccaagtcatgtcgctgccgctgagcgccgccatcgttgaccgctgctcctgcaccacttcaccgctactagctatacagagagagaaatcgcgagagattcagagagagaaaaataaagaaagaaagaaagaaagaaagaaagagagaagggttggatctggggggttgagaaaaaaaagagggagcacgtgctgtttattctctcccactacttttgcaagcggagctcccaacaccccgccagtaaaaattgttttttttactggcagcatcttaagagcaccgcctgcaaaaatacctctatttttgtcggcggccctcttaacccggccgccaacgaagatccattttcgctgccgacccttgttaaaatttcgctggttgttttcacgtatggccgccagagaaaacaaataagttgatgccatgaaaaatcgattttgtagtagtgagcgtgaggaacgggtggagagaaatggttgagagagaggaggggaatggataagatggagggggtgcgagggtgtgggcggtgggtggagcgaggcgtggggcgcgggtgcccgatattctcgttcccatcgggcgcccgagtccaagggttttcgtaatctttacctattattaaaatttaagatgattatgtaggcacccaccttttcgtccgttgtgacattagtttactgatttttcgtaacctttacctattattaaaataatcttcctaggtggccatacgtgaaaatgatcttcacctggaaaaataaatgcaccccgtctaagaaaattgtattcataatagtgggtcctcccactgcagccaccaccgctgcccaatgcagttgcgtgccgcggcctgacagagccgacacctgctgcagtccacgtcaggagcagagaagttgtttttatcaaagtaaattgtttactccgataattgttggagcgggatggcaggacgtggggtggggtggggagcagggaagttgtttttatcaaagtaaatcgtttactctgataatggtgggagcgggatgacagaacatggattgaggtggacttgatgcatcaagagcgggatgacgggacatggattgaggtggacttgggctgatgcatgcttggcgctcggaatactaggagcacactgcgctcctagtagtatctctatataattcatagatttttcttttgttttgtaatgagtactccctccatttcatattataaattgttttgacttttttttgtttaaccaagtttatagaaatattagcaacatctataataccaaattagttttataaaatgtagcattggatatattttgatactatgtttttgtgttaaaaatattgctatattttactacaaacttggtcatacttaaagaaagtttaactaggaaaaaaataaacctacttcatatataaaatcacataccttttatccaaaaattgaaactttcaactaaaagatcaaaaaaaatattcttggctcaaactttcaatataatatcccaaaacttttaatccaaaaactgaaacttcccaaaaaaaaaaatcaaaaactttgtgctcatggctctcaatcttttgatacgaagttacaaaatttgggaaaacttccaaactcctcacgtgtcaagttgggatgaaaacggtcggaaacgatcataaaacaggctcaaccattaccataaccatatttttctcagaaacaaaaacgatatcggaaatatcgaaaaaccagaaagggcagctacgttggatgggctctccaatttatcttaatttaataattccctcaataacaagaaaaatgatctccagtcaatttcttgaccattgttctataattttacttataacaaaattttacttatgactttataaaatcccgcagctaggggtgaaaacggtcacggaaattcccaatcgaccgggcgctgtttctgtttaaggggtaccgtttccgaccataacgtttttggctattttaaaattttgttttttctaatttctttctgtgtcgtattaatgtcgatattgagtagtttaaatgataaatatgttcaattaccgaccgatcgagcatcgtttctgaagagatgctactgattccgactgttttcacccctacccgcagcaacttgctggataccacccaacaaacatataaaaaaaacacaccatgttctagtgagcatcttgatcgtggtaggatagctagctaaataaagggacggatgcgacaatgggtgctagcgaatagagcttttctgccttgctgaatcgtcattgatacaaggaaagatgggaggaggaacaagctagagggagaggagcaatagtttgggggatgatcccctccattaaataatttctcattctggatgtgtgctagggatggataaataatgttatcccaaacagaaaaagttacgtacggccgggtatgtgcttcacgtgaaatgggaaatatatgtacaatcaatgacgactaatttggcagcatgcatacgcgcatgggccagtttgattcgatcagcaaccggaccactgagagcaaaacacatgctgcatgcataatgcgtttatatactcgctcgtgtatcacgcatatcaatgatcgatcacatgcaacaccgacatattaaattgacccatgcatcgatcaatccatctctctagctatgcctataaatatacgccatattaagcaagctaattaagctagctacatatatatatatatatatatatatatatactctctccaaagtttacattgctgatatatagctcatcatcatcaatcgatcatggccggagttgtgaggtcggcggcgtgcagcggcggcgagggggagcggaagacgtcgtggccggaggtggtggggctgtcggcggaggaggcgaagaaggtgatcctcaaggacatgcccgacgccgacatcgtcgtgcttccggcggggtcgccggtgaccctcgacttccgctccaaccgcgtccgcatcttcgttgacaccgtcgccggcacccccaccatcggctagcctccctcatctgccttccttcagcgcccgggcccccggccatctttatcttaattaaataatgatcacatgcacgcaagtgatatgtactgtgtgcatgtttcgatcgatccatccccatctgaataatgttttaccgtcaatgtttttttcctatgaataaatatggaagaatcttctcccatcgaacgtccgacgtcccaaaaaaaaatcagacggtattccggtgaccaacgagtgaaacatcaaattatatatgactagtaatatacccgtgctaacgcaacggtgatatttagtagagtaaaatggacgggcggctcttaaacttgtagaggtgtatcatctaggtccctaaactcttaaaatgcatatccaagtatcagaacttgtcatagtatgttctctaggtcccaaatcgctacaaccttctggatcctacatgatactgatgtggcatgccatacgtgcatgacatggcataattttgactgacaaatgagacccatttaaaaaaaattctttttctttttttcttctttcttctcttttatttttcctttcttctcctttctctatgacccaagcagaagaaagaaaaaaaaaagaagaatgagaagaaaaccaaaaaaaagaaaaagaaaaagaaaagaagaaaaaaaagacccatcatgtccatgtggcatgccacattagtgccacataggatcttagaggggctgtgtcgatttgggacctagatgatacactttgataagttccgagacgtggatccattttaagagtttggggatctagataacataaccctacaagtgtaaggaccgtctatgtactttactctgtaatctccaaaagttaatattgtttttagtcaaaaagaagttaatattgttttaattataaagcatagaataaggctgctggatttattgaagaaatagcacctatagaacctttcaactgatatttgtaactattggttctatagaaatagcacctatagaacctttcaactatttgtataataataactttgggatttgaaggatcaaataacagtgacttcacagtcgaagtatgtgctgaaaaaggaaaaatagaaacgttgttgctaaatgaatagaaatgcccaatccccagctctcaaaaacaaatagaatgaaaaaaaaattgagaaaccgaggttaacttcaactgcttctctgtgtcagacttggcgagcgaaaccttcagccggtggcgagcgcacattactcttcactatgtgtaggtatcagctaaataccagaagcgtccgtattctattctaacaaaatacatatattatctaccctgcttatcccttgaaatgacaaattgaactgcagtctgaaaatgagacataattttatcaaaatactaatagtaattagagaagagtggcacttacattgtactcggaacaattctgcaagcctctctacatataaaagcatccggtcaaatatcaatggttgatatacatgcatgcatggttgctttttgcaaaacattcgatcaataaaggaaagggctctttatattttcttcggtacaacatctaacaaaaaataaaacacaacactaaatgctgtagcaattaccagtgtacatattctgtaaacatatacttatagtaatatgcctgtgctaatgcttcaaagccaatcagtaatgtaaattaaaagcataggatgagatggatttaagttagtatattgttgattccatagccgcatgcataaaataaaatcacaatttttatacatttctaactatctacaacacatataaattcgaccagctattaatttatcgtgttcaatacagtgtattacaaaaatatttttcctcacttttattcccagtgcagcctctcttctccactctacatatccatgatatgtacattttcttcagagaacaagtactacagtgttaatcagaaaaaaaaaggaccgtggaattgatatgcataacatcatttggaaaatgcttagtaataggacaaatctgcccgaaaaaaagattaccaatatttgactctggcatgccaacaacgagaagaaatgtttacataatcaattgatactttatttattacagttctaatccaaagcccaaaggtcaataatattagctcgtaggcagctacatatatcactacattcgtcatctgccctcttagccttgaagcctagtcattcattgatggaacatattaccaatctcacgaaccacatagtaaatattcagaaggtaccaagtagccaagcactgattattatcagtttgctgctctatgcaaaaagtaaaatataataaataataaataagaagaagaaagaaagaaaaaggagaatggaagttcaagaaatattaaataccaaggtgcatctttattttttacacatatgtacatgtaatggccaatcacattccagcattttttactgctgttacagcagaaggtgcattttgaaaaatcaagaaattatctggtttcgaattgcactgaacaacacgcaatgcacctgcatcaggtaaaattataacaccgtgtttagtccaaagaacattttaaaggaaatagcacttacatggcaatacctcagattgagggcaaattaccctgttgcaacaaccattagtaatccatcaatttcgtcccaaatcaatttccggagaggaagatatctgatgcattcagatccaattgataagccaaaaccataatgtcttgcttgcaattcctatcaggcaggatcagagaaatggacctgctcacgcgcatgagcttggaagtagatcagccagtggcctggttggtgtcgactcgggatcagcggcgtccgcgccgacggctgcaacgtcaggcggatggatgcctccacacttgcaggcttgcgtttccccaatcttcggaaggggaggagatcgcgttcgcgtgggggagggggaggaaatcacgcgcttgcgttgcggcgaggcgatctgcagccggccggctcagggagcaatagccaggcttggggagggggaggcgctactgcggccagggcgacgattgtgagggacatcggcgctgggagaggggcggattggcggattgcgggatggcgaccgtattctcgggcgtttgacgcgcgtgggaggtggagacgatcctgagcattggatttcacagaggtgatctgaaccgttgagtgatgaatgtaagagtgtaggagagaaagatgagtaaaatgagttggtgaattataaggtagatgaaataaaaaaaatcagcaactgacacatttaaaaattttaccattttcattttcgttccaatcgattaccattttcatatggcttggccggtagaaagtcggaaacgaacatcggtcagctaagaatttccgttaccgttttcatcccagtatcaagatttgacgaagaagttgtcgggtctccttaacgtcgctgaggagtgactagtgaggaagggctcgtaacgcctcgccgagtagagtagcgaggaagaagggaacccgggctcgcccaaatatcactgcgtgccattgggccgtgcttgggccggcacgaagcacgatgggccatgccgtgctagaccggcacggcccaagtccccacaattacctgagtgtgcccaacgctccagatttaatttcgcatgttgagccaatatgctttatggctaatctcaaacacaagcacttagctggtttttcacctatagtcttgattttgagattttatttattttcggctatgaagtaagaaaattatcaatgccttcagtgtccagactttcaggtgttgagaggctgaggtacaaatgagagcttctgggatgaaatatcaagcagtaaaacattatctcaagaaatgcaagcaccaaaaaagatcaaacgagtatcccttagcctcctcatttgtgggttgaacaccaatacggtgacaatttcataactgctgatcaagatatggctcatcagccaaatgaactctgcaactctgcacgagttcacctctgctgggagctatagtacaacagtgacaatcagtcatcggtcaactgcctgagataattttgaacgcattcatctgcataatgacttggaagttggagctttgctggtattgttctgaaccaattacagacatgccaggagatttgacaacagagagtaatcggtcaaacgcaaaaaagggaatgttgggtattacaaaaaaggggaatgtcagggtgtacagtcatgagaaggccgagctttggtataagctactttactctgctgatctgaactcatacataacccctcaaatcaagaacaagcactgcatccagttcttgcactgatctgggagcattactctacaagccatggtgtcagaacagattcccattcgcagagttcgccttctttgaaccatagagctacagacagaaaatgtgtaatgagtttatcatctgtttgtaaagaacaaaatagcaggtcacaataaagttaagtccaagctaacaaacatgcacgtctctaagcacatagtgctgctgaattattatttttaaaaaaaaaaaacatgatcctaatcactgtgtcaactacttcattcttcgtagtacttaaaactcatgattctatgcaccttatattgttataccatgactactgggaaaaggagtagaacttaccgatttcacgcttgccgttatcaggactgtcacttccatggacaacattcctggaaagcagagtccataagaaatttaatttctttgacagagatatatatgcagagatatccgctaaaatgtgaaagatgtggtagatataataatgttaaaacatgaaaggttgtttgattccaaccttcctgtttgaactgcaagatcgccccgtatggtccctggttcagcttgaaggggattagtagctcctattaacttgcgagctgatgcaacaacaccattcccctcccaagccttacagaacagaacaacaataaatttaattgaaaacagtttactgatcaaagtgcagagttacaaatatgtttggttctttacaaatatatataccatgcaaacaacagggccagaagttatgtactcgatcagaccgggaaagaaaggtttttccttcaaatccttgtagtgctcctgtgcacataagagagaattagcagctcgttgattaaacataatatactcctggtgattcccttcctatgtgaaaacaaagataatactgtatgctctgacggtgagcagaaaccaggtttaaccacaaatttcgatggcatttctacaaaattttctccagctgcttggatatttaatggatcacttttcgttggctgaatacaagaaaaagtgactcgaaagaactatctcagcagtcagcaaagaatgagtactttggatgatcaaggctgtcctgaaataacataccagacagacatgctatttatcatttattcgattgtgaaatttccattcacaacaataaaactgtgatctcctcaaataagtccattcaagtcttggcaaattgcccactaccaagaaaataaactgggcatgatattttgtcatgccacgcaaccatggtatattttgaaatggcaccattgctctccaacgatgattaaatggtgagtccccagatggtggaagaaaacactttacttttgaagaaaacggtggatattaagaggcaaacctgtgccaagtccttggggcactgaaaaagctttaagcccttcaacacaaagcctttcttctcgaaacgggaaataatctcgccaacctatatgaacgaatcgacaggagtgtttatctgagctgaaagaaactataatggaactacagtattcagtaatggaatatattacgtcaaaaaaaagtaatggaatctaaagttagaaaagtaagtaaaatgatataccaggcctcgctgaacaccatcaggcttgatcataatataggattgctcaacctacagaaaaaatagatttaatcttatggttgatcaggaagagatcacctaagtggagagttctcaacttctaactgaaataacagaatattgaggtaatcagaaatgtctgacatctattatataataaagtccattaaacttccta

SEQ ID NO: 68731 - DNA, 4709 bp, Oryza sativa
gccgccgccgctgccccagcccgcctgggatgccgccgccgcttcccccggctgtcctggacgccgccgtccgattccccctcctcgtctcacgccgcgcgccgccgtgcatcctccgccacgagagagactgagagagattaggaagagagatagaggaagagagatagagggggtatgatatgtgggtcccaccatttaaaaaaataaaatgctgactggactgcaacgtgtacgccacgtagaccaaaatcaccgcggattaggtcgaggggggtaattcgtccggtttgcatagttggaggtgaagaatatccggttttgtggtttaggggggtaattcagacgaccgcggatagttcggaggtaattcgtactttttcctttgtatggtgttgatacttcagggacgaattctgtgcgttactggaattggagacaaaaaattaaacaacttgcagagttgatagaacaaatatagacttcttcctaagatatttttttgttgttttgtcaatcagtcaactaaataagtacaggcctttcaaaccttggtttacacccaaaattcgtaaaaatgcggcccatatttgcaaatgaaaaataatttgtgataaaacttttatatatgtgttcttagcgatctaaaaacaaaggctgataaataaacttcgatgaaaaaaaacaaaaatcaactccaaatttaatgctgaaaacttaaattttagctgataagtataagtataagataagcgtaaaaataagaccgatggcatcgtcatgagttaaccacgcggatcatttagattctgttgtgccatggtgatgaattctgcattagtattacatgtattggaaaataacttcggtggggcctctttagttcaaccaatataaactagagtacatggctattaacttttgaatatggtgttggaccctttgtatttttttttcaaaacgttaatgtaaatatgcaaaatgtaagtcatcattaaaatacctttagagatgtgttacaagtcgcaccaaaataaatgatacttctatttttttaataagacaaactatcaaatgttatattcaaaagtcagtagctcaatttaaaggcggatatattgttatattgcacacgcttgatgcatgcttgtgtccaaattaattatgaacaaattgaaaaatatccttaattagaaccaaattccaatgtactagttgcttgtgccgtcacataactgtataccagcatgtgtcaacttaaatgtgtatccgcataggcatgacataaacaacgaaagagacctggtggcatgtgcttgtgggctgaggaaggagagtaactgctaaatgcagatttgtagggacccaacaaataaatcggaaagaaattttcatgcaagtaaagaagaaccgagatttgtacgcaagtaaatcatactggaacttccatccaaaattcataaaaatggtgtcatggtgagttaaagatgtggattatttaggttctgttgtggcatggcgatgaattttacattagtgttacttgtatgagaattgctttggtggtcgcctcctttatagtttaaatgatatacactctttttttttcagaaaaagtgtaaatatgaaaaaacttttgaatacgacatttgatcatttttcttttttcaaaaaaagtgtaaatatgaaaaaacattagcaatgattaaaatatttttaataataaagaaaggtcaaaaaataaataatacttacataatttatatttttgattaagatgaataatcgaatgttactttcaaaagcccataccgttgtttattgatggaggtagtacgatcttgcatattcttgatgtactagtttatgtaagatcaatgtgtgttttgattcttattctgtgatgaataattggcatctgtgattattggttttgatatttggagattattgtcgaagtggttttggagatgattgattttcaggtaatgaacagggttgctgttttgtcgggtccggtcagaccgggcaggtgttgctggtcagaccggcgctatgtgagtggtcagaccggccagcccgcggtctgaccggccgacgctgtgtcggttttggtttcgggttgtttctttggatatccgtgattgtttcatgtttatggcttctagatggatactatacgtatatgatactgttgtttgctaacaatgagtcaagttggggatagcttggtctcgaaatatggtttctttgtttattgcatgtgtagttgactcgatgcctcgggagagtatttgcagtgatggatcgggagtcggcttggtggtaagacgatgtccgtggtggtcagatatcatgcgggatacttaggttagagttgatgcacgtggttggtgaagattccatatggcatacgatggaggtattgtgtgcgtatgggatgcgaagtcgaatttggaaggagtccaaatttggtatgattggttatgtaaaatttgtttcttgcactaggaggtttcctatggggattaggacttctagaatgagtttggttcgtggctttaggctgtctatctcatgtataaatagagagggagcatgaggcttcccggtatcgctttgagaacaattgtgttgatagtttagttaggctttcgagtttagtcaagatttttgtaagaagtgctattggtgcactttgtaaacacagagagaagtaataaagttgtcatctactttgagagtttttcgatttgtgttttctcaggtgcggcggtccaaccggcgagttaccactggtcagaccgatggcatcggtccggtcagactggcgggcatacggcggtcagaccgcggcggcatcaggaggctgaggagactttggggcggtcggaccgggcaatctacatcggtcaaaccggcggcacaggcacggtcagaccgacgggactactccggtcagactgatctacatcgaaattgaggggaacttttatttccgctaaaagttttggtttttgagtacaccaaccatttaccccccccctcaggttggcttagttcctgtgtttcgatcctacaagtggtatcagagccacgtttgctcttcttgatctttaccgatcttgagtttttgccatggctcttaagtttgcaattaagcctgatgttttcgatggaacggattttccttattagtgtagtaagatgcaatcttatattcaacctgagtatcttgatatttggagaaaagtttctaatccttatgtgattcctgaacaaattaatactgctgttttaaaacttgaatttgaacaaaattgcaaagctcgcaatattcttttaagtgggatttctcgttcggattttgatcgtgtctctcatcttgaaactgctcatgagatttggaaagctttgaaaaactttcatcaaggaacaaataatattaaagaactttgtcgtgatcttttcaaaaaggagtacattaaatttgagatgaaacctggagaagctttggatgactatctttctaggtttaacaaaattttgagtgatcttagatctgttgattcttcttatgatgcaaattattcacaatctgaggtttctcgtcactttttgaatggtcttgatatgtctatttggtagatgaaagttacatcaattcaggagtctgttgatatgtctactttgactttggattcgctttacacaaaactcaaaactcatgagatgaatattcttgctcgtaaagttgattctaggtctagtgctttggtttcttcttcgacttctttgaatgttggtgcttcttcatcatcttcttctgtacttgctttatttaatgccatgtccgatgagcaactcgaacagtttgaggaggaggacttggctttgttatctaacaaagtttctcgagctattaacaaagtttctcgagctatgaacaatgtcaggaacagaaaaagaggaggtcctaatcgttgttttgagtgtggtgcacttgatcatcttcgttcacattgtcctaagcttgggagaggcaagaaggaagaaaatagtagagtaaaagaggttgaagtggacaagaagaagaacacgaaggagaagaagaagaattgcatgcagtggttaatccaagaactcatagcagcttttgatgaatcagaagatgaagacgagagcaaaggtaagcaagttgttgatctagcttttattgctcgtaatgcaagttctggtgttcatgaatctgacagtgatagtgaagaaaagcttagttatgatcaattagaacatgctgcttacaaatttgctaagaaacttcaaacatgttctactatgcttgatgagaaggatcacactattgagattctaaattctgaaattgatagattaaaatctttggttactaatgatgatgaatgtaaatcttgtgaagttttattttctgaaattaacgctttacgagatgtcaattctgttaattggttgaaattggaatctgagattgaaaagtctaaaaaattggagtcttcttttactcttggatttgctttgcatgctcgtgttgttgatgagttgattttgataaagaatgttttgagaaaatacaaagttgttttttgtgcaagttccttgtttaatacttcatgtgcaaatagggctttacaaaacaaagatgttttgatttctcaaaatttttctaagtg

SEQ ID NO: 68732 - DNA, 14981 bp, Oryza sativa
accatgaagccaattcaaaggcacccttatcacacatgtatcgaaatagtaaatatatgaataatctgagatcatggggggtagagagatctagttaaccacgaaaccctttttagagaaatcgaggcccgagtagtcaaaatagtaaaagtatggatggtttctcctggggaaatagcagataatattaatactcaaacaagtaaattatcattttaccgattggagcatcaaaagtctaaagtggcataatcaattaatccgaacatgtgataaactgacgtatgtgaacagcagaaagtgttttgaaatatgcatcaataattcagctcaataaaaaatgcattaataaaatggttccttaaaatgtagacaaaaggatagcagataagagttggtagtgtgagtgcatgctagacaatttatatactaaatctgtcaatatttgtagagcaaaacgtcgtattatttttacaatcaaaaagccaaacaccaaacatgtagttctgggacattgtacagtggaactcgtatctgaaagcttttccctatcataatgatatgcatattgtactattcagaatgcagttcttctatgtaattaataatgttaggcatttaatgcgcagcgcagcgcagcgcatggcataaattagatttaaaaaatgtgaaacacttgatgacagcactacttcaagttcagtacatgcctgcaaatgttcattatcacagttcatccatatttgcaattttgatcacaagacaacatgaacttgtcgcaccgcttatgataagacatgatctagatataaagcaggatgtggatataatatgtttacaactatgtgcagacagagcaggcacaaagcaaaactgagcaaccatgttagatctttacaaacatggcgttaaaccagtacaaaaatatatcatactacaacttgtttcatttacaatgtcatatatgcagataaaaccttttaggaagctaaataagaccaattagtaattacaaccacagatgttggaataaataagctgcagcattaacaggacaacatatcttttgcagcaactcccaagactactttaagaaaatgtgattacactgaaacacattcttagtaccataatcatggcttccaaagactagaaagttaattgacaaatgtgcatgctaaccttccgagtttgtccaagtgtcaaagagggcagcaaagacaagaggcctctgatcttggaaatgaatgtaatacggcatcttctttggcccatcctttttccattcgtagaaactgagctcatataaaatattaatgcatgattaatacaaaaatatggtcagcttattgtctctctaaatggacttttcaacaaagacattatgctacaaataagaacctaaatattttttatctaccaaattgtgctgcacaaggataaaacaacttgaatgtgatacactaacaactaattgagtcctagattgaattttgtctattttaaccagttcaactcagattggtcagggcaaaatcaagccccagtgtcacatgtgaggattaagaagggtagctggagtttttcctcggaaacgcaggactgtacttcatttcattaagaaaataaaccaaatacaaaaggagggatcaaaactgatccaccactaagaacacacctcacatactcatcacttaaaggtgatgcataaccacaaacgaaaaaggaaggactagccatccggggtaaacaacctacaaagaaacacatgtaggcacaggctactactatcattttccgctgtctttaaaagcaccaaaacgtttgttgtggcaccactgaaaacacagtcgttgccgtgcttccaaatcacccaagctgctaggataatcccgataactttgccaccaccatcctggaaaatgggctgccgacagttcaggtgcaggaccagccagccccaactttagagagtagtaaagtccaaacatggccagagaaaacacgagatacaaggatatggtgaacagtttcgccgctttgatcatataaagggcaggcagcaggatgtggtagaccctgattaaaagcaagttgatctgaagtccaacatctgctgttaatagccaaccaaatgaaaattttgcagcataaaggaacccaactagtccatattcgcttccatggagcaaacttgatggatcccaggaaataagcattgtaggttgacttgctagtgtaggagcaggaccctgtaagcttccaaatgtgttagtcctgaaccccctgctgcaagaccgccccctcaaccaagtcccaaatcaacagagaacttgaacagtgaagccaccttttatatttctcacccaccttttgttctccaatgcctgcaccacagtgcgctgcttacttgacctttgagtgattaattcaaaaagattgggggccagttcagctattgttcttcctggcagccatctatcatgccagagcatggtgttcccccttttaccaattatagttttcacagccactccaaacaaagagtgaacattgtgaggtacttgtataggaaaaccaaaacaagcccaaggtctagaagagtcaggtgtttgaagccacaaccacctcatgagtaaggcccatcccatcttttccagattatgaatgcaagtccccataagggagaggtcagcaaacgcaatcccaagaaacaaggaaattagcaccattagccctctcctgacccttccaaagaaaacctctgtaccttttgtcagtagccttgatcacccatttgggtagctgggttagggattgaagaaatagtagattagatgtgaacagcaagaatacagaagagggctttggagggagaataggagacaacatgaaggagagaggtaattttttaactctttgcttaatccccaatgatgatgccaatgccctactgatctaaccaactaatgagtaatgatatgatacaaaagctaactaggaataataatcaactaaactaacaaatgatatcagataatccaacgccttgctgctccagtgtttcattgggccaaaggacctactagcagcccgcatgtcgtatggccatgacacctaggactgtaggtgcttttcacataaccagtaatccaagtagaacagcttatttagcagtgttatacgtctttgatatgattctagctgtatacatataagaccaacaaatgtactcagagcaaaggcttttggagccaatctatgatgataattttgggagtcttgatatattcgcgagttgtctcatgctctcagtgaaggtgtataattgagtacttggtgattcacctttggccaaaggttttactagaatagatcacaagcaacaattagtggtttccctatagatttgctcaatcaaaataactagttatctcaattcctgagatgaaaaacaggtaacccccagattcggtacaatgtatttaacatgtcatgcaatctatgcccccatgatttatattcaataaatataattaagatacctcatagtttggaatgaggaaaatcaagcacatctaaacctacagtcctatgtcaaatcctacaattggcatgtcactcatcgattagcaccactatatgacagaaggatggagcgagacacggaaagcaagaagagcaggacagaagttatatcaaactactataaatccagatgtcaaattttacatccaggtgcaaatcattctgtagccttttagcctctatcaatgcaagcaaatattgagcaagtacatgcatactgtaccaacttcaaggggtaaatcagagcatgctcatgcaaaactttaacaaagcatatgatagttggaagttccaaataaaaggagacaactattttgtgcatacccttctactgccacaagacacctattatttgggataagtcgccgaaaggaagccttttcctttatagactctgaccgtgcattgaactgcacaataaaatatttcagtgattaaatcaatttaaagaagcacagtaatgggacataataaaatgtaaatcaagctctatagcaggcagtccaatgcataagcaatgtggagtaagacatcagttttagaggagtcaaataaagaaatgaataattttagctataaaatgaagcagctaagctagcgtacataggaacagattcccattctgatgtccatagaacatatttttaagagaacattccaaataaatgctagaatttgaaagatgatagacaaataagcacacagaaaaatcaagaatataaaatatatactaggatgacagcacaaatatttcatgttttggaaaaaaattgcaaagcattacactgtgttcaatactccctccgtcccaaaatatagtcgcttctagcgtttaaatgtggtcccatcatatagctacttctctacctactccatttcaaccaatcccagccatctcccatttaatttctccacctactccctcatctcaaccaatcacaaccatcccctgtttaatttcacctctctccttaatctctgtgaaaaactctagaagtgcttatattttgggatagatggagtagctttgagtgtactaacaacctgtcctttcaaatggggcattattaccataaatgtgacactgaaaaccaacatcacaattgcagaagccgtccaaattgcctaattggagtaaacgtagtaatcaaacaggaatcaactaacttggatggttaaaatttgcagctcccccctgccactcatcgccggcccgccacggtggcagggggacggcgccagagatgttggcgccgtcccgttggaccacggagctagcgactctggcgtcccaaaaaagaccatttctgggataagttttccaggggtctatttgcaaaataagtttttcaaaaggaccaagttgtgaaaaatccagagggcgagaaggggccacctgcaaaattaacacggcatacccctcgcccaccctatgccacatcacatagcccaccctaccatagggcgatttatatgccccgccctacgttgcggtgtggaggagtatatttttgcaaaaatttgaaatagtagtttgtttatgtaaatcattaaagaaataaatataaaaaaaatttccacgtccacgcgcctgttcatattctattttcttcccttgttgctcctgttactttccttatgcaatggtcctgacgccatctaacaagacaactataacccattgttagatgtagatcagtgctaagatctacaggatgttcccgaggtcgctttccttgctggccacgtcgtactatcctccaggttccagcctcttctccctatggcctttatccacaactggggaaacaatagctaggcaaggctttggcatccaatttcctgtattctccctaattattttgacaaataatttattacaaggacattcctgcatttgaaaaatattctcatgtgcgggattctgttccacaggcattgtgatggagccgaacggcggggcatgaacacaggacagagcgcgtgcaacaatggacagagcacgtgcagcaacgtctagaacacggaagactcagcattgtttaaagatgaagtttaaatgtgttacctttatcctcattcttagagataagttgttaggaagagtttgttacaagatttgttagattgggtcttatttaagcttgtaattcgttcattgtgatcaatgaagaagaattaatctaaaccctctccctctgtcgtttcttctgtcccacggtgtgcccttctgcctgtgcacttctttcttactttgttcaatcttaatgtcgccgtgcctcgctgccatggggactgcggcctagggcgccagtcaaccacaactacaacctccgatcactgtcagggcatgcagatatgttctgaattgttttattgtagttgatatatgactagattttattgttagggtttagagtaaatttatatacatatattctaccattttgatgctaaatactgcacaatacctatatttttttttagtttgactacatggctgtaaataataggtgaatttaattatggagaaaattcttaaaaaaaaagcagcagatagcaccaacaagattggggtttatcgttctacgaatatgaaggagcataaatatgaaaaagtaatgtactccttccattccattttaagcgtagccatgaatttctgtgtccaaatttaataatccgtcttatttaaaaatatttttaaaaaaataaaaatataagtcactcataaagtacaattcatgttttatcatctaatacaataaaaatactaatcataaaaaaattcaaataagacggacaatcaaagttggacacggaaactcatggttgcgcttaaaatgggacagatgggacagatggagtatgtatttacacataagtacatgtataccagaaaggaaatggcattctttatgtggagtggcttttcctagaggcttatcttcttcgaaactcaaacttttggtttttgaaaagaaacaagaaaaataaatgagaagctgataaaaaaatatggatcaaagaaaagctaatgcctccatctaccaaagcttaattggaagcctccatccattgccattgatgcggtcctgctggcaaggcaggagatgccaacaaggagtgagccaaagctcagttcaggcaacaatccaaagggagcaggaagcacacgctcagccgacagcggacaaggacgtagctgtctctggcagggcagccctaaaggcggcagatccagcagcagcttggtcgacttcaaatcaaaacattgcatgaataacaacgtgccttggatagtgcaaacaacttgacaagactgttggacttttaagacgtccacgccgctccaactagttaaccttagttgccaaatacctaattgtctaagcttgagttcatctcactttcttataagaaaatgacttttaagaaagatattgacaatttggaattgtagttgtacaaatcaaacatctcatcccacgttaaagaaatagagatggtgttaaatgataaacacccaaccaattagtcaaaacatagtcatcaaatgtggatcaatcggtctgttgtttgtggtttatctagctgttacataggcaatcaacccactacaataaactgtaatcagcaatcataacttctcaagactcaaaaaaagctattcaagggataagaacaagattgtatagaaagaacaaccagtccataccatcctgaaatgatcgggcttctcgttcttgccggtgaagctgggcacaagcccccacttcatgcactggattaccgacacctccccgtccatgtcccctccaccatcataccccgccggccgcgcccgaacggtgcccaccggcaggtatgtccctggcgacacattgtatgatggccgatacctgcatctcacaaccagaatctcatgattggcaaaatacagctgagcaggatgaccccatacctcaaaactcccttcctaccggtccatccggagcaacggcacagcgggtgcgtcacctcctccgcagccgcccccagtcccaccgcccgcgacagaggtcgtggtcgggaagccgaaagccctagcggcctgggacgggctaagggtgcagcgagccctgccgcacatctcgtactctgcccgggcacatgttaattaagattagctttgcatttgaaatgtaatggttgaaggaatggaatcgaacgatgattaccctgggcaaacctgagaagaacagtgtaaaatggtcagagcatcgcatcatcctgaacataatgccattttcttcccatccctatatacatcaagagcaagcaaattgttctcaattctaacaagaacactccaagtgagataattattcagtccggaaagattaattcagatgaacaactataacccagaagaactattgattctctatacaattttcagagaaccaatatgagatcattcttttttttttggcaacttggaagtgtaaagcataaacatgtacgcgggcagtcagatagtgtgaccagtgacctaaccaaagctgctactatcttttttcataaatcattgttatatagaaaatagtactgattggtaaagctcccactgtaattcaccaacacagagaaaaccggatgttttatggcttaatcaacactatgtcatgttggcaagccataataatgaataaaatgttagcacgtgcatgttactaacgttacgcagatgactgtatctcaatttcccctctgaaattaacatcacacgagatcaatcaatccatcaatccggggaggggtctcctaaacctgatttcaatctagagtataatctatcggctaatttactattgaacatctccaagaatcagtatctcacggttcttagaaaagatggaaaatttataatcagaacatgatttcttgcaggtcagtaacaagggagagaaaagtgttctttttttcgaatcaagatccaaacttccgctgtggaatagaaagcttacctcttttctctcatcaggatgtgaaggagcaaccgggcgcacggaggggaggccacgacgggcggcggcggcggcggcgacggcaatggtggtgcttgcgaagggcgtgacggagattagggcgcggggtggagcgagcgcgcaggtagtgagagagagagaggagggaggcggcggcgtcggggtgagtgcgagagaggatggagggaatagcgagcaagagagagagagaggagggcggcagaggcgtttgcgtctgcgtgaaggtatgggtgcggccgtgcggggaggcgagtctgagggaaacgtggaccgatctgagccattggatcggatgattctggaccatcagatttgatgaatgaggttcgtaggagtgtaaggtcccgttcttttctccaatataagagttggataaaaataaaaattaagattttcatgttacgcttttcaaactgctaaatggtgtgtttcgtgggaaaaagtcgctctaaaatatcatattaatctattttttaagcttgtaataattaaaactcaatcaatcatacgttaataccacctcgttttgcgtaaaaaatttaatcttcatctttatcttcaggagaaaagaacaccacctaattggtgaattatagggtagaagatagaagaataataatatgtacaaataagatgtaatttgattatgaaaactaaaataatttgatataattttgagcctaaaaataattaagattgcatatttttaagagagaagaaagaagagacaatttgtgatgtgaccatgtctactacagatacaaccatttctcacatcatggatgaacaagaagatatcaagatcaagtcctccaagtgctgaaatccgattcggccacctactacactgctgacttcaaacggccgccgaatctgcatacgacctccgttttcagcccatgagtacttgatggaaggctctcggaaccctctttccaacagatctagcctcgccgccaaattccatgtcgtttggccgcaatcacataaacaagatgttgcatcacctggcttgggaccccggcccaagtgggtcccatgtggggtgcaccctaaccaggtggagaacgacccttggcaccccttggtcatcctccctgtaggatcgaatcacaagaactaagccaaccaaacgggggtgaatggttggtatgcccaaaaaccgaaacttttagcggaaataaaagttaccctcaaattcgacggagatcggtctgatcgaagttgtcctgccggtctgaccacgcctgtgccgtcggtctgaccggtgtagatcgatcggtctgaccgccctgagatcgcctgccgcacctatcaatgttgccggtctaaccgccttgcgcccgccagtctgaccgccgcgatgctgccggtctgaccgccggtgagtcaccggttagaccgtcgaaacccggtgaaacacaaatcaaagaactctaaaagtgaatgacgactttattgattctctctgtgtttacaaaatgcaccaacagcactccttacaaaaatctcgactaaactcgaaaccctaactcaactatcaactcaattgctctcaaaagcaataccgggaagcctaacgctccccctctatttatacccgaggtaggcaggctaaagccacgaaccaaacacatactagaagtcctaaacaccttaggaaactctctagtacaagaaacaaactttacataaccactcataccaaatttggactcattccaaattcgactccgcatcccatacgcacacaatacctccatcgtataccacgtgcatcaactctagcctaagtatcccgcatgatctctgaccaccacggacgtcgtcttatccccaagccgactcacggtccatcaccgcaaatactctcccgaggcatcgagtcacctacacatgaaataaacaaagaaaccatattccgagaccaagctatctccaacttgactcattgttagtaaacaatagtattacatacgtatagtatccatctagaagccataatcatgaaacaatcacggatatccaaacaaacaacctaaaaccgaaaccaacacaaagtcggccggttagaccgcgggctacgctagtctgaccacgcatataccaccggtctgaccgacagcaccggcccggtctgaccggtccagacaaaaacagcagtacctgaaacacctgcaaatccaatcatctccaaaaccacttcgtaaataaattccaaatatcaaaaccaataatctccaatgccaattgttcatcacataataataataatcaaaaacacctttgattttacattcccacccctataattagttaggtaccccctcagggtttcttgggttgtttagatgaaagtttagccattgctacttccttgcagctcgcgtgtcggctagaccgtccgtctgcttgtattcgaaaccctaacttatcgtgtgtattcattcctatttgtaattcagatttattttatcttgttcttacttgtttcttcgatttgcttgccggaataaggttgatctgcaccggcaagatcaacaacccacgaagagttgcgtcgatcgcaaaggcgcaacacaacgtcttgtacggttgtagttgggtcgtcaacatttctcccaaatcgtagttatcattaactcaccaaaagatcaggccaaacaactgccttgagtgtcgattggaacccagggttcatcaatttggacaatagatctatcatccgaaggttagaaataattggagtgatgtggtttaatgagagaagaaagaaatagcattaactacaattagtggggatgagctatatgtgaggggagattaccgataaggaagaaatacagatatggaaagcgtccacacaaatcaattatatcctaatataactcttctggagattataggtaccacgtactcacgctgttgggctatccgattggttaaaggggtaactcatatagatagaatatgtataggataagattcaggtgttatattacttgtgtattaagcaatatcacgtagtcttagtcggctacaattgtaaagtagttatagagctttaaaccataagggataaagtctctacattgtaatcatgctttctttgactatataaggagggtaggggaccccttgtgggcagaatcacacccaagatcgtcatatcaataacacaatcggcggaatatttctccggacataagtagggtattacttctcattgagaaggcctgaacctgtataaatccttcgtcttataacccatccactttcctagcttgttcgctacccacttttagtattgccaaaatctagttttgacagttggcgtgccaggtagggaagcgtcaagtttctcgccaactagtgcgatgggatctacatcaggcatcgacgacttcgtcttccctccagggcagacgttccgtttcggcagcctcgacttcatcaccgacatcctcggcaagatttctcttcacgactcgggatcgaatcagttgggaagagatggcatctaccccgttcgacttaccgaacttggccaagatctaccccaagacttttctccgtgggacggcttcaaaccactcaggagagaccaccaagatctcatctccttcgtcaagttctgctcaagataagccgacgtatccaccaatcaccatgtggcttctggacgacctccccactgtattcggataaaggtagccttccccctaggtcgacccaatttggctttcggccaagatcgtatctagcttcagggaggtcggcgttatccttcaaccactcggatcttgctcatccatagaaattgctagctatttcagctcttccaccaacagctcccatgcgacactaagatcatcgactacgacgacttcaacgacgactacgacttcgataattttgccggctttgatgattattataacgacttcgatgatgactatgctctactctacttcggcgtctttatggccgaaacgagacggatggacagagggttggacaactcgtggacgaggaacgagcaagattggagcaggagcgccgggagcaagaatgactcagattggagcgagaacaccaggagcaagaccgactaagatcggcatgtgaacggcaagagcaagaacgctgcatgaaggaagacggagggccctggccgaatccagacgccgtgcccgacagctgattggccagacagtcattgatgacaccaacgtgttccttacccagcagcagaaatgtagttggagcaattactcttcttgataccatcatccccaataccctagatcatgtgacaccaacgctcgacaggatgaagaccatgatcgccgccacaattccgtacaacttgggagacagtcgacagcccaccgcttcgacgtatacaccttcgggaagccgactaccatctctcaggtaaagggattatcgtgagcccgaacgcagcaggaccaattctcgcatgcctcatgcgggcagggaacaccgggagcagttggttcactcaccagctgtcggacacagaggtcatcgtgcagatgcggagtaccagaactcctctcgagcacttgtcgatcttagggagaccttgaacgcacgccgcggagagagaaatgatcgaagacaccaacactctcatgcttttacaaacgacctatgtcgagtgaattggccggctggtttcaagctgactggtatcgagaagtatgacagtaagactgaccccgaatcatggctcaccatctacacactcgcaaatcgcgtagtaggaggagacagcaaagctattgtgaattatctgaccatagcgttagctgacttggccaggaactagctcaccgagttaccgtgaggcacaattggttcttggagcgagctccgcgaccacttcattgctaattttcaggggaccttcgaacaactaggaacccacttcgagctttacagcgtgattcaaaaacctgatgaacccttaagggattgcagtcggcatttttctgaaaagcgtaacaagatttctgatataaacgatgacaacatcgttgctgcattcaccaaaggagttcgcaatgagctactcattggcaagtttggacgcaagcctcctagaacgctcaataattgataccgactagagagcaccaataattaagtttttgaagcaacaagagttagtgtcaagcccagaaatttagtccaaatttccatactattttgtgtattaagtccctgtccaggaatcagctagggtacacaaaacgataagtaaatatatagatccaagcataaataaagcgtaaatacttacagaagagacacttagtcctcacactgaaaagacaacagcaacagcggaaaaagtgatcctagcggggcttcagctccactccacaggcaaaactcaactgaggtatgagccatggtcctctaacttcgtcttcagctcagaagcacttcacttctgaaaagagggaataatagcaaaactgagtacaaccaacgtactcagcaaaacacaccaatgaaacattcatgcaaggggagacaaggagaggtttgtggctatttgcttaaaggcagttgtaaacattttatagttgaaaacagtaaaacagttgattaattaaggcaagattaaatatgcactgaacaacgccacaccacattgaacatgcccgaccaaaccacctgaactataccagttcattaagtcaagttattaataaagtgggactaatcacggtaaagctggtcgatcgcccataaccgcgggcatgactattcgaatagttttactctagccagaggtgcacaactgtacccacaagatacaacccaccggcatgttaccgtgtccgaccgaacacgtcaccatgtcaagtgattatgacaagacccttcgcataactcccctaaccaatcgcaccacacctcaggtttcgcccccacccatagaacggtagtgggcagccccctctcatgacacggtgaatccggcagccaatcaaccggacaccccggccggccaaactccatcacgcccaccctagcctgggtacgtcagctagaggaaagttatactacaagcctagcagttgcccatacttgcttgtggtaagcgcggtaagtcttccaggggtttcccgcgaaccggtccttaattaccatgggtgcgactagcaaaaaccatgcactcacagcccaccattaagccatattttagttggattattacgaccaaagaaacatggctgaatgtctcgagcatgcagctcatcaagatactagagtaaataatgtgattatcccattaggtaacct

SEQ ID NO: 68733 - DNA, 987 bp, Oryza sativa
attgggacccttaagactgatgttattagagtgtgttaacagtgaaatttggtaagcctggagtagtcaacggcttagagtcagcatcggctttgaagtctgagattagccgatgagagttgtcaagtcgtcagttgtcggattcttgctatattcggttaaggaaattgatctactaaatgaagtttatccagaagagaccgagttcaaagagaatgcggcatggcaagttatctattaattaggaatagtttgtaagtttccttttatctttaggaaagtttctttcttgtcctacaaggactagtatctacccataggtataaatatgtacacccggggtcattgtaaactatcttcacgatcaatacaattcggcgcatcgccacccttttacttctacttttgtttttacgttccggcggaacttggcacccgacatggggctgcatcgtcttcgatctccggcgaagggatcagtccaatgttccgtcggcccaggcaattgtatcgtctacgtcggcatcgttcaaggctgcatcagtacattcgacctcttggattactctggtttggataatatatttgcctggctatttatcatatgtctatgttaatctagtcctagcatctcaatttagctctatcggatgtctctcactttagggtttctgccggtatcggctaaatcgccttgctagattagattagtttagacatctaccaccctgaaaactcagtcatcggcttgattgtctagatattatttttctttttatgcttagtgctgcatcagttaagtttgatctactaagtcgtgcttagaaccataatttctagcctgcttcttgattgccaataagggtttcatcggggttacaggcaatgagttatctggacgtttcattcggttacaaggatttgatgtacatataagttggatttagccgatcccaaaaaaggtttactggtttatctaatctcggg

SEQ ID NO: 68734 - DNA, 1477 bp, Oryza sativa
ttaacttacaagtgaagttaaatgtgggaaataaatttcctttaatataaagcatggatggatttaatttttattaaattctccatgattaagtcaactctttgaaattttctcggatttttcggagctcaattcctaaatgatacaaacaacagttcagtaattatttgatcattaatgatctaattatatttgttaagagtttttcttgtttaaaatccttaaattataaattgttgtttaaaaggaattattagaaatgattttaaaagcctagaagagaagatctaattttaatttgttaaatctcaatataaaattgggctagataaaattttgttaaatactttgcttaattctataattcctagatttttctaggatttatttgagctaaggaagtatttttaataaatggaattgcatttcatgaataatttaaattgaaaaaggtttttaaaagtctgttttggctttgggccgaaagccggcccaaaacctctctcttcctctctccctccccggcccagtcggcccagtcaacccgcgctccttccttttctctctcagtcgctgacaggcgggccccacctgtcagggtcgtcgttctcctcgcgccgccgccgccgcccgaaaccctagtttcgcgccgcagccgttcctttccaaatccggcgttcctttccgtttccggtgaaattgattgaggggaaacaatctttgggatctcctctaccttttctcctttggaaacatcggctaaatcggtttggaatgtgtttgattcgagttcgaatcggatcggtctctttccttcaaaccccgatctttccttctcgtcgccggccgccgtgggccttcgccgtcgcctccgagcccctttaaaaggttccccaagctcttctctacctgccgccaccctcgccttcgcctctcatcgtccgtagtgccctagcgccatgtagcttcgcgccgccgtcgccgccgtcgctccagccgtgcgccgccgccgttccggtcgtcgttgtcgctcgggaaggccaccgtcgggatcgccaagtcgtcgccgtcctcgtccgccgcttcgccatcgccgaagatcgccggagcaccatcgccgccgtcgacccgatctccgccgccgtttcaacctcgtcgccgtcgccgtccgttgctcctccgccgctcctttggtcaccggtgagttcgccgcgtcgccctctacccgttggtgctctccgttcgtgccgaagcgccgccgttcgccagcgagcgtgcgccgtccgagccgccgagccgccgccgccggtggtgacgtcatcgccgacgtcatcgtcgccctctcccgtgagccggtcgtggaccgatcgatttcggccgtccgttttggaaggatcgatttcggccggccggttccgtgaaccggtggtaagcacccggtttcactgcgaaaccctagccgctgacacaataaata

SEQ ID NO: 68735 - DNA, 3448 bp, Oryza sativa
gaagaagaagcatgtgtagtaagtgattagttatttttgtttttgacttatctagaaggcattctactcccgccgtttctaaatatttgataccgttaactttttagcacatgtttgactgttcgtcttattcaaaaaaacttctgtgaaatatgtaaaactaagtatatttaacaatgaatcaaatgatagaaaaataattaataattatttaaatttttttgaataagatgaacggttaaacatatttaaaaaagtcagcgtcaaatatttagaaacggagggagtactatctaagaagtataacaggcaaacatgtataatctgaaagcttatggcctctgcaaagttcagaacgttaatttgtttgtaggtgattttgatactgaaatgagtatttgttctgaaaatttcttttccacagtttacatctgttcgatgatattctgctatccacttcttcttccttaattaatgtgttccttttctttcaaaaatcacatgcatgtaaatattttgtttgttgctttctccttctctctaatataatggcagaaaaacctacctttggttaaaaaaaggagtcctcaatgaggaaacaattaatagccagggaattggatgaactcaaaagcagacaaaacctttttttaataaagaaatttatttcggcattttctttgaagaaattaactatagtcaactattaccataacgaagtttgtagttcaaactactgcatattaaaaaacgcagtttgatagaaaacaagacaactatatagaacacctgcctaaaaacagatgtgttagtctattgttaaaacttcatttgcagttagcgaaaatctacataatcgacaaagtcaaaaccagtagagaggatacatagtcacccatgttctgaattcaaattcaaagtcacaaatagactcatcaaattccatgaccaatcatccatccgaatacatctcgctcacatcacagctgacgattacaatctaaccaaagcgaaagataagtttagaaccaaatgaactacaatcagagcctacgttttcattagggatggagaactggacactgtcgccaacggagaagaacaaaaccttataagtagaaggaacaaattcattatcaacattctttagaaaactttttaaattatcttttcaactttccaaatacttaatttatttgttcgtgcctccaaataattatcacaaactttagttttatgaaccatccatcattcattgattgaacgcaccgggacttgagattaggattaaactagtcaaaagctcgcgcgttgcagtgaaaatttataaaagtgaagttgtgatgaaattttaggggacgaaaaaattgatagagtggtataacatatttataagacatgtgtgtgaattgaagcaaaatttgcaataatgatgatcaactatgagaaagttgttgaggcatacttagtgagatcagcattagaaagataaaaattgtcatcgatagagcttacctcaatctcgaaagtactcttaaattatgcctcaacaaatatcattttaaatataaaaaacttaccatgtgtcactaattatgtttaaagtacagcctggtagcaggagccatgaaggtagatttcgtgcttaaattgttgagattattgaagagaaagagcgagtgattacttgacggtttatttgagcattaagataagtaccactatttaatcatgcaatgagcaacaatcaacatcatgaatagaggagggattcatttgcagttaatgtgaggaatggagcacatgttattagcttctctattgtatcggatggttaatatctgagatgcacaatatgatctaacggctataacattcttgatgatgtggttttacgaattcacaactaattggagtggttatatagaaatagtagatagttgggatgtactcccttcgtcccaaaaaaaaaaatccactcatagcatgtcaaggtggaattagtggagatgaagagtgactaaaatgcccttaatcattttaggtaaagaatagtgaagggataaaacttctctttttacgtgctgagagtagatagtatgggataaaacttaaactcttaaagttgaatttttttttgatggaggcagtactgattacgatgactccttcctagtgagtagggaactatattatatttatatttatagggtatacatagtatgggttgcgcaagcgtgtgctctaagttaagtgaagtgatctttattaggagatcgaggacccattcccctgccacattctcctcttaatgacttgcatactcaattagtggattagtcgtcgtactactactaattaatttggtttggctgctcacatgacccaatatatatgcatatatatgcatcatggtcccatgtggacagagagtgccatgccacgctacctcacaactacccatcatcatcatcatcgatcatcgtcaccatctcaccattgcatccatgcaaagcatggtcccaaaccaaccaacggtagatagatagcgatgctgcgctgctactgtccaatactgtacagctacgcctagctgtactatatatgaattttctcagtgctttttgcgagtgaaagagagagagagagagatatgagaaattgagaaggaattagcataaactagtacgtactataggagtattatagcatacatataccaacttcggtactttttgtacttgatttctgatcaatgtaattagaaagtcttcggtcatactcttttgggggttcggcaatgggcaagctcaatccctatgaaatgaaatgcaaattcaatctgcagctaatagtgaattatttttagccgtcatgcccttccagtgagtatgcttcgttattacatttttaacaatcaactatgaaaaccatttttcgtgacggccattatggatttttgctggcggaatttacagccgccacaaagcaaaggccagtgaaaatcaagatcttcgctagcggttattgaccaccagcaaaaatccattttcgctggcggtcgtcttaagccagccgccagcaaaaattcattttcgatggcggctgtgttatatcggccgccagcgaaaatctatttggggaacaaaaaaaacacgcatgcaactgcccagccgccagcgaagatttggagaaaagacaatagattcattttcaaaattcaaatccaattcatatacatatggctgctcatttccaaattcaaacacaatataaaatcatcattagcacacatgtacacatatcaaacatcacaacatgcacaaaacatctacatcatcaggaaacatgcaaaaaaaaaaaaaaaaaatcgtgccgccgccggtctcttgtcgtcaccacctcatcgctgccagtggggagggaggaggcgccggatctgctcccc

SEQ ID NO: 68736 - DNA, 24046 bp, Oryza sativa
atcatgaattagctcagctagctaggagattaaatagttgtgcagtttggcggtttgatgctgctctctgtattagaacttagaacttctgactgtaatctctctggttgagtaaaaaattcaccctttccccgcaaaaaaaagaaaggaatatgaggaagatttcagagagagctacaaattggacgtgggcgcccacgtcatcatgacgtcatcctacatgtatgcatctaagcgaactttaaactatttttttctcttaaattatttatccaaatcatgatccgattgcactattaaatccgttgcaactaaatctttaaaacaaaaccacacatggatataatccgatgaaaaaattagcttattattaaactattttttaatgttgcacgctgctgcaccaagtatatcggaattgtttcactaactagatcgaaaatgtttcatcggacgttgtttcgccttatatgaaaacaatgtttcagcaaatagcgaaaggatgtttcaattcactgcaacatttgattcatacatagtgaaacattatgaatacactaggtgaaacatttttttgtggaacaaaaaatgaaacggattcctttaatagagagtttccataatatgtgggtgatttgttgcaaaagaattgtttcaattcactacaacatttgatccatacatagtgaaacattatgagtaccctaggtgaaacatttttgatgaaacaaaaaaattaaaagaattcccttaataaaggagtttctataatatgtgagtgatttgttgcaatggcgtgcatggtggggacacgtggcgggaatggcgcgaggaaacgtgacgggcagggcgcggggcgcccgattttactcccccacgtcggacgcccggttgtaggtattcccggaagatttcggtgcaaaagggctgggataagtttaagatgcacgatgatgcaatccagaaaacaatttgtccaactattcctgtaattacaactccttatgtttgcaatacattcagacacatgaaaaacatgtgtttgtgcttgcaggtgaagaaggaaataataataaatgcatgctcatgatgctcggaaacaaaattctcaggacagacttttgggcgtaaaatctaatccatgcgtgcacatggccacatgggttagtcttacggacggcgcgacctctgccgaagccgtcagattaaagccatcacgtgtgcacgtatgcatgcatgtttttttatctcgacgcttttagcttgagagttcaatgtgagtctttctaacttatatagtacttgtatatttttaatattggatgatatatttcaaaccatgtattggttttaagatccgttttaaccattgatcccacttaaaatatatgataaaatgagtatactattgaatacattgaaatatttaaaatccaccaggtccctttccctgtttgtgacatgcccatgtgcatttacatttcatattggattatttggcacaaaagaaatcaaatatcaaaaacaagtaatggaaggtgaccgaatggcataaatctaaagtgtggaaactttcagtagtataccctaaacttatcactagtgcagaactgatcttttacagtggtacccaaaataaaaatatttccgttagattattagtaccggttctaaaagtccgagtactaaaaaatgcatctttaataccggttggtaacaccaaccgagactaatcatggaggatctttagacccggttggtgttaacaaccggtactaaaaacaccaacctggactaaacatatttttagtactgattggtattaccaaccagtactaaagatatctccagggttacactactacaaaaaccctcatagagaatggcttataggtgttggttcatttaaaaccggcacatatggagcttttcccaccttctacgacggaaaaacagagaactgacacctttaaacactataggtgccggcacctataatatattataggtacccgtttttttaaaaaaaccggcacctatagctttgagccgagcctgcgagccgagcccatcagaaccgcacaaccacacccatcgcgcgcgtccttatctactcgatcattctccgcctaatccatctaccgtctctttctcgtctctcagctctcgggtctctctccctcctgtctctctatctctctctctcgcatctctctccttctcccccctctctctatctcgtggtgcctgcccagcgaaaacggcgagcccccgtggctggcagccggcctagtggacgctgcagcggcggcggtggccgcgccctccccttcgccaaatccggtgggagggcagacggcgggctcctgcggccagcggtagcagcggcggcggaggtagttgtggtgcacctcggcagcggcgacggccgcgaaatccccatgcggcgacgacggcaggggtgaagaagaacactggtggcacgggcgaggtggtggctggcggtttgagttctttggtgtttttctttttgagttcatgagttcttgtcccaaactttttgagttctttatgctttgtaccatgcatatactattttgctgttggttttgatctcggattcaaaggcggtgatgaaggggaatagggctgggttcgacggaggatgacaacgacggtggcatgtggttggtgagttcggctcggattcgagccggctctctttttttttggctcgagcaatgctaaaggtgccggttcctaaagagccataggtgtcagttgctagtattggtgcggaccaattggtcccggatgaaaatccggcacttgtggcccatttggaaccggcacctatgaccattattttagttgtgttagttcaaaaagaaaacatctctatgcaagttagatgtgtgtagtagtgttgacggctgttaagtgccaaaataatgccgtcaataccttcctaaaaccataaatgtgaaacatccaacatagtggtaagatttatttctaacaatttccacgagtgttgatgtatacttgtatgcaggtgatcaaccaccaaagttgggagagaatgagcataaagagtggaaatatattttgctctgatgaactcacatggttttgagctacaatatataaaatgtgcaattatttggagccaaaacatggagcatcatgaagtggggcccacatatcagcatcctgaagaaagatgtgggccaggggagccaaccatggtttggccaaaccccggccgaacccctagctggcccaatccagcccaacttcggtatgacggttgtgctcctcatactatgacggttacgggcgttaataccggtagaaaccgtcatcaagaggacacatggcaagaggagaaggaagatgctctttggattctatgtagaatattattagcatctccactctcccaagcaagctccacactataaatacccctctcctctccctcattcacacacaccaaagcatgagctgaattacaagaggctctattgtactttattgtatattagaatagggagagagtaaggtagaagaagtcagaggaatcccagagttgtcggtaatcctctcttatcttttgtcccggtacgtagtagagcgacatttgggaacagtgggttgacagtgcctggtgtattgcgttaggattaaagttaagctttccctagacattgtttctcattaggaaatcctctctgccctctgcccatattagttttgtgtccttggatgaacctgacgaggaaatagtcacacacgttcccttggattcgatacccttggaatactccgtaggggaagtgctacatcggtatatcagtgcgcttgcgtatcttatctgtgatcgtaagaaataccaacaagcatttctggcgccgttgccggagaacggttgctgtttatctctgaaccttgttcatcctcgtatcctctttatttttctctcttctaccttcacccctactaccccagagaagtatttctgaaaaaaccttctcaaccgatggagccattatctatcttccaattatctactcctcggggtgaattttacgagccacctgcttcatcggagcctattttgacacctggctatgaaattcgtcccaaattcatcagtatagttagggagaaatatttctctggtttaggccaggaaaacccctaccatcatctgcgggaattcgaacagctttgttcgtgcttaagatttgaggcatgaagcaagaaactgttcggtggaaattgtttccattcactcttcatgagagagcgtaacaatgggtggctggtctgtcctctgggatagtccaggcagctacaaagtcagcgaggacctgtgacttgacggctgttttaggcacgaagtggacattgaattggctcagctcgactacccatttggcgatttggccgaccatgtctttattcctgacgacttcgcccaaagggatggaggagacgacggtgaccttatgagcctggaagtagtggcgtagctttcttgatgtcatgactacagtgtagagcagtttttggatctgtgggtatctagtttttgcgtcgtggagggcctcacttacgtagtacacaggacgttgtacttttttccctctctacgatgataactgtactcacgaaataaggcgtggcagcgatgtacaggaataattcttcattgatttgaggaccaacaagtacagggggatttgacaagtagcacttgagcgcgataaatgcgttctcggcttcttggttccacttgaatttgtcttgcttcttgagcagggcaaagaagggttgtcctcgttctcccatttttgcgacgaatcggcttagcgaagccatgcatcctgtcagccgctggatttccttaagccttgtgggcaactttatgttctcgatcgccttgatcttctcaggatttgcctcgattcctcgtcctgaaaccaagaatccgaggagctttcctgacggtactctgaacgtacacttctctgggttgagcttcatctggtatcttcggaggttgtcgaacatttccctgaggtcgtcgattagtgagtcgatgttcttggtcttgacgacgatgtcgtccacgtatgcctcgacgttttgtccaagctgagtgccgagtgctccctggatcccgcgctggtatgtgttgcctgcgcttatcaatccaaagggcatcttggtataacagaatacaccgaaaggcgtgatgaacgctgtcttctcctcgtcctcttttgccatgctgatttggtggtagccggagtaagcgtcaaggaaacttaacaactcgtaaccggccgttgagtccaccaattggtctattcaaggaaaagggaagttgtccttggggcacgccttgttgaggtcggtgaagtcgacacacatcctctagttcccgttggctttgcgtaccattactgggtttgcgagccactctggatggaggacttctcttatgaagccagctttgagaagtttgtcgagttcttctcgtatggcttgtttttgatcgggtccgaatctccgcagtttctgcttaactggcttggcatcaggtcgcaccatcagtttgtgctcaatcacctccctgggtactctcggcatgtctgacggctaccaagcgaacacgtctacattgtcttagaggaaggtgatgagcgcaagttcctatttgtcgtccagcgttgccccgatcttgacggttttgtcagggttggcgctagacaacgggattatcttgatggtgccatctggttttggcgtcttcttgggcttgctcactttgttcgggttctctgttgtggcgggcaggttgggagtatgctcgatcatgtcaaggctccgcttgtcgcactacactgccaacttggcgttcccctggatggtgattgtcccttttggtcctagcatcttcagcacttggtatgcgtagtgcgaggccaccataaacttcgcgactgcagctctcccaatgatggcattgtatgcggtatcgaattccgcgacatcaaaggtgatctgctctgtttggaaatttttggcgtgtccgaatgtaacgggtagtgtgatctttcccaacggtttagacgacgattccggggtaattccgtggaagggctgatctgttggcgtcagcttgcttcgagttattctcatcgtgtctaaagtgctggcgaagagtaggttgaccgaactcccaccgtcgatgagaactcttgccaccttgatattccgaatagtgggttcgaccacgatgggatatctgccaggtgtagtcacgatcttggggtgatccgcttccgagaactcgatcttgtgctgggaccacttcatcttggtggtagtcatctgcgaggtggagcagacttcgcgttccgctttcttgtactccgtcttagaggtgtacgaagtggatcctccaaaaatgtgggagacatgcagatcgtactccggcaaggcagagtcagagttgttggtggcagcttcttctgccgtctcaacgactcgtacttgctttcctctttcgattgctagttgtctcgcgagctcctttttgacgacgtagtagtcctccaaggcgtgtttgcttgtcttgtggattgggcaccatggcttgcgggagtcgtcgccctgggggttggagtgtctggatggttttgcttgctctgtggcaaggacctctcctgaagatttgcgttttccactcttgtgacttctcttcttacttgactctggtgcatctttatcggccaacttcttcttctcatctcccattttgcttttcccctcattgcgcctcaaagcgtcgtctgcgtgagcgcacctatcgatgatctcgaatagttttcggccagatgtgattcagtgtgttgccaactcctgagtagtgtatcgatctcggacgccagacttgaatgctcaaatgacagaagcgtcggtgatctcggggatcgtatttctgcactcattgaggcgccgaatacagccccgcaatgactcgcccgggttctgggttaaagtatgtaggtcgtcctcaatcgtgtggcgcttgtatgtcccttggaagttgtcgacgaactgctgccacaaatcttcccacgaagagattgagttcggcgggagatggacgaaccatgaatgagcagaacctttcaacgcggctggcagatagtttgccagggcgttgtagtctgcgccagcggcttagagaattgtggggtagacttgcaaaaattcttctgggtttgtacttccatcatatttctcaattgatcccggtcggaacttgtcgggccacctcacattgtgaagtgcgggtgtgaatgccctgcgtccgttgcctgggacatcatgtggcccatggtcgcggcgtcgtcttggaggccaattcgaagaagatgatgaagatgaggatgaggggtcgcacggatcaggagcccggcttctcgaacggtggtcacgtccgcggtctcgactcggatgagcagattgggagtttcgatctcatcagttgccattgtccctctcctgtctttggtgatgatttttccgatcacggttgttgtcgtcacttcggtcatcacgggttcgtcgatcttgatcctcgttgggggtgttcccgcgaccatcgtcctgttctcgccgcaagggagagcgatgacggtgttgtcggtgtggatcaccgtcttcatggcgagaaggagaacaatggtggtgacgctcgttctcgttgcgttccctcctattacgccgatgtccgtttagatgctcgcggaggtcgccatcttcacggcgtggtggtgtagggtcacgtcttggaggagagcggttgccggtggcatgtctcccatcgagattttcttcctccgcatccccggtgggccgttcttcgttcatgttcggctctggaccgcctgcggcttcagcgaacgtggtattgaggttggtcacagtttcccgtagtcactttgcccatcggctggcatctgggtttgtcaccagatacaaaggactttccctcaaaatcgcatctacgttgcgcaattgatgagctagcgttctcgctgctacgaacatgcttgtttcagtgttgtcgaccacgttcacttctctaggtgactgcaaagaggactcgtagccttctaagaggtgtaacacggatggctcattcgcgccgatgaatcccacaaaccgatctggggccgcaactggttccttggcaacgcatggggtttgaactcgtggttgctgaacgcgatgatgcgccggtttaagggttctgaggaagatcctgcagttggtgagatcatacactttggatctatggatcggaaagtaggtggtactcgttggtgaagtgcattgtatccctcgttcccaacaggcgtagagttcagcttgcacatggaatatcaccgggcagtcctcaagagcatgcttggttgtcttatgcacaggacaccaagttctcggtcttagggtggtcgtccttgtcggctttgatctttcacatggagaatgaaattcagctgcttgaggatacctcccaggtgttggggccgtcgatgttccgttctccaccggagtgggaggaattatcggcggggcgtcgtttctctcagtcgttgccgtacccttctcgctcccgatgacgatcggaccagtcgagattgttgtaacgatatagaccggaaagacaatagatccgacttgagtccacaccagcggtgtcgaggtagaaactccttgattggcgctggtgatgagactgttgtcggggagtcctgaagtcatactagcatatccataagcgccaagtgcccctacctggcgcgccactgtcgacgagtggtactcgcggaccgaaagaatagggtattggcgtacgttggaacagggatctatgtagtacgacattaaaacagacaaaagactaggattatactggttcaggccccttatcaggtaataggcccagtccaatttatatgggattgatgatgatgaggacagattaccaagacagtaaccgaagcaagcgatactgataagatcgtagtcgagggattcgacgagatctcccggcgagttgactccgtggacttcggttccgtaaactttggtgggtgtgttggcgatgaaatgcgatgatctttgcctctccccaggggtcccttttataccgtggaataccttgaccctcaagtaagtcttggagatatgtaaacctacacgatatactagagatttcaccctttccgaggacttatgcaattccttaacttcgtggagttattttccataatctgaggtgaattcctaacggcgtatatgggaaccaaccttatatgcgaaggtataccttatcggtatattccataagtcgtaggatagagggtatgctttatccgtaaccctgacacacatctaccgtcgggtatgtaaacggtgaccgggagaaattgcgagacaggttatgcctcgcattcttccctataacccgtattactactcttcgtgtagaaattctgagtttccagcagataaataaagaatcgattgatgcagcctggtccaaattcactaatttagttcagtctggcccaaccctatctatagccgattacgtgctattgcaacattttcaaatgggtttagatagggagtctgcattctaccttgacataagtgctggagggtcattcatgcacaaaactcccgccgaaggcaaggaaattctcaatcgcatattagaaaatacctcctttgtcgggcagtatgttgaaccccatcaagaagcatgtgtcaagaagggaggaaccttcttttgccgagcctaaacccgagccttcaacatcttcaggtctgactaaagagtcctccctggagccatcgccggattccaatgaaattcaagctccgggttacgctcctaaattcagggatgatcctcataccgattatgagaaaaccttgacaggcatcctccctgataacacgccgatagaggaagtaatgttagttctgcttcatgaatcccctgaatcaattctacaacaggatgatcttcatttcattcaaaaagattctggtgagacccttgaattgctctccatagaaccaccatcacaacctcctatcgagcctaaaccttgtccctctggccttcaaaacgtcgttcttgataatcatcaagtatcaacctcattcttgaatgacgtctctcttgagaaggagaacattcaggccagggacaagtttgagacatcaactctggaggatgagaactccacaaatgagcatgaaagcttctatttcaaaatcaaccaggattcatgctcacataaggaatctctagagtcttgtctgatcagtgccgcttcttcgtgcgaggaccacaaccaccttatggtcctcatttctaacatgattagaagtgtggttgtggatgctttcatttatcagaaatattgcaaatctcgtatgtgtttgtggcactaatcttgcagcgagatgtctccatggtcgagcctgtgaccaaaaacaaagcactgtcgggagataccccagattatcttggtaagttttctttccaataaaagcaagaaccagtttttaggataatatgcaccttcgggtattcttggtcaataaccatttcagattgagattaagaacgagggacgtatgatgcctaagaatatgggagctacatcaactgttcattttggtgatccttggtgctgaaacacactttatgaagactccaacaacacacatttggttttgatgtctcgtgacacaaaagtccaagtgtgagggaggccgacgagcttgcatgacgagttccatcaaccaaggccattttggtttgcagtcgatgttagtcttaccttgctgaaaaaaagagaaaaaaaagaagaaaaaagagagaaaagtaaagaaaagagtgacggaagaaaaaaaataaaagatgggagaagaggaagagagcaagagagctggcgggctgcatctagatcaaagaccgcattatgtgcgagtctttaaaatatggtcatacacctcattagtagcaatcatgctgcctggctacaaccagcccctctcttgagctcatgtgcagccttggcttagccttcatccactcctagctgtgcacaacctctcgctccagcagcgcctacacgcatacacgcaagaggagatgccctcttcttttctaggtgtttgatgctacactccagttggcacttgcatatttgcccaaaaagagatgcatcctatgtctctacagcattgtgccaaaaccactcgcttgagttggtgtggtcaaagtgccttcctccgccacaacccacatcaagacggaggagagatcgacaatcacatgtgaccatgccaccgctctagaagtttcaacatatacattatgctggcagtaagtacactcaggtatacaacaaaagattcaccatttcttttacttgtacttatctctagttgagtctggcttgatcgtacatggttatgcgtcctcgggtccattttcatatgctatggtttgggtggtcgtcgacattcataggctttttaaattaagcatgatgcttaggatagatagcctgctttaatcaaagttaacatggtgtcaagtttgcttcaatgaaccatagagccagtactttcatggacttcggatgtatacccttcgtggattaaaccttgcaggaaatcatttcaatttaacggatgagttctcaagcacgagtcacactggaggtaagttaagggccaggaacaaatcaattgccaaaacaggcaaaggagaaacatatcacctctcaaggtgcacggtatgtatattgccaaatgctgctttgctatgttatgtaactttatctcaaccttgtatgagttttgcttaaataaaagtttcgtgaacaaaataaaaattgtttttaagaataaaagaaatgtctctcgaaaaaaaagagaaaaaaacatttttttctctcgagtaaaaagaaaaaaaaatgaaaaaaataaatggcaaatttatgggatccatgctcattaagttttcaatttaattcctttttaccatggatgtgatcaactaatcttgaggctacgataaaatcttttcaattttttgtagtccctcaggtatttgttgtccactaaccttttgcaggaaatatgtacaataacctcaacattcgtaccacgctccttggactatgagaagacagatgctcagggaaccaggcagaacaaatgcaaagttgtgttgcattcttgcatccgaatcaaagcttggtaagtcctatctagtaagaattcgaaacaccctgtgtatcattgcgtcacaaatgtccaccctgctaggttacccatcacctctattgctgccataaaaaatgataaaaaaataaaaacaaaataaaacatgaaaaaaataaaagaaattttaggcacttcatgcgcctagaattacttgaataaaatttggctcaccggtattctaccccgatgaaagcccattttgctttccatctttttgttgaataaagacaaggtacaaaacaagtgtgggggagtcttttcggaactcccaacgcacaatagaatcaattcaacatgacaacatgatgaacactggccaatgactgcgcacaaaattcagtagccagaaccgagtcctggctgggtcggttgaaccaagtgttcgcccaacccttgcctggctcggtactgtcatccttcgccgtatggtcaggtttgcgtgtctccttccttatcctcccttgtttgtgaattaaactttggtagaaaaatcgaatataatttagtttgactccaaatgaaatattgaaaacattaactctcaacgaatagaattgccctatgaatgatcatgtatactttttattctttgctaacacttgtcacttgtgaacaaccatctatcataggaaaccttgctcatctatgtaattaatatttgtgatatggttatgacgaaagaaattattgtccaactgtcatgatacttgggattttgttttgtgaaaaataaaactttttcgagcaatactcctcagtgactatattattaccttccaatgccatatatgattatcattgcaaaaaccttgtatatgtataggctgcttgacattacattgagccttgtcaaattattgtgacccgtgtgagatacttttcatactttcatgatcaagatcgcacgcacactccacatacacacactatgctaaacttttacactagaagctagcatttctcatccattatttattttatccattatccacaaaataaatactccatgtcatttatgcttcttcctccaaaattctttcaaagaaaaaaaacagagatagagagaggcatggctatgcaaaagaagaaaaaaaaaagtcttgctcatacaagtatggagcattgatgaaaagagagagaaaatagaaaaaaaaatcttgttcatacaaagtatggggcatgatgaaaaaaaagaagaaaagatatagccatgcagtctcaaatttccaaagagagaaaattggaggaggaggtatatcaaaggagttgtcttctattttcctttttccacccataaaacaaccatacacatacatacccatacacatatcacacacatgcacattcttgatcagagagtatgacttgctatctcctagggtccgatattttggctttgcaatatatgtgatgcaggtatgccccgattgatccctaccgacctccacctatatagccttttagaatagggacaattcggcaaacatgccttggtgaggatccacaaataaaaccacatgagtgatctgagagaaggtcatttgaggagtatagctactttgcaaaaatatataaaaaccccaagagattgacaggaggattaaggaggacttgagtcatgaccgttctattcatcaattgcccaagatgataagttagacacttgaaaagttcacaggtacaggtatagcttagagtaatttgtgtacttgtattatatcttgggaaaatttattccacattaatccttaacctttactcgggacgagtaaagagccaagtttggggggttttgttgacggctcttaagtgccaaaataacgtcgtcaatacctacataaaaccataaatgtgaaacatccaacatagtggtaggatttatttctaacaatttccactagtgttggtgtatatttctatgcaggtgatcaatcaccaaagttgggagagaatgagcataaagaatggaaatacattatgccctgataaactcacatggttttgagctacaatatataaaatgtgcatcatgaagtggggcccacatgtcagcatcctgaagaaagatgtgggccaggggagccaaccaaggttcggccaaaccccggccgaacccctagctggcccaatctagcccatcttcggtatgacggttgtgctcctcaaactatgacggttacgggcgttaataccggtagaaaccgtcatcaagaggacacatggcaagaggagaaggaagatgctctttggattctatggagaatattcctagcatctccactctcccaagcaagctccacactataaatacccctctcctctcccttattcacacacaccaaagcatgagctgaattacaagaggctctattgtactttattatatattagaatagggagagagtaaggtagaagaagtcggaggaatcccggaattgtcggtaatcctctcttatctcttgtactttgtttattactctgctttaatagaaatatcattctgagtaattgagatttgcgtagtgataattacttcttggttagttcctaattagcatacgggatcattgttcactatagtccatttatttatagtgattgctttagtgtttgatcggaactagagtagttattaattgcgtagacgccgtgtctgggtaattaatcttcagtggttgctgcgtatcgcacagtacgtttgaggtgggtgtagaggtggaaacagcgggttgacagtgcctggtgtattacgttaggattaaagttaagctttccctagacactgtttctcattaggaaatcctctctgccctctgcccacattagctttgtgtccttggatgaacgtgacgaggatatagacatacacgttcccttggattcgatacccttggaatactctgtaggggaagtgatacatcggtatatccgtgcgcttgcggatcttatctgtgatcataagaaataccaacaagtagttgagatggtaacgtgcgtgagggttgaggtcagagatctttagtttaaatcccacatcgctgacattttttcgacatcttaaggattggggtacccatccttaaaagaaaacaactgaagccctagcctactctaggctcctatggattgctaaacatgtccatttagaatagcagaactcgatgataccgacgagaccatagtcgagttggttcgactagatctcccggcgacttggctcctgcgtgctctagctccgtaggctgtggtggatgtgttagctttatgttgatctattgtaccgtctcgtgtcccctctcctcctagggggccttgtatttatacacataggtgtccccttgtccaagtagaactagggaaacctatatggatacaatccgagtagtccttgttatttccatgtagaactctgttcatccttccttatgcggaactcctcctatatccaaaggttgtttccgtataagagatggtatgtggtgggtcctgccgagatttagtaaactactattaggtatgtggtatccataaccctgacaatagcccccgacttcaataaaaatgaacaaatttatattctcaaccgcagaccttggagtaactattatcgagctcacgtgagcattctcggtgagttcagagataatgttagacttcccttatcagcctcgtgcgggcacctgtagggtttgtctgagtcaatctccgacgtcaaccaagaaagtacaaagcatacgactaagtctgtcgtgttgctgtaatcgagaatttggattgaagtcaagaatttttatctcagcgggtacaccatctcttcatttcgtattccttgtcaagatccaccaaccgttctcgaatgatcgagaaggcgcagagtctacgacggagccttgtcaacatttttcgtactcgccttagtcgatcttggtatagaaccatagagacatggagtcttcaacaatgtcgaatagaattttcctgaaatcaacactcaaaaaagaatattagatagaaatagcccctgagcgaatgctcaaagggtgacatgttataatatgtatggaaaactggaaatgaattaaatttacagaccaatgttttgtgtacaagtgtcttctcttttaccgacttcgatcagtcagtttgttgagtcatacactctacctagcccccagccttgtcgtcggagaatcgttctcggaggataaggctcttggaccctcgacctgccttggttgaaaaagcactgatcctagcccccagccatgaagttggaaaactcaatttctgattacacggcttggttaatacgcactgcgagaaatcttacatgaccagatcttacatggtcgtttgtctttacatgatccgataaggccttatccgctctaggcattgctagccgaagttcccttaggttcctcagagaccttgtcggaacggcgtaaagggacatgaggataggtttcaactctaggtgtcgtcatggtaagggatttctgggtaaaacgcttggcgatactgtgtacctgatatcaactttgttggagtaaaggtagcgggagaatcgctacaccgctggtcggggaccaggggtagtcataactcgaccacttgaagtggatgcagtgggagaaacgctacgccgctggtcgagaaccaggggtagtcataactcgaccactagaagtaaaggtagtgggagaatcgctacaccgctggtcgaaaactaggtgtagccttaactcgaccaccagaagtagaggtgggagagatcgctacagcctactggtccgagaaccaggagtagcctcaactctctgccgattgatgtcgaggtacgagagatcgctacggcctacttgtccgagaaccaggagtagccttatctctggaccggttgaagtcgtggtgcaaggaccactacgctgctggtcgaagacaagtcgtagtcgtacctcgaccatctgaagtcgtggtgcgagagattgctacgatttattggttcgggaaccaatgagtagaattatctctcgagcaccaatggaagttgcggtgcgggagatttctacgatttactggttcgggaaccagcgagtagaatcatctctcgagcaccaatggaagttgcggtgcgagagattgctacgatttactctgggggcgctaaagttggtatattacatgtgcatctcatgtggccagcatgactcacatacccaacttatagcatatccagatgtctgttcgcaatcatgtcgggtgatcaagccgacaatgttcacgaggaattatccgttaacaaccttttctcgaatagcccagctatggccggtgctatgagataggtcgtcggtcttcgttggtaggttgggtgcgataactctgcatttgtcgagaacgttctcgataatggagtgtgctcgaccacaacctactcgagtgctcaattgtttctgaaaaatattttctagaaggcaagacatgtagcagataatatcgagtatgtactcaaaaaactgcatggatcttctagtattatcaggatataacgagcaaattaaatatccgggattatgtaaaccgtaaacaagcatgatttatacagaagaaaatagagcgagcccccagcgttagactgtagttggcctaacatcggtaatactcgcacaatagatattgtataaaaaacatgctctaggtaaaaataaattattgatctgacaatgttgtatgatctaaataagtacgataaattgcatataaaatgcgtacctttgtagatatatgtcggatgtatctacaaaattagtagatcaatttgaaaaaccaatctaccaattaccttattgcgtactcgttcgacatcatatgatctgacatcttttggtacgccgcgtatcttgaggcttggatgatctcgatagaccgagttgtcgatgacgatgatggttccgatcttatcggggcacgtactctggtttggtttgacttctcagatctaaagtagttgaagtatccctcgtcaaaaaatccatagtgacgatgtcttggcgaagcttgacgaatatcccgatccgcctgagaacgtacttcgttcgggtcatatcatccagcataagaagtcgttgagtagtttgttgaggaatccatctcttgaacctatctcgtcaaaatcctgaagcaccaaaatccccctacctggcgcgccactgtcgacgtttgatgtcacgattccggtatttgcatagtatggggatcgttggtactaggatatacgcgagattgtagtaaaagagatggggacgaggatttttatacaggttcgggcccctgaattgtcaggtaataaccctacatcctattgatatgggattatatgatggaaaccacagattacaaagggaatagcagaactcgatgataccgacgagaccgtagtcgagttggtttgaccagatctcccggcgacttggcccctgcgtgctccggctccataggctgtggtggatgtgttggcttgtatattgatctattattccgtctcgtgtcccctctcctcatagggggccttgtatttatacccataggtgaccccttatccaagtagaactagggaaacctatatggatacaatccgagtagtccttattgtttccatgtagaattctattcatccttccttatgcggaactcctcctatatccgaaggttgtttccgtataagacatggtatgtggtgggtcctgagatttaatcaactactattaggtatgtggtaaccataaccctgacaacatccaacgaccagatcgaccccacgatccccacgccctatttcctgccgtatccaccctcacgatcccggccctacgccctcaccacttcccgcattgcccccaccaatgcgctccttccctcccccgcgatcccggccggctcctccaacacgcggccgctgccaccagatcagcggaaatccgcccgcgcccccaccctcagcacccattcctcccgctgtgccgtccgttgtcgccgtcgtccagcgccacggccgccggaccggcaagaatccacgcacgccctcacccccagcgccccatccctcccgccatgcatagggccttcatcctgcgtcaccgccgctgccggatcgacgggaatccgccgtgcccccaccaccagcaccccatccctctcgccgttgctccgtatcgcctcaccgtgcccttcgtcgtccaggaccgtcacccacgacaccggcgacgaatcaccgccatcttacacttccattgcaccgccgccgtcgtcgtcgtccaacacagcgattcgccctccgtcctccacgcccaccgcgcccttgcggccattcacgatggtcctggaagaatgccattgcagcgcccaagcttagcctccgtcatcgatgatgcaggtctgcagcactacgtcaatatacctacgtccatgtcccgcgcggctcatcgctgccaaccccgccgacgaggtaactagatttaaagctcattgctttggttcgatggattgacggccgggcaacatggatcttagttcttcgtaccgaaggttccagcagaatgttgttgatcgtgatctttgttaacacagaaccccagttactactactttcgttacagagatataccttttgctttggctccagcatacaaaaaaaaagggaaattaacatttgctatgaagtatataaattgaacttgtaggaaccagtcctgagggtcaacaattatgacagcattaatagaggatgctgctgcaatgtcatttgtaattgcccatggacttttggtaggtcagcctagccagccattcgggtccctacaaagagagttaaggtttggtattcaatcaagctgtgaatatggtggtgtttggttccaggattaagctttagtccatgtcatatcggatgtttggacactaatttagagtattaaacatagactacttacaaaactaattgcataaatgagagctaattcgtgagacaaattttttaaccctaattaatccataatgagcacatgtttactgtagcatcacataagatgatgatggattaattaggctcaatagattcatcttgcaaattagtccagggttatcaaataggttttgccattagtctatatttaatacttctaattagtgtcccaatatccgatgtgacagggactaaaaaaatccctggatctaaagagggtctatgttttttttctactagaaaaaaataccatttcgttgcaatgggtgaaggctattttaatcttattattgttatatggtttatttaagataaaattcactgttaaattcgcttggatacatagtttgttagaaaatcataagctgcaattaggaatccgatcgtctcagagttagcatgcgagttttctaaagagatttcctatacaatttcttttctatttccaaaagggaacaaacttaaaaaccaactcaaatacattatagttccaaaagcgaacgaatttaaaaaccgactcatacacaaatgacgtatcaaagtaccggtaaaaacatcttaaattttttataatagtagagatcatggtccagcctgagttagagttcttgacttgagacaagggtacagcaataactgaccaactgaatatcctaactgacagtccgatagtaattcttccagtaccaatattgccctgtttaggatgccaaaattcagaattagaaagaattatactacttcaagcagcttcaaagtaaattccatactattattactaccactgtaattattccatactgtcataactaccactataattagtgcaattatacgcataattgtctcataatgaactatttggttttgtcgcagtgcactttaatttgtgctgttcaatgctcgatttgggttgctgttaattgctgtggagtggagctgtatgggaattgctcaattctaaacacacttagttatagggctaaaaaaacaagaatttcaggggaaatcatccatattgaagtttagttagatttgccaacttattaacactcaatccctagggggatcaaaggaaatgttgtgactgactaaaatgttggtcggccatcaagagacacaaactatttggttttactttgttaggatgatttcctatttgcaagaaccatgcgagtacttttctttgtttttcctgtacggaattaaggatttctacgaacatgataaaatatcatctcttttggattgtgatttattttaattgtgagaattaacaaatagtgtatgtcttagtctgaatttatacctgagactgtcaaaaacagttgcaagggtatgccatatgtagttgttaatatctatggatcaatccatgtgggtagccaattgtacgacatatagccatgtacaggtaagcctggtacatttgtcaattgataaatatatgaatatgtatcagatacaaattattgttatttttttcctccaatccattcttaactatctaaaccactaatttacatataagcacgaaacagaaagtaagcaagtatcttaacacattttcagcatatttgaaattgataatatgctagactgattactatctgtaaataatgctatactttctaataaaaaggtttaataaccatgccgcttctttcatttctgtagctactatatcatgatgaagcaagttgggtatgtcaatgaaagccaattagaccaagagcagcagatctctgctttataagggagatgactaatcaggttacccttaattccaaagtagtttttgcaatgaggatagtattggattttttaaaatggtaccgctgagtgtgagatgatcagtacagttgtcaagaatacaccgctatcatttagccttcagcttatcagcataagcgataatttgaattttaaaacttaatttagagttgatttttaatcgctaacaagttgtttcacatataataagtttgagcaaaacgatgaagcctataaatgtcattttcaaaaatgagatgtgttgtttgaggggcagcttaccaatgttctagcggaaccagttgaaggtattttagattcacccaatgaagaaacatgcaaaggttctttaatgtcagacaaaaccagctattcagatctttagtgtaatatctcatcttttgagctcaatggacaaactcaataataacttcttttgtaagctagagcatcatggttgaagtgttgttgaatcgaagggcaaaagaggaagctccaagtttttgatttagatggacaagtgaggtgcacattaaatccaacttccaacttgatgaacaatacaggtcctcgacactattctacttgatgccaagagtgtggacatgaaaggacatataaagtcattgctaaagctactttttttagagagtcttggcagttagttttaatgaaaataggtgggtttttaaataaaaacaatataaatttgaatttttgtgtttcatgtgtccttaaaacggtctttgtgaagtttgttatcatttggactcatttggagagaactatccacaatggagaaaatcataagcagattgtttcttgctattattctgagtttttgaggggtcgaatgacattttgacccatcgttttatactagcaaatgaataattgaattgtttcaattctgttttgtttgccaagtttgattttatatgtcaacgatccagtaagaaatctagcagcgtaaacatccctatatgttctctacttgctaatttggggtgagaccaataattttagttacatgatagtgattttgctacatctaccaacatgtaatatcttgttcctacttgatagaatttatgactgaagacaaatttttgtttgatgagatggtcaaattcaaaattggtattttcacttgaatgattttagcaacacgtcaactttgttagctttaaaatgcttttatacccgttgcaatgcacggtcactaaactgtaggatcgaaacacaagaactaagccaaccagaggggggtgaatggttggtgtacccaaaaaccaaaatttttagcggaaataaaagttaccctcaatttcgatgtagatcggtctgaccggagtagtcccgtcggtctgaccgtgccagtgccgccggtctgaccgatgtagattgcccggtccgaccgccccaaagtcgccttagcctcctgatgccgccatcggtctcaccgccgtatgcccgccggtctaactggaccgatgccgtcggtctgaccagtggtaactcgccggttggaccgccgcacccgagaaaaaacaaatcgaagaactctcaaagtagatgacaactttatttcttctctctgtgtttacaaagtgcaccaatagcactccttacaaaaatcttgacaaaactcaaaaccctaactaaacaatcaactcaattgctctcaaagcgatactgggaagcctcacgctccctctctatttatacatgaggtaggcagcctaaagccacgaaccaaactcatactagaagtcctaatccccataggaaacctcctagtacaagaaacaaactttaaataaccaatcataccaaatttggact

SEQ ID NO: 68737 - DNA, 1079 bp, Oryza sativa
aaagtttaagactccggaagcaggaattttaggcactgtattgccattagataatcgggtggataatatacatattggtttgccaaacacttggaacaggccacaaatttcgagttaacttttatttgattgaggatttcacaaccggtttatacaaggtctagtacccaagagaataatagcgtactgaacaaacaaagggacaggaaagaacaagggctgcttctgtcaagaaccatggtcacttgaacataaatgcaaggtgagataaaacgataatggcgttagaagagggaaggaagaaatgatcagaagcagcaggctactggcattgacacttgatggtgttaacgataatgttaaacaagtcgacacgaaaaaatcactactactcctactcctaagcctcagtgaaggaggaaacggagaacatctctctcgcattgcagtaaatggtactgctggtgctggactcctcacgtttctcagctgttgaacgctggaggtagaacagtagtagcactggtaaacagtggaagtaaaatttcatttatggattattaatttgctattaaaggacagtttaaactgatctaaagccaagctaacatggtgaacttttgtggctaacgcaagtatggaagggttgccatacaatgtacaagctaacatgaacgttattgaagctgaaaaaactataatgtaatactcctatatcctactgacatgtctgcaccatatattgatccatgagactcattcctgactggccttttactggcacatgcatggaacaatcagcttaaagttaacagtcagctatactgcatttagctgcacgcctgcactacaacagattttgcaactgccattacattggctaatagagaaagctagcatacagttgaaaaccaaacggaacaaacccccaacgcttaagagcacatgaaaacctgctgccaaaactttgatgttacagcttacaataacaatcagaatggtctggtgcttctgcgacaaacaaatgtttcaaaactcgtcccttttgcaccattaaatatttctccctaggcctttca

SEQ ID NO: 68738 - DNA, 2051 bp, Oryza sativa
catttgcattgaagtcgggggctactgtcagggttatggataccacatacctaatagtagttggctaaatctcggcaggacccaccacataccatgtcttatacggaaacaaccttcggatataggaggagttccggataaggaaagacaactagagttctacatggaaacgacaaggactactcggattgtatccatattggttttcctagttctacttggacaaggggacacatatgagtataaatacaaggcccctaggaggagaggggacacggaacaatagatcaagacacaagatcaacatacaagccaacatacgccaagacaagacgccaccggatatcgacatcagagatatgcttggactgaccctatccagtacctacagaggacgactgtagggatctagcgctgtctttgatctcctcgggcacgggttcgaggaggaagactaccctgttgtcgactacgtgatgatacttcactccgctatgtcaacaatagttagataggctaccctaaatattgtactggtgtgattatggtgaataagagcaacgaccggcttcggccaacaggagtacagttattacctgacaattcaggggcccgaacctgtataaaaatccttgtccccatctcttttactacaatctcgcatatatcctagtaccaacgatccccatactatgtaaataccggaatcgcgatatcaaacgtcgacaccatgtaattagcaaaacatgcaattttatttgtaaaaaattataaagtgggttcaatatgctcaaggggaatgtgtgacttgctcgaatcttcaaacaatcctccgaacactcatcctcgcgaacgcgatcttccgaaacggtggattctagacgctggcacgcaaaacgaggaaaagctctaataaaaaccaaataagtagtatgtgaaagtaaacaatcatgcaaatctcaattttagatgaattttgcaagatgaatggcccaatttggagttcgtatgaattagttgagaattttagaagttttgagccatttaaatgaatttctagaattaaacttgattttttgtgctattattaattatttttcttaaaggaagtcaatggttattgcatcagcagtggggcgggtgtggaccgagtccaccaaaggtgggccccactcgtcagcggtacaaggggcagcaggccaccgtggaccaagtccacggcgtcgatcggacggtcgagggtggccgggcggcatagccagcgaggaaggcaaccgtgcaagcaaggcggctgcccgacaagcagcggagaggagagcggggagtagagaagggtgctctccgagcaccaacgacgaaaaaggcggtgcgcggaagctcagctgtgagagaccgaggcggcgctccacgaggaaaacggggagcgaagctccgacgacgaccggtggtcgtggaggagcgtccgagcacctccaagacctgctaaaggtggagaaggggttaggggaggaatgagaggcgtgaagcggcgtgaatcaccagccagaggaggaataaatggagaagctcaccggcaaacgcgtagggtaggtttttagcggtggaagacgacgaccgagcgatcgcctaggcgcggcggcgctgcggagccgaaagtggaggcgaagtcccccggcgtggtcccaaccgccagcaacgagcggctggagatggcaatggcgaaggtggctcggggtcgtggtttaagcggcgctcgggtggtggaatggagcatcggtgtggtggtcgggtgttggtattttttaatgatgttactagaaatataattcccagcaatggtgccaaaaatactcatggtatattatggttacagaattcatccgtaagcgcatggatataccattgtggcattttacctgagagtattctaagggtatcgtatttatttaatcccgtgggaagatcatggtagagagaacctgactaataatttatatgttactcgtaataatcatagtctaagcaggggttaatataatccaagggtagag

SEQ ID NO: 68739 - DNA, 1484 bp, Oryza sativa
caatcaaaatagacaccttacctacttttttcaaaagaaataaaaaacaacactaataaataatgaacatgattttagatgtagtaggtattattctggaatactcctcgtcggaaacatatggaacgcatttccctcaaaacgcaaaaaccggggccccgagccctcgacaccaaccccgtcggatgtgaagccgacggcccagatggaggccagcggtgccaatgcgtaggccacgcgtgcctctgcgcaaatcttatctcccgggaggctccgctccacttcccttcccgagtcactcaaaccatccaatccctccaccttcccttcccttgcccccattttccaccgccgccgcgccttgcccccattccccaccgccgcggtgcggccgccgacgacctccacacctcgagcacgcgtgccgccgacgaggtgcccttctctctctcactctcgtctcccccattcctcccctcttcccgtgtcccgtcgtccacagctccccgaccaaatccctagccctactattccccacccaccaggcctccctcgcgtggtcacgccgcacgatcgggcccgacagtgccgccgcttcttgccctactgccgcggttctttaagaggttgtcctgatttgctgcagcccagtaggtattgtatatttttctcgttggtaaatttggcagcaaaaaaaaaagtgtttaataccgaatgttataaacccgagcatctcatggtgtctatatatcagcatatatgatatgttaggattggtaaggatgcatatcacacgattacaattaccaactccacctcgaagataataagcccaatagtctaaccctaaaatccctccctacctgtccgttccttttctcaacgattcccagaagcgccgcttatcctcgagccgagtggccgacagcgccgcccaggagtcgaggagtcgtagctcgtagcgccacccttccttgtgcgcgcggttgtgccctttctcgccgccggtctccccgcttcacctcgcatcctcaacgtcaacagctgccatccgctcctcacgctggctatcgggaaggtcagtaggtcacgccgtctcctttcctacttgcctccggccaccctaagaccccaactcgcctgtttctcgcgcgaatcgtctagttacccggcgggcgacacccctactcccgggtggacgctcgtactcgtcgtcatgcttgccctgctttctttggctcacgagccaaacgagcccgctcgagctagacaactagccgagcctagcttgggtttctagctcgttaggataataggccgagcctagctagaccgagccgagctggatcgacatccaccccctacacgcgtgcctttgcccaaatcttatctcccgggaggctcacttctctcccgagtggctgcgacgaccttcgcagctcgagacgagtgccactttctcttctctctcttcatcccccatg

SEQ ID NO: 68740 - DNA, 32481 bp, Oryza sativa
tccatctgtgtccagtcggcgtgatcgggccgaggtacgtcgaagaagacatgatcggtgagggcgtattttccaagcgcgatgaggaaaaggcctcgccagcgggagtagtttttggcgtcgaggtcgagggtgacggggacgagcgccttcacgttgaggacggcgacggctttgctgtggaggttggcaacggcttcggcgtcaagcgccgccggtggcgcggcggcgtcctgcgtgggggcggccggcgtcgtggtgatgccgagacgggcgagaagcgccaggatctcggggggaagttgcgccgcgggagccggagtggaagccggtggcggcgggatggcggtcgtcgaaggcgcggtcgtcggaggaaccggtggaggcaccgtggaggagtcgtcggaaggagaccgaggataacaggggcgagggccgcccgggccacggtcgcggcacgatcggtggcgtcgccagcgacggcggtggtcagggtgtcgtcgtcctgaccagagggagccttgaaggaggagcggacggcatcggcgatgattttgatggtgtcatcaaggacggcgtcggcagtgagggaggagggaggagaagccatggcggcggcagggtgcgccggccggcggctggggtggagaggaggcggaagcgagaaggaacctaatctgaggacgcccccgtcgatcaaccccaggccaggaacgtcccctcttggccacgtccgtgtgtccagtgccagcgcatgtgccatgctgtatgaccactcccggtccacaccaaccatactcccgtgaaaccgcgagagtcagctctgataccattttgtaacgacccgcctttcccaggctaggcccacttacatctggtagctttcataggtcataagactgtcctcacagaccaacacaagtcttttctacgcactttgtcctcactcatgcgcactcgggaagaattttctggtcggtcacccatccttaaattgctccagaccaagcacgcttaacctcagagttctttagagatcggcttccgaaaaagaagttgcaatttgttgatatgagtattctagtaatcctattaagccctagaccgggatgttacaccctcaccccttacaaagaatctcgtcccgagattcggaacggctagaaagaaaagggcattggtcaactgcagtctatcttattccataactatgataattattctaaggctttaaagaaaactactgctgctttgagactggtggctgagctgtaacacttgaagatgcaactggcactacattggctcctgtgacgacaaagatgtcgatggggtctacttatggaggccaagtcaagtggatcgagggacatgaagatgatggtcgaactaaagtgtccagctgtcaagatggaatgaagtttggatcctagcttagaacctaaaccaccaaattgactttgaagaatagttagtagggtagaacgtttgttgcttgcttgtgtgtaggtaaggttgcattcccatcattggtgtagttcaatgatgagcgtgtaactatattaggttgcttgcttaatcaacttaaacaatataatggtttacacacactagatcaatgttaacatggttaaggtcttgtctttagtgtcacccctctccttctatcttctccaaacctatagcagatggtgaacacttgcgctagtggaagtggaaacaataacaatgatgagaacccaactcttgctcaagttctagctcaacagactcagttaatgaacataatgatgcagcagatgcagaaccagctcaaccaagggaacgacaatcctccaacgccacagaacaagttagctgacttttcttcgtgtgaggccgcctaccttttctagcaccaccaacccagtggaagtaggtgattggctatacactattgagaagaggttggaattgctccagtgcacagatcaggagaaagttgttttcgcttcacatcagttgcatagacctgcttcagaatggtgggatcacttccggatgaacagagcagaaggacaaccaatcacttgggaagagtttactgaaggattcaagaagacacacatacctacaggagtagttgctttgaagaagcgtgagttcaggacattaaagcaaaaggatcgtaccgtgacagagtatcttcatgagttcaaccgtctagcacgttatgttccagaagatgtgcgtactgacaaggaaaggcaggagaagttcttagaaggcctgaaggatgaactatcaattacgttgatttctcatgactatgctgatttccaagagctggttgacaaagcaatttgacttgaagtcaagaagaacaggatggacaaccgtaagagaagactgattgttttcaaggaagcacagggtactagccaaaggcagtgtatcaagcaatcccaagttgatgaatcaagtctaacatctcaagaacagtcgcaacagttgaacatcggtgatgagatcaattcagagactaatgcaagcaatgaagttaacatcaagcaagctactcaatcagtgccagttcagcagaaccagtctcaagaaaataatagtagtggaatggaagggagcagcaggtatgtttcaactgttacaagccatgtcactttgcaagagagtgttcgaagccaaagcatcagcagccgcaaggtcaagtcaacaacattgtcgtcacaggagccaatgcagtgcaagttgcgtcttcaagtgttacagctcaaccaccagtttcaaagcagtagtagttttctttaaagccttagaataattatcagacttatggaataagatagactgcagtttacctatgcccttttctttctagccgttccgaatctcgggacgagattctttgtaaggggggtagatttgtcacagcctgaattttcgtttcaagatttataaattatttaataaattattaatagaatttatattaaatgttcattaatttacaagtgaagtgaaatgtgggaaatcaaatttcctaattataaagcatgggtggatttaatttttattaaattctccatgattaattatactctctgaaattttctcggatttttcggagctcaattattaattttaataatacaaagaacatttcagtaattattcacatattaaattaatcattaatgagctggtttcaatgtttttaaatacttagggtgtccaagtatgttcaagatttttcttggaattatttgaccattggaagtatttttaacaatcgaaagatcatcttattggttaatttatttggaaaagtaataaaatcttcatcctcagcttgggcccttttcagcccattctctcccttcctctcagcccgcagacaagtctgcttttcgtccctctcgctacagtgttgtcttcaacccctagacagagccgactgtctccagcccgtgcacagttgccgccgcctcctccttccaaatccggcctctccgttgctcctttttccaaattagttgtgggaatggaatcctctcaatctcctcttccttttccccaagaaatccccaaaatttctatggaaatcctttccaatttcgcggatcaatctttcctttttccggcgaagatcctaaactttcccgagtttttcccgtcgatttgggcccgaacccgagctcctgtgcctatataaaggaccccctcgtcgtcctctacctatcccctcaagttccatcttccgccgtcgtcggaatcgctctccccgcgctcttcttctctctccaagcgccggcgccgctccagccgcccctagccgtcgcttcggtcgtcgccgtcggtcgccgtctccttcatcagcatcgcgaggtcgtcgccgtcctcgtcccgtcctccgtttccgccgaagatcgccagagcgccgctgacactgtcaacccgaagctcgccgccgcattttgatctccggcgaggccactgctgctccttccgtcgtcgccaagctttgccgtcgcctccattggattcgcagctgcgaagtgaagcccggccacccctccgttgttgccgcacatcgccggaaagtcgtcgccgccgtggacagtacctcgccgcccttcgaagctcgtcgccggccatcttccgtcgctgtccgtcatcgcgtaagtgttggtaaggaccgtcgtctcgtgctcttcctcccggtgccctccgtttgcattattgtgccgtggttcgccggcaaccgctgcccctatgccgttcaccggtgtaggtttttccctagggtcttaatccaacataatctaatccgtgatttgtctagcgttgtcatctccgtgtgttgtagccggaccgtcattgtcgaccctttctctctgatcgctttggttcggtgagacttctatccgttctcttttttcagtggcatattatttctttttaatatatgccatctactaaatataacctaatcttttctgaatgttgctttaatcttttcttaattataaatcatttgtaaattgtttaattaatttggaatagttttttctttaataggtttaattggaattaaatcttataaaattcataagtaatttatatgaaatcggaatgaggccgttcaagtctcataattcatctaaaatcatgatctacatgtttatttactttatatgtattgtttatttggtttttattagtctttttccttgttttatgtgttagcttgtcgtttcgaaggatcgtgagtgcgtcggaagtgttcaagaagattaattgaagaccgaatattgcaaggcaagtcacatagatcccaaacacaattcctttgagcatgttgatcctatatttaaattctctatttatttcaagtatacatctattttcgaatgtcaccgggtggtgtgaacctatttctttgttatggccaatttacattgattatcctatttcttgattacctcggggtataatttgactagttgtatttatatattggttcaactagatacattagatataattgcttagccatgtttagaaacattagcacactattgggataactaatgtttcacatttacttaatgataactaatgttttgctattacttaatgattggttaattaattaatgtgccaactaaaacttgataatggtgggttgtgagcacatgattttgatggtcgtgctcatgacaattaaggaccggttcacgagtttcggttgtgaaacattaaccgtgccaaacacaagccagcataggcaacggctggacactttgtatagcaaggctcattgtggtgtgccagactgagaagtggcggagataagcccacgggggtcgctggggagtctatgcctttggtttttgagggggtgactacgatccaggaaaggtgcgctgctttgagttgagctatgcgaggggtcttgtcacaactacacaaatggtgacatgttcagcatgggcacatgatgatatggtgacatattatggagttgtgtcttgtgggtacagtggtacacctctggccagagtaaaactattcgaatagccgtgcccgcggttatgggcgggtctaacaatgtctttcgtgattagtctcacactactcattaataataatgtggtaattgatggtaattaatttagctcctggtttggaatggtacattcctggtttagagatagatctgtacagccgtgtatagttgttcaggatggttgggcctgtgcagcatgggtgtgcagttcagtgttaattaatattgatgattaattactctactgttttagaattctcaaatgttttgctaaatgctgcttttgcaaatgagctatatattatgccattctttggtatccttgtgcacttgcatatttgttgtgtggcttgctgagtatgtcatatgcccacattgcaataatcaatcgaacctcagttgaagacaagttgcgaaggagaagacgtttggcttgtaccccagttgagctacttgtggtagtggatgtcacgccctgaagtttccccctttttccttgctttaaaaatttgttaaataaatcgtccgaagaaattgtcttaattaacctagagctaaatccctaattaataaaggcatttaataattggaattggcaatgtgggattttccttgagttccacatgtcacaatacattaacaggattgatttttagtgaaattttcagagccttggaaataattttaaccaattaaaaatcaccaaagtgcaattttaaatcccaggaaaaatcctttcccctttttccctttttcgcttttcttttcctctttttccatctttttgggccgtcggcccagtccaccccccctttttctcctacccgcgctcggccttcctcttgttgggtcagcccatgcgcccctccctcctctctctgggacgccgataggtgggccccacctgtcggtcgtctcccacctccggccgttggagccggagctccaaccgctgccgccgaaaccgccgcgccgccgcctcctccgctcctcccgtgcccacgccgcgtcgctcccgcgtcctccccacgtcgccgccctctcccccgcatctcccggcccgcgcgcgcgctcgctaggggcgggattcgaatttgaatccccccattctctctctctccacccccacgtcgccggccaaatcggccacctccccggccacgtccgccccctcccgcacctataaatcgctccccgcgtccccctctctcgtttttcgcactcgctgcgcccttccgtgcttcctatcctcgccgcgccgctcgccccttgcgccgccgcctaccgccgtctccggccacgcgccgccgccactatagccaccaccgcgccgcgcagtcgctgccgtcgcgctcaccgagcccgcccgcacctcggccgccgcttcgttgccgcaaatcaccgccggagctccgattccctcgcgtcgccggtgagctctccattttcatccatctccggccggccactttggccgccgtggtcgctctccctactcctaacccctcacctccccttctctaggtgccgccgccacccgtccgccgtccgtgtcgccggtcgtcgccggccgccaccgcctcctctggtgaggactcccctcctccctccttccctatgtgccgcacgcgccgcagctctctgtgctcgccatcgccttcggccgccgccgccagcctgtgcgccgtccgccgccgcctcccgcaccgccgcttgttgttgccggcgctcgcgcgccgccgccggtcgccatggccgccggtcggcttcgaagccgagccgagccaaccgggcacccttcctctcctcttgtgccgctgcccggtggggcccaccagctggtggaccccccttttagccgctgccggtggggcccgcgtgccgtcgccacctcccccccttttagagccgctgacccatggggcccacttgccggcgccgcccccctccttggctgacgtcagccctgggtattattgcgcaataaattgattaaggactttttctttattagtaaaaacacagttttatcttctaaaattcataagtaattcatccgagctccgtttaagtccattcaagtctcagtaaattcataaaaatgcaaagaatccattaaaaatggttttgtttcctgtttcattagtcttatagcatgttttgcttgtgtactttgtttgtcgcgtagatttcggccgtttcgtcgatccgcggtttctcgaagacgttgctgaggtctcatcagtgcgagagcaacgcaagtcatgcattacaattgatcatattgtacccaatttacaaatatcccgcatttctattaaatgtcgcattcttttacaatgtcatatgggatgggtcctattactcagccatttattgtttaccatatgccattaataacttgggtatcaaaatgattagatgttggtttaggaaatgcttagccatgcttagctccactagtacacaaatggggatcacattattacatagactttgactatgagcatagttttggattggtgccaccgcaatggtgttagttaattaaaatacactgaatggtgggctgtgggtgcatggttttgctggtcgcacccatggcaattaaagaccggttcacgggaaaccctgggagacttaccgtgcttaccacaagcgagagtgggtaactgcttgatctgaagtatagctcgaccctttcctaggcaccggtggcgagggtgggcgtaatggagttgggtcggccagggtgtccggttgtccagctgccagattcaccgcggcgcaagaggggaccgcccactgcccgttgggggtggaggtgaaaccttagcgtggtgtggatggttaggggagggttatgcggagggtcttgtcacgatttccccctttgcagtattatggtgatacttcggggcatggtgacatgtgtggaatcgtgtcttgtgggtacagttgtacatctctggacagagtaaaactattcgaatagccgtgcccgcggttatgggcgatcaaccagattcaccgtgattagtctcacccctagtttagcttaatgaactagtgtagttcaggtggttggttgggcctgttgcaacgtggtgtagcgttggacagtgattggttaatattgattaattactacagttgttttactgctttcaactactgcttttaaatgctagttttatgcaaaagaacccctagcctcctttggttatatcctgcatcatacctcctcttccggtatgacttgctgagtacagtgggtagtactcagtcttgctctcttttcccccacaccagagttgaagttcttctcagttggagctgtctcagaggggttggtttcgtcgctgccgtcaaggtttgcctatggagtggagtcgcccgctgctgaagtcaagcttccaaggctagctcgttttatcttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacagtggagccggagcttcgctagatcgttattccgctgctattttctcttttcatttgtaagtatgtaacgttgtattattgatgaatctgtatattaaattgtcagcttgtgtacctcggctgattcctggacgagggttttatgcacaaattagttcggaaattactagtgaatttctgggcgtgacaagttggtaccataataaatggcgtcgtcgtcgtctccatgtgttgccgccggttcaccgtcgtcatctattcctctccgatcgctttggttcggtgagacgtctatccgtgttccctcggtttagtttttaatctctcgtttgtgtcgtcgagtagccgccgccgtgccacgcttagctgctgccctagcgtcgccactgcactagccgcctagtcgtcgctgtgccgctccctgctacagccgtgctgctgctgctcgtgcgtgacaagtcgctgccgtcccgctaccgtagccaccatctgccgtcgctgtgtgtcgtcgtcgctgtgatgtcgccctaacccgagccgcgtgtctccgccgagtcaccgccgcctggccgagccaagtcgccctagtgccgccgtgtcgcagctgtgtgccgctttaacctagccgccgctttaaccgttgctcggtagtcaagttgtctagccgtaggtgcatccctaaattcctaccggcctatcgtttgccgtaccggggctttaccgtgaatcgtttctagcccaccggtttagccgcagccattgttgagtcgttcgctcgttcgttcgaacgaggtgttacccgtgcttcgttcgtttgtccgtgttgagtcgtcctttagtttagagccgtttagagccgccggttccgttcgccggtttcggttgatcatttgggtaatcccgtgtcacgtagaattgactcgttgagtcggtatctcgtgaggctcgcttgccagatcaatctaagccatccgttgaatcttggtcaactctatgtcaagattaatcttagccctccaaaatcgatataaatatgttctctcttttcagtggcatattatttctttttaatatatatcatctaccaaatataatctaatctatttccagaggttgctttaatgttttatctcagttataaatcatttgtaaatgatttaattaatgtggaatagtctttttctttaataggtttaattggaattaaatcttataaaattcgtaactagttcatatgaaatcggaatgaggccgttcaagtctcataattaatctaaaatcatgatctacatgtttgtttactttatatgtactgtttatttggagtttcttagtctttttccacgttttgcgtgttagcttgtcgtttccatcgtttcgaaagtccgtgagtgcgtcgggagtattcaagaagattaattgaagaccatttattgcaaggcaagttacacagatcccaaacacaattcctttgaacatgttgatcctatatttaaattctctatttatttcaactgtgcatttattttcgaatgtcaccgggtggtgtgaaactatacctttgttatggccactttgcattgattactctgtcctttgataccttgggttacaatttgactagttgagctttatatattggttcagctagatatattagatataattgcttaggcatgcttagaaacagtagcacacgattgggataactaatgtttcactattacctaatgatggatatttaatcatagctcacgatggctaatcgtgattggttaattaattaatgtgccaactaaaacctgataatggtgggttgtgagcacatggttttgttggtcgtgctcatgacaattaaggaccagttcacgagtttcggttgtgaaacattaaccgtgccaaccacaagccagcataggcaacgactttaccttttgtatagcatggttcattgcggggcaccagactgagaagtggcggagataagcccacgggggtcgctggggagtccatgccttgtttataagggggtgattatgatccaggaacggtgcgctgtggtggattgtgttgtgcgaggggtactgtcacaactcctttcagaggtaccgtggtggtattgaggcgcatggtgacatgtcgtggggctgtgtcttgtgggtacagtggtacacctctggccagagtaaaactattcgaatagccgtgcccgcggttatgggcggggtctaacaatgtctttcgtgattagtctcacactactcaccataataaatgatgctatcactggtaataattcatggtatcagattaggttccttctcgcttccacctcctctccaccccagccgccggtcggcgcaccctgccgccgccatggcttctccctcctccctcactgttgacgccgtccttgatgacaccattaaaatcatcgccgacgccgtccgctcctccttcaaggctccctctggttaggacgacgacaccctgaccaccgccgtcgctggcaccgctgccgatcgtgccgcgaccgcggcccgagcggcccttgcccctgttctcctcggtctccttccgacgactccggccgccgatgacgccatctcctccacggtgcctccaccggttccttcgatgactgcgccttcgacgaccgccatcccgccgccgccgacttccactccggctcccgcggcgcaacttccccccgagatcctggcgcttctcgcccgtctcagcatcaccacgacgccggccgcccccacgcaggacgccaccgcgcaaccgccggcgctcgacgccgccgcaccaccgccggcgctcgacgccgaagccgtcgccaacctccacagccaagccgtcgccgtcctcaacgtgaaggcgctcgtccccgtcaccctcgacctcgacgccaacaactactcccgctggcaaggccttttcctcgtcgcgcttggaaaatacgccctcaccgatcatgtcttctccgacgtacctcgccctgatcacgccgactggacacagatggactgcgtcgtcctcagctggctctacggctccatctcctctactcttatgcaggaggtgctctctcccacggcgacggcatgctccgtctggcacagactgcaccacgggtcaaccaggcctggcccacggcctacaacccgtggacaaggagcatccacatgtggccggtccaggcctccttggcgcgcggcctagcttcgccgggacagccttcaccaccacgcccgcgccggcccagcagcaagccttcctcccgccggcctatatggctcttcctaggccggcccagtacactgcaccaagcacggcgcctccaactcttgttgccgctgtgcaatctccattccagtggacggggccctcacagtgggacccacgggccctcgccaacgcgtacaacacggccacattaactactccaccgtccaatgaatggtacatggactcaggtgctacttctcatatgacgtctgacaccggtaccctctccacttcccaaagccccacccgcaatactccctctcatactattgttggcaatagctcccttctccctattacctccgttggtcacgcatatttacattaccccaattcttcctttgtgcttaacaatgttctcatttctcctgagattattaagagccttatttccgcacgccgttttacttgtgataattggtgttccgttgaacttgacccttttggcctctctgtgaaggattacccaaccaagatcgagatcgtcaggtgcaatagttcctgtgctctttatcctctcccggcagatgcgtactcctcggcggcctccactcgtgcctttgtcgcctcctccaccaacaccgacctatggcatcgccaccttggccacctcggtcatgaggccctcacccacttggcgtaggcgtctgttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatccttttcttctttttcttttccctccctttttcctcctttttcttttcggatgggccgccggcccattcccctccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgtctccgccttctccgggccacgtcgaccacgcccgcgcgtgcgccgcattccccgcgcccgttcccctctctctcccgctcgcgcccgcgcccgagatggctgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatggatcccgatcgccatggtccatctctctctctctaatccctctcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctcctagagccgctagccgccgcttcgagtcgtcggccgtcgccttcgactgccgccgccgtttcccgtgccgccggtagccgccgtcgtcgcacgcgtgccgtcgccgtttaacccagccggccggtcggctttgatgccgagccgcgccggcggccgcatttaccgcgcgccccggccgcgaggtccccgtcgccgtcggttcggccgccacgtggcgccgccgcccctccttttccccgtgccactgaccagtgggcccgcgcgccgccaccccctttctctctctcccggtcgctgaccggtgggccccgcatgtcggcgccgcgccccctcgctgacgtcagccctggttaatattgcgcaataaattatttaaggatttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatccctccgacgctccagtgtacttcgagatagtcgccgaggtccctccagcagcagagcaaggcaagtcatgcttgtcatttgaacatgttgatcctatattgcaaatgctctattgttttctttcaaatattgcattgttttataatattactatgggatggatacctattgttacagccatgcttttggatatcatgctcctttgttagcttgggttataacatgattagactttggactaggaattgcttagccatgcttagttcaactagcacacagtggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaaccgttttcgcattcaattcctgtttataaatgctagtttttatgcaaatgaaccactctagctcttctttgttaattccctgcatcatacccctattccggtatgacttgctgagtacagtgggtagtactcagtcttgctctacttttcccccaacctcagagctcgagtatgtgtccgatggcgggttctccgaggagtaggcttcgtccgtgccgtcgaggatgcctgtggagtggtgttcccgctgcagttcaagtcaaggcttagctcccgtttcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacatctgtcatcccaccacctaaagtcactacatctttatgtcatgcttctcagttaggtcgtcatgttcgtcttccttttcccactagctctagtcgggccaaggcaaattttgatttagtgcattgtgatttgtggacatcacctattcctagtgtgtctggttttaagtattatcttgtcattcttgatgattgctcacattatgtgtggacctttccacttcgctttaaatccgacacattctccacattatctcatttttttgcctttgtgaagacacagtttgccacgaccattcacagcatccaatgtgacaatggtagggagtttgacaattcctccgcccgctcctttttcctcaccaatggagtctccttgcggatgtcctgccctcacacctccccacagaatggtaaggccgagcgcatgcttcgttccttgaacaacatcacccgctccttgctcttccaagccaaccttcccgctccctactaggtcgaggcccttcacaccaccacacaccttatcaaccgtcatcccaccaaaactcttcaacaccacacccccttttttgccctatatggtgctcacccgtcctactcccacctccgcgtgttcggctataagtgttatcctaacctcttcgccaccgctccccataaactagccccacgatccaccccatgtgtgttcctaggctatccctccaccataaagggtatcggtgtctagaccttaccaccaacaaggtcatcacctcgcgacatgtggtgttcgatgagacatgttgtaacgccccgattttcgttcgggaataaaaatcaattaataatacattttctagaaattaaataaaagttaaaccaatttaatcaagtggaattatagaggaaatttgaaattttcctttaaaaatcattggtcgggaatattttgtaatattctttgcgccctaatgtactctccagaattttccgtgaattttcggagctcgagaaatagttttaatagcacaaagatcattgcatcaattaaaataaaaaaaaacaattaaaattccacttcctctctttgggcctttttcggcccaagtcttccttccctcccgcggcccgcgcgccccttttctctccctctcgggccggcctcctccctcggcccgctcggctctctctctccctcaagtctgctttacctccctcgcccgttttcccctctctctcgtcccacctgtcatcttcttccctaacctcccgtcaccccaatggccgtcatggccgccggtttcgccccacgacgccgcggttcccgcgcttcaccccgccccacgagcgcgtggaatcgatcccctccacctcctccacttttcccccactctccccgcgaaaatcggcgccggttaacccctccaccaccccacgtcggcgccccacttcgccggccgattccgccacgtccggcctcgatcccgccttcccgagcccataaaaagcacccccgtgctcccctcgtccatttccccttgtttcccgggcccggcactctctccctcgctcttccccacgccgctcccgcgcgccgccacactccggcgaactccggccgccgtttcccgtcactagggtcgccgccgccctgctccgccgccaccgccagctttgccgccgcccgggcaagctcggccaccgctccatttcccctctccacctccgtagcgccgtagccacgcgaaccacctctctccgctgccgcccccgactccagccgcgtcgcgccgccgcttcggtcgacgccgacccgcgccgttgcctccctcagctccgcaaggacgaggaggacctcggccgccgcccctcttcgccggaaatccgccggagctcctccttcctcggtcgccgatcgaggccgagcccgtccgccccatcccgagcgacgcccgtcgccggagctccgtcacgtcgtcttcctgaggagccccgtcgccaccgttccttgccgtcggccgcccctttgccgtcgtgcatctcggtgagcactcccctccctctcccttttcctccccttcgttggccgcttcccgggcgtcctcgcgacgcgctgccgccgccggtggccgtccgaccgggtcgctgccgccgcgctccgcgctccgtgcccgcgccgttgccggtggtgccgggcagccggttgccgcctcccccttgccgccgccgcgccttggctcggccgggccggcttcgtgccgcgcctgtgcccctggctgccgctcccctcggccgcccgatcggctcaggccgatctgggccatccacgtggtggacgcgcacccgaggccacgtgtggaccatgtccaccgtgcgccctccccctttgactcgctgacatgtggggcccgcgtgtcggcgctggccgcccctttgctgatgtcagcgaggtccatttcctctgtaaaaataaataataattgcgcaataaatcgagtttaattctagaaattcatttaaatggctcaaaacttctaaaattcatatctaattcattcgaactccgaattgagccgttcaacttgcaaaattcatctaaaattgagctctacatgtttgtttactttttatgtactgtttgtgtcacgcccagaaattcactagtaatttccgaacttatttgtgcatgaaatcctcgtccaggaatcagccgaggtacacaaactgacaatttaatatacagattcatcaaattaactaaaccgataaatacttacttaagaggcacttagtcctcaccaagaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatttccgccacttctcagtctggtgctccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacggttgaccatcgtgagctaccattaaatataaccataagtgatagtgaaacattagttatcccaaatatgtgctaatgtttctaagcatggctaagcaatcatagctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttaaacaacttttgcaacttgaaccacattaaactgagttaagatgaattagatatgaatttttaaagattaaatcggattaaaacacttaaatcggtttaaattgaattatgacgcaataatgaattatttttgaaaaggaaaaggggattattgcgtcagcggctagggtttcggtggaccgggcgcacgggcggcggttcacgcgaacggacggccgagatcgaaccaatccaaaacggacggccgagatcgatcgggtccacggcggctcacggcggacgactccgatgacgtcagcgatgacgtcaccaccggcggcggcggctcggcggctcgggctcacacgctcgccggcgaacggcggcgcggcggcgcgaacggaaagcaccgggatgaagcggacgacaaggcgaactcaccggtgaccaaaggaacggcggaaaagcaacggacgacgccggcgacgaggaggaagcggcgaagctcttcggcttgacgacggcgacggcgctccggcggtcaacagcgacggcgaagcggcggacggggacggcggcgacttggcgatcccgacggtggccttcccgagtgacgacgacgaccgtagcgacggcggcgcacggctagacgaacggcggcgacggcggcgcaaaagctcccgaggctagggcgctacacacgacggcgggcgaaggcgagggaggcgacgggtagaggagagcttgggggtccttataaaggggctagcgagcggcgacggaggcccacggcgaccggcggcgagaaggaaactttagggtttgggagagagaggaatccgattcgatctcgattccatcgagtttccaaaccgaattgaccggagattccaaaagagaaaaggaagaggagatcgagaagatcatttcccctctaaagatttcaccggagaaggaaagaatcgagcggatttggaaggagaaggcggcggcggcgcgctagggttcgcgggcggcggcggcgacgcgaggaagacggatccgacaagcggggcccacctgtcagcgaccgaacgcgcgcgcgcggctgcggactgggccggctgggccgaggagggagagaagagaggttttgggccggctttcggcccaaagccaaaagaagacttttaaaacctttttcaatttaaattatttcttaaatgcaattccatttattaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctcttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacattttacttcacttgtaaattaaagaacatttaacaaaaattctattaataatttattaaataatttataaatcctgaaacgaaaatcaggatgtgacagtttgcttggtttttattagagtttttcctcgttttgcgtgccaacgtgtagttcccgacgtttcggaagatcgcggtcgcaaggataagagttcggaagattgtttgaagaagcaaggcaagtcacacattccccttgagcatgttgatcctaatttacaaatcttttactgtttgcaaataaatatgcatgttttgctaattacacgggatcagggtttacctatctgctcgcttgtgccatgtttacttgatatctatcatttgtcaaccttgggtaataaatcgactagctcatgttacttatgtgacccagctagaactatatgcttagcgatgcttatttaccactagctcagttgatgggataattacagtattagacctttttagtatcagagtgagctgcgtgctcgagacatctggccatgcttcatggtcgtaattatccaactaaaatgcgactgaatagtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaagctattcgaatagccgtgcccgcggttatgggcggtcgaccagattcaccgtgattagtcccatcttaataaatcgacccaatacactgtaattcaggtgggttggttgggcctgttcaacgtggtgtagcgttgatcagtggagtttttaatgttactttaattacccaatagttttactgttttgctcaataaaatattttacaactgcctttatgcaaatagccacaaacccctccttgtatccccttgcacgtctgcatcgttggtgtggcttgctgagtacggtggttgtactcagtcttgctattattccccctttttcagaagtgtagtgcttttgatctgaagatggagttagaggaccaaggctcagaccccagttgagttttgcctgtggagtggagctgaagccccgctaggatcgcctttttccgctgctgtcgttctgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacacatgttttccttttgctgagatgactaatgatgcagttgctactgacttgaagtttcttgaggatttttcagctcctctccctgcgccgattggcagtcgccgccgccctggtcacactgacccggtggcctgcacgcccacggccctcaccgagcatagccgctctcggccggccgctccaccaactgggccggccactccaccaactgggccggccgctcgcagcttccccgcacaggcttcggtgcgctcaaccactgctgggccgtcgggcccaaccgtcactcctactcggtcggctggtgtgccgaccggaccgcctgcccctcggtcgccctggtcagctggcgcaccgactgggctgtctttacttgcgcctgcctggtcagccggcgtgcccatcgagctggctcccctaccgacgcctgcttcgttggccagcgcgcccaccgagtgagctcccctgctaccaccaccgactggtgctgccacacgcgcccgcagtgcgcgtgtccccggcattcgattgccaacgcagctcggcatctctcccatcatcaatgagcacaccatgacgacacgcggcaagcacggacttcaccaacccgtcaagcgctacaacttgagtgccaccactctctctccagttccgcgcacatatcgtgccgcactggccgaccccaattggcggtccgccatggaggaagagttcactgcgctgcaggccaaccgtacatgggacttggtcccccgcccaaatggcgccaatgtcgtcaccggcaagtggatcttccgctacaagttccagtccgacggcagcctggacaggtacaaggctcgctgggtccttcgcggcttcacgcagcgccccggcatcgacttcgacgagattttcagccctgtcatcaagcctgccacagtccgcactgtcctcagcttggcggtctcccgcgattggccagttcaccagctggatgtgaagaatgccttcctccataggacacttcaggagacagtctactgcactcagcccgccggctttgttgaccccaccaagcccgaccttgtgtgccgtctcaacaagtcgctctatggtctcaagcaggccccacgggcatggtacagccggtttgccagctttctccttacactcggctttgttgaggcaaaatcagatacatctttgttcatctaccgtcgaggctcagacacggtttacttgctcctctatgttgatgacattgttctgacagcctcctctgatgcacttcttcggtggaccatccgtgctctccagtcggagttctcgatgaaggatcttggcagcttgcatcatttcttgggcatctctatttctcggcagtcctctggtcttcatctcagtcaacgccagtactgcctcgaggttctggagcgtgctggcatgacagattgcaagccatgtgctacccctgttgacaccaacgccaagctctctgccgctgatggtgccccagttcgtgatcccacggactatcggagtctttctggcgccctctagtacctgactttcaccaggccagatatctcttatgctgtccagcaggtctgtcttcacatgcacgatccacgggagcctcatcttgctgctctcaaatgcatcttgcgttatgtccgtggcacggttgattatggtcttcacatccgccgctcctccactgttgacttgagtgcatactctgatgctgattggatgagtgcatactctgatgctgattgggcaggttgtccagacaccaggaaatccacctcgggttatggtgtgttccttggcgacaacttggtctcctggtcctccaaacgtcagcttactgtatcgcgctccagtgccgaggcagaatattgtgccgtggccaacgcggtggctgaaacttgctggcttcgacagcttcttcatgagctccatacccctccgagccgatccacattggttttctgtgacaatattagtgctgtctatctctcttctaacccggtgcaacatcagcgtactaagcatgtgaagatcgatctacatttcgttcgcgatcgcgtcgctgcgggatctgttcgagtgctacatgtacctactacgtcacagtttgccgacatcttcaccaaagggttgcccagtgccatcttcttggagtttcggtccagtctgaatgtccgttcccacgacgttccgactgcggggggtgttagattgtgtttatcccttgccatccttccttaatcttctccgatattgtttctataaatcggttgctagatatggaaggcatgtgcctatatgtactctaccatatgtgataatccaatctatcgtgttgagcctgtcgtcgatgacggtccagctctcgtcgccaggcttggcaatggcgcgcaccgtgggatcggagaaatcgactgccactactgtggaggcatcctcgacgacaaaaccggcggcgttcacgcgaagacccacgccatgggcgcccaaacgccagctcgctcgtcggcgccactccggtgtcaggagcgctgtcaccggcgggaggtcggtgcggtggcgggtgagcgggttcaggaggtggaggcggaggctgggctcgtggagcagcagcaggaggccctccggcgtgagcgccagcatcgtgtggtcggcgagctccgggatgtcgtccgtgtggatgcacccgccggtggagacgttgagaaagcggtggcggcggtgggtggcggcggcagtggtgcccttattgtggtgggccttgtcgagcatgatccagtgacgagggaggaagcggctgtctaggccaccatcttgcgggcgcgggtgcagcgaggaggagagccgccacgggcggcacacggcacggaagcggacgtaatcggcgacgtcgttggcgagggtgagctccgcgatcttgccggccggcccgtccccgaggttcgtccagtcccttgtgccagttttgctattgtggttgatagagcttggtagcgagcgcctgggcaccaccaccgccaccgcctgctcattgccgccggctggcgtggggcgggagcgtttcgcctgggttctcgctggttcggtggaggcgcaagctccccgcggcgattgtgacttattgaactggctggctggtcgcttttccatcccaccgctgcaatccatcggacaccggcgaattaggggattagacgtagcttctccctttgtgcaggcgaagaagggcgcggtgaggggaggatggatcggcgtcggcgtcggctggagacgtaactctggtatttggtattgccctagtttaggtcacaactttttctttaaacttttaatttatccatcatatcaaatctttcctgcatacataaacttcaaacttttataaacttccaacttttttcttcaaacttttaattttagtcaaacttctaattttaacgttaaactaaacacatagattatcgagtcgagacgagtctttaattaacgtggttattatttattgtcgttgggggtcggactcgcgatgcgcgtcggatcgatcctcggatcgggtggtcagtcgtatccgaggttcgagcaatcaccggcaagttcttttctccccacatgtttcctcccaagagaggctgatgcggcagcggccgttgacggcacatgcagggatccacggcgctgtggatcagggtggtcgatcggatcctgagaggatgcaacgttgggcgttgagacgatgtgttggatctgtggacatgactcttcatcatcaagcctcctgctccgccgccactggacccgaccacgtcgccggtcaaggaaggaagggatgacgacagcggctccttttctccatcttattcatcgaccacagcagcaaagagctgacacggatgtgtatgtgggaaagtttgtttctttgcaaatgtttttcacctacatgtaaaaacatttactaattgaataatcaaaattttaatatttgatcaatgacgtataacggaatacacatacgtcaacttttgaaatagtcatccgatcgatttgtgaggctatagaaacgtgtacacaatgacgcatgcagcgaacacaacctagttcaatactatatataatttctgattttgttttgtctttattttgtttctcttgtttcagtttatcgtttaaattagcagagtttttatcgatcgtaaaaattattttcgcatgttacaacgcacatgcattctactagtaataacaacatgtaatcagatagtttaactgctcatggttcagattaataaatattgatttaatactcaaaagagtggtctttcctatatagtgcgctgcaaattataagtagttattgcaattttattggagaatcagcaggaaaaatcgggcgcctctatcgcgcctccagctcgcgcgctgcaagcctctagctcaggtgccgcccccaccacacaccctagcacacacgccgttgcaatatatcacccacatattttagaaaccatctattaagagaattcgtttcagtttgtttccacaaaaaatgtttcatctagtgtactacaatgtttcactatgtatagatctaatgctgcagtggattgaaacattcttttgcaacaaatcacccacatattatggaaaccgaattcatttcatttttttccacaaaaaatatttcacctagtgtacttataatgtttcattatgtatggatcaaatgttgtagtgaactgaaacattatttcgctatttgatgaaacattatttttatataaggtgaaacggcgcccgatttaaatgattgaaatattttcgatttaaaacaatttcaatatacttggtgcaacaacgtgcaacatttaaaaataattcaataataagctaaaaaagttttcgtcggaatatatccatgtgtagtcttgttttaaagatttaattgcaacgaatttaatagtgcaattggatcatgatttggataaataatttaaaataaaaaaatagtttaaaatagttttgcgcgcatacatcttgctgacgtcatgctgacgtcaacatgacgtgggcgcccgattttcccaccccggatcgggcgcctgacgtgtagttgcctcccattttattgcttagagtgatgggtttctttttacaaagacacggagtcatcttttcccctcctcttcatttacattctctaggtcaaatatgaaaaattgcacccttctatttgcctaacaggccacacacaatttccttccaaagcccaaaatgtacggtttccgtcggcctaaactgcgaggttttcatttttccatcttcaagccaattcaattctgtctctcttatctgaagcaaggttttcattttcagttttgctcaaaaattcggccatgtcggtagcatcgaaattcccaaatttttgggattttgaagacttattggatcaaaattatttaaatttttaagacaatttgactagatttgaataaattttgatcaaattcaaagaaaaagaaaagaaaaaacaaaagtttcagctgagataatgacttgcccgaggttaccgaaattgtttttcactgatccaaagtagaatattagcagtaacaaaggaaaacgcttctgccgataaaggctccatttggatattgggttatacctattgggaaaagaaaatgatatgctggtagattgaggtgggagattatatgaaagaaagtcatatcccatgtttggtttgatggatgggaaatggaagtttctagagaaatgaccaaaatacccctccctacaataagtggtataacattcaaatgcagccaacgatcacataatatatacatgcacctcaccatcttcgagagccttcgtcccacgcgaggatctcggtggattgctgccagctgcttacaccaaagagcaccctcagatttgatgctatgagctgtggtagatgaatcaacagattatagaagggtcaaaatggcgagggcaatttggtaatttcacctggcaatattaccctcaatccagcatgattgcatatcccattcccaacctatccaaacaagggaaatatcaaaactggaaataatatccatttcccactctctttatcccattttccaaacacaatcaaagagattgtgtgatacatgctcatcaacacgtgtgcccgttaaagcccttggctaggacaagaatccaacttaaaaatccaccacacatcgtactttccactttatactagtataaaataagggattttgtccgtacagttacatactttgtattttacctacatctaatctcctcattttctgtttttattatccttctctaccaaatttctttcctcataaatattttttttaaattatcattaaggtgtgtctacaacaagtttgttactttgcaaatgctttttatctataggtaaaaaactttcactaattgaataatcaaactttcactcatctatagcaaaatacacatgcgtcaacttatataatagccacccgatcgatttgtgaggctaaggaaatgtgtacataagagatttttcgtgtgatgacacaggaagcgagcacaactgagttaactttgttttgccattgttttgttcatcttttctcggtttgttatttaaattagcagagtttttatgaatcatgaaaattatcttcacatgttgaaacataccaaacatttttgctagtcattttaaaaacagaaatgctacttaccgatataccgtttgggatcggtcccggacaggacaatttcccatggatcaaacacacaccctcacggatcagatacacaccctcgagaagcattgagacacctacagctggcaaggctgcggcggcggcggcggagcctgcttgctgctcctcctcttcagcgacgccggtgcgcacgaggtcagctgtgccaatgagagagagtgacgtaagcatgttgatggcggctgcggcggcggcgtctgcggcggagctggtgcgcatgatacccctttctctcattcctccttgatgaggacatcctccactattacccactggcaaagacgctaaagtcgggcggcgaccgtgtgagcctctgaataatcccaccttgcttagcttgggaggaggaatccaccttaaaagggagagccacccttcccttattagactagtcttttagggagattgggcattttcccgagtgagtgcgcctatgaactgttggggtccgggcaaccttaagttattaggcctcggccaaccccacctgggccggattattatcatttggtatcagagttgggcccttgttaagggggtgggaatgatgaggacattctctactattacccgctagcaaagacgctaaagtcgggcagcgaccgtgtgagcctctgaataatcccaccttgcttagcttgggaggaagaagccaccttaaaagagagagtcacccttcccctattggactagtctttagggagattgggcctttccccgagtgggtgtgcttatgaactgttggggtccggccagaataatcccaccttgcttagcttgagaggaggaagccaccttaaaagggagagtcacccttcccctattggactagtcttttagggagattgggcctttccccgagtgggtgtgcctatgaactgttggggtccagccaatcttaagttattgggcctcggccaaccccacctgggccggattgttatcactcctttttcatcgatttcctgatttcgattttaacatctcttcatttttgtattttctagggtttgttgaatccccaacctgtggatggggctcgtcatatcacatccaaattgaaatcaaagtaagctaatactctctcttttttctatgcatttttgttcattcactggggatgtttgtaccagaggtgaggggtgtgtgtgtgctgaatcatatgatacttgatatgatacttgcagcaaaatgttcgaattggaatagatcgctaaaaatgcttctagttgtatattgatgggaaggcaaatattgcttggagcaattttgtcgttaacaagtacacactgtcttgaaacagagaaatctccattcaactagtagcttactgcttaggacttttttaggtgaactgaagtgtaaacaaaatcagagaaatccgcatcagtcggttgctggcttctagttccgggtatgctttgcttgtcaattgttatcctttttgtcatagagggcagcgcgtggcgacagagatggcagatgcagctgagtcatagatgcagatgatttggatttttttttcctgttgatgtttgtagatctcagtggctggctgggagttttctgttttaaaatgatttgatactttggttcaatctaagaagaatcaccattgaaatgatattttctttgtcctttcacacatgtgcacagagttgaaatagcattgccacctgcttcaagcgaatccgatttcatgcatgtttcaaagaagaaaaggtgctcttcaaggttgaacaagggctcagcttaacccccacttgacaaatctcacactgctcattcttgtcatccatgcaggactacatgaaagaatatcatagggagctatgcaaaaggttgttgtaccatcgcttcaatgacttacatccaaaacgtcatttctatgctcattcggttcaa

SEQ ID NO: 68741 - DNA, 3842 bp, Oryza sativa
acatgatcctacctacccaggtatcatgatcgacgattttcctaggtaggatcatgtgtgatacttcacaagtatcacaccatcctactaaagtatcatctctgaaacctcacaaggatcatgttaccagagatgatacccaagtagaatcatgtgtgatacctgtaaagtatcacatcatcctactaagtatcatctgtgaaacccatagggattatgttagaaaacatgatacctaagtgggatcatgtgtgatacctcacatgtatcacacatgatacctaagtaggatcatgttagaagacatgatatctaagtaggatcatgtgtgatacctcacatgtattacacttaatgatactttttttattaggatcatatgtgatacctgtaaagtatcacaccattaagtagcattcgtgaaactcatagggatcatgttagaagacatgatacctaagtaggatcatgttagaagacatgatccctaagtaggatacatgatacccaagtaggattatgttagaagacaagatccctaagtaggatcatgtgtgatacctcacatgtatcacacttaatgatactttttgagtaggatcatgtgtgatacctgtaaagtatcacaccattaagtaccatctgtgaaacccatagggatcatgttagaagacatgatacctaagtaggatcatatgtgatacctcacatgtatcacttaatgatacttttttgaggagaaccatgtgatgctacaaagatatcacatgatcctacaagagtaccatgtgatcctcaagagtatcatgtgatcctactagcgtatcacatgatcctaacagagtatcatctgtgaaaaccacatgaatcatgtgctacttgtgtgaaaatttttagcaatcacataacaaattgtgtgtgaaaaactacctccaccaacagccaggacactcagtgtacatcttttgatcatttttctaatacaaaagttcaacgatagtatgcaaacacacaagcaatcttttgacaaatattggagattaagcagtccttttatgtacattccatcaatttttgtaccacacagggacaagtcatgcataccatctgttctatccacttccatatcatctgggtcacatctagctctttttttttcgccgggccagccaagataggccaactaaatttatacttacgattgaagaatatatacaaatatacaaagttttaacttcaactagaagccgtcaaagtaatggaagttgtcaccggagcaacctctctcctatatttctgaaaaccccagcttccttccaaatcgccacctcctctttgattgaaccaaacaggaaaccggctgagcgccgctggttctgaaacacacgcgcatttctttccttccaaaccatccaacaaataagcagcacaaggctatcaatggcatccatgtagttgttccgaaatttttgccgcatcgctaaccaccattcgcccaagtccaagcctgactcatatggcagcaggaagccaaccccaatccagcccttgatcattctccacaccctggtcgtgtaggtgcaagacacaaataggtgttcataatcttcatcaaccaccaagcaaagttggcaaacctgctggttcggccagccacgcttacttagattatccgccgtgaggcatcgccctttttcggccaaccacataaataatttcacctttgacggcgctcttgtttaccaaatcagagtaccacatcgcgccaccgtgtttgccatgaagaacatgctgtaggccgagtagggagtgtatttttcatttggtgcccacttccagattgtctcatcttcctccccatcttgaagttgcaccccctagaccacgtcccaaatctgaaagtattccccaattgcacgattggagggtgcccccttgatgtctcgtacccacctatggttcagaagccctcatgccaccgtcaagcccgagcgctcgacgtggctgaagatcaaggggaatctcaactttatgctcctcaccagcaaccagtccgccagccaaaatttggtgttcttcccatcacccaacacttgtctcgttcctgcgaggtagaggtcttgcaagtctttcgactgatctattggaactgttgttcacggtgtcgacgttttatgtcgcgattccggtatttgcatagtatgggaatcgttggtactaggatatatgcgagattgaagtaaaagagatggggacgaggatttttatataggttcaggccccttatcttacaggtaatagccctacatcccattggccgaagccggtgttgctctttattcatctggatcacacaagtacaatatttggagtagcctatctaactgttgtcgacttggcggtctgaagtgctgacttgtagtcgacaacagggtagccttcctcctcgaatccgcatccggcgagatcaaagacagcgctatatctctcctgataatatccgtagataccgtaagggactagccatgcttatctctgaattcgatatccggcgtcttgtcttgcatgttggcttttatgttgatcttgtgtcttgatctattgttccgtgtcccctctcctcctagggggccctgtatttatacccataggtgtccccttgtctaagtagaactagggaaaccaatatggatacaatccaagtagtccttgtcgtttccatgtagaactctattcatcattccttatgcggaattcctcctatatccgaaggttgttttcgtataagacatggtatgtggtgggtcctgccgagatttagtcaactactattaggtatatggtatccataaccttgacacacggcctgtcctgttgttccccctttttgccaaccacttgagacgaagtccttgccgaaataattgatgttcttgattcccagcccgccattttcatgtggcatgcagaccgctttccaggcaaccaagcagtgtccgccattcacctcttcctgcccttttcatagaaatccccggcacttcctatttatttctttgattgcccactgtgggagctcaagtacagacatgtaatgcactggcaaagcaagtaggactgtcttgatcaaggtcagccggtcaccggcggagagaaactttggcttccacccggcgaatttcttgacaaaccggtcaaggagcggttggacatcgtgcttcgtaagctttcaaagggggagcgggagcccgaggtaggtgattgggaacagctcgactctgcaacacaggatcgactggactagctctgattgctcttctgaacattggatcatggtgactgcactctttaacatctagctctaacaagggcctcctttaacatctctatttcagcacttaactcatccaacactaacttatctactattgttgtcacaactgactcgctagctacagacacactagcagaaagtgcacacaaaggagattcactcgagggggcatcacttttttttattctcctgggcatcaaaagaaatcacacaaaatagcaacaaaacatcaaaacacatacattgcatgcataaaatagagataacagagaactggctttagaattcttacgcgggctgatgttgagcttgcagcgcatagctggagcagaatcggtcgaggaggtaggagcagagcaccggattgcagaggaaatcggtagacggcgtgtgcgccggcgaaatcaacaaaggaggcgcgcgattccgaggatcaatcttggggatgcggaggagctcgcgccggcgaggaatcgtgcgcggaggcgcgcgatttcgaggaggattc

SEQ ID NO: 68742 - DNA, 10947 bp, Oryza sativa
attctttctgtttttgttgacgcgcggggtgaccataccgggttggttttagaatcatccctgttttcaacgggataccggtagatagcggctttttttaaaaaacgtgcccgtgtaagaggaggaaagggtagattgaagccgtttgtaatccggatcggactcgtgtagtcgtattgcaagacgcaatcacgaccgttggccacagatcgggcggtcaggacaccactcgccacacgttctcctcctcacccgcagcggcccgtacccttcccaaggagaggcggcggcagcggcggcggaggtggcggcggccgtatgcgggagagagaaagagctcagctcgcatggccatcgcggtgaggtcggctgcggcggtggcgaggcactccctgcgccctccgctggccgcgcccggcagcatccgcggcgcctcgctcctgccgccgcagcgcgctcgcggcgtgggcccgtgtcgcgcccgcgctcgcgcggcgagctcctccgcgactggaggtggcgggcaccttcctccgctgttcaggtgagcggggagcggaattattccgtgttttaggcaatggagacgggcggggatggcggtgctgctcatggatagctgattgatttcgtggttttccccctcttctcctgcagcgtggcgccgatgatggactggacggacaaccactaccggacgctcgcgcggctgatctcgaagcacgcgtggctctacacggagatggtggtcgcggagaccatcgtgcatcagaaagataacttggtgagctatatgcccttccgcccttcacttcttcatgattaaaaccgggtgaaacgtagatgagagaaatgcaaatccttgctacggaggaggaaaccctgcaactgatcagcagtgaagcaacctgtggttttaccacgattctgaattactgtgcgatgtgaatctggtagtgatttgattggagtcagcagcaaactgaattcgtttacgattggcccactttcattcatgtcaataacaatgccacaggtgttccatgaaaaactttcccgtgcgcattgcataagttttccattctcttcaagctatatctggtgactctttaagtacactcatcagagtcttatagtataatgttcatcttaatagttccattagcccatggtgcgctttcatatatcacaacttggaacctaatcatacagcggcattccactgattccttttgtcagatatagttcatctcctctgctgtctcaatctaggcatatgcgaaggatatccattgttttagctaatcagctctttttttcacataaatattgcagtttaatgaaaaaaagaatcaacttactgccttatcgggataaccagcaatgtattgcccacatgttttttcttttgtatgttatcaagttgcgatgagctttcttggcggcactggcagcttaatatgggggaaccacttcaactcaacttggcaccatcagtgctggcttgttttgtatatttgtcactatgtcttcaatcattgtttcttaaattctacttttggtgcaatgaaggcaactgtgaaacgtgtctacgacatatggttcacattatgtgcacatgacactgctacacagaattgataaatcttattcttttgtcgtcacaatatgcaggatagatttttagcgtttcctgctgaacagcatcctattgtgttgcaaattggtggaagtaatctggataacttagcgaaggcaactgaactggcaaatgcttattcgtacgatgagatcaacctaaagtaaaaaagcgtcactcaatctcatctaatcatgtatgacatttcttttattacatataatttactccaaacgttttgtatcagctgtggctgccccagtggcaaagttgctggtcatggttgcttcggtgctcgcttaatgtttgatccagaggtttgctttatgaattcattgcagtaaaccatcaggtagcatcaatttgttctttctccacccttagtaaatattgattcaattatctgaagtttgtaggggatgctatgtcagctattgctgccaattgtaatgtcccagtcagcgttaagtgcagaattggtgttgatgatcgtgactcctacgaagaactttgtgagctttcttcagagacctctcatgttcctttaaatttccttaggcttcccagatatgagccatggaaatcatgtcaaataagtacactctatcagatgcacttttacaccgaaaaggatcaatcaacaatgggttgcggcatgctttaatgtctcatattatcaaaatatgttaacctataccataagctaaatataagtaaatcacttgctggtgttatctggttgttttacaagaaccaggttacctagctgtagttgttattggttactggtcagtgtatttgtactcttctggcggtggttgtgcccttaaggtcaaattgaagaaagaaaaaaacagtagtatctcttgtgcatagtgatgctggacggttaaaatcttggattagtattaactgacccctaaaatgtaccactggtgcaattactccttacatttcaagttttcaacagcatcagagcataaaaaaaatctcatatcttctcaaatcaaaagaatagttgaaagcttctaacatcagtggagagtctctagttctctgcatatatttatcatgacttattccaaattaatctactgtatgtaaatctgcttgtagatgaaatggtggcatgatgacatttactgcagtttatctttttttagggccaaaaataatcacccatggctgtttggctaaatttgaaaaattcccctttccccctgagttggctgaggattatcttcaaagcattggactcctattaaattgcaatgtttaactatggttgccagttaattggtgatgtatatatttgacatgtgatcaacctttttgtatgataacaacatccttttacatttatttagagattatcccttctgcacacatcaagctgaaataattaggtaactgaataatgggaaatcaagtctaagaataagttgctcaatttaattgttttcttcttgttatgatatatggatatggcccatttctttttaacatgtcacacgacatagttccttttgttaggaatttgtaacatatcttttttttatttatattacccagttcaaattctatgtcatgctgtaggtgcatacttttaatgattctcattcatgttactctagataaatttttcatatgatgtttaattagttcttgtattgcatggtatttaattatcataggagtattgtttgagggttaatttaacctcatgtgctgatacagtgccatattgcaacaaactacgtatctttctcactgttaggtacattgactttttttttctttcccaggtgaatttgtagataaggttgtttcaaaatcaccaactaggcatttcattattcatgcccggaaggcattgctaagtggcctcagtcctgcagaaaatcggaacgttcctcctttaaagtatgtcacgcccatgattttctttgtgtaaaatattattcaaatttgatggataagtcttcgtggtccttggtcgtgattcttctttttgcttttgggtagtttcaccttttcaggacagcatctacttctttagcgtatttttcagttgctaggacagctgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatatgtatccaacctccctcgggtaggtatggctttgtgttttgtgaatgaagaaaaccagaaaattgccccatctcgagtgccatcctcttctcaatgagagtaaccattgaagttctaacatctggtatcaaagccacactttcctgtaggctaaacatctcttgttccaccccttcccaagctcggttgagctctcagctagcagcagcagcagcagcaacaccggctgctcctccttcccctttcccttccccctctccacgcagcagccccccggaggtgtgccatgtccgacgttcggtctcggcgttcggtcgcctcgagcactcggcgtcagcaggacaccgagctcgccgcagcagaagagcgcaggcgagcaacggctcagaccgctgcagcagcagcgagggcggccagactggcggcagcggagttggcagcagccaggtcggaggcggaagcagaggcggcggaagatgcggcacgtgcggcggaggtagaggttgagaccttgcgcagcagcatcaacggctccatcgccggcgacatcaccgccgacagggagcttgaggagctggcaagaggaagggcacgggaacgggcagagcggcggcggcggcccaagggaccgcgcacccgccgacgggaacccagatgggcgcgggcgtgccggcggcagcccggagcccgcgcgcggccctcgcaggcagcgcggctctccctcccctgaccggtgccatggtcaccacggcgtccagacggtggtaagggactttggtctcggcggtgggtggcctaccctcaccaaaaccaactacatcgagcgggccgcggtgatgagggtgaggctccaggtgcggcacatgtgggaggcagtccggtacggcgacgttgactacgatgaggatcggcgggcactggatgccctcatcgctgcagtcccgctcgagatgcagttctcgctttcccataagtggactgccaaggaggcctgggatgccatcgctgtggcacgtatcggcagcgaccgcgcccgcaagtccacactgcaggcactccgcaaggagtgggagaacctggccttcaagccaggtgaggatgttgatgactttgccctccgtctcaacactcttttgcagaagatggtgcagtacggcgacgacacctacgacgaggagagagctgtcgagaagctctttcgttgcgtcccagagaagtacaggcagatcgctcgctcgatcgagtctctgctggacctctccacgatgtcgatcgaggaggcgttaggtcgcctcaaggtcgtggacggcgatgagccacagcctctctcggggcctatcaccattggcgggaagctccatctcactcgggagcagtgggaggccagccagggtgacgggaggaagggggagtcctctccctcgacaggcggccgcaagccgtgcaaggcgcgcggaggcgtccaactgcggtgggcgcgaagacgcgccgagggtggtgctcgcagaggcgcccagggcggcgccgccggcaaccacaagccggcacgagacgacgcttgccgcaactgtggcaagcttggccattgggccaaagactgtcgacagccacgacgcggcatcgagctatctccagcggcaccggccgcaacggctttcctccacctcgatgagccgaaggtacacgccttcctcggcaacagctccagcaacgacaaggctgatgggtggtacctcgacaccggcgccacccatcacatgactggccggcgggagttcttcaccgagcttgactctagcgtccgaggctccatcaagtttggggatgcctccggcatggagatcaagggcgtcggctccgtcaccttcaccgcaaagtccggtgagcacaggctgctcaccggagtctactacatccccgtgttgaggaactctatcatcagcgtgggacagctggatgagaacggctcacgcgtgttggtcgagcacggagtcatgacgatttgggatcgccgccgtcgccttcttgccaaggtaaccagaggcactaatcgactctacatcctcagcgcgcaggtcgcacaaccagtttgcctcgccgctcgtcgggacgacgaggcgtggcagtggcacgagcgtttcgggcacctccactttgaggccctaaagtggctcagcgccaaggagatggtgcgaggcctgccgtgccttgaccacgtggagcagctctgcgacgtctgcgtcctaacgaagcagaggcggctcccctttccccagcagacgagtttccgagccaaggagcagctcgagctcgtgcacggggacttgtgtggcccagtgacaccggccacaccaggaggacgacgttacttcctgctgctcgtcgacgacctctcccgctacatgtgggtgatggtcctcggcagcaaggcagaggctgcggacgccatccggcgcgcgcaggctgctgcagaggtggagtgcggccgcaagctgcgcgtgctgcgcaccgacaacggcggcgaattcacggcggctgaatttgcgtcgtactgcgctgatgagggcattcagcgccagtacaccgcgccgtacagcccgcaacagaacggtgtcaagcggcgcaaccagacggttgtagggatggctcgggctctcctcaagcagagggggatgccggccatattctggggagaggtggtggtgacggccgtctacatcctcaaccgctcgcctacgaaggccctcgatggcaggacaccgtacgaggcttggcatgagcgcaagccgggggtctcccacctgcgggtcttcggctgccttgcgttcgtcaaggagcttggccacatcggcaagctcgacgacaggagcaccccaggggtgttcatcggctacgcggagggctcgaaggcctatcgcatcctcaactcggagacacagcgtgtgcgcacagcgcgcgatgtagtgttcgacgaagggcgagggtgggtatgggacaaggcggtggacgatggttcgactccgaagtacgacgacttcaccgtcgagtacgtccacttcgagggagctgggggagtaggcaactcttcttcaccgagcgtgtctaccccagtccccgagcctccaccgactccgacaccaacacactctcgggccacgacttcgactacgacgagctcctcgcctacaccaccacagccggtgaccccacgcgctccagcaccaacagccactcctccgagcacgtctactccgacgccagctagtgttgagcgcaacccggtggagttcgctactccgctctcccacgacggggagcgcatcgacgcgtaccacgacggcgagcagctacggtaccgtacgatggaggatcttctcggcgaccagccggtgccgggactggtgcctcccgacctggaggcgcagttgcaccttgcgtgcgacgacggtgagcctcggtctttcgcagaggccgagaaacacgtggcatggcgtgccgcgatgcagtcggagatggacgcagttcaggagaaccgcacctgggagcttgctgaccttcctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttgcgctggctgctcaggaaggctgggcgtccatcacatggacgtcaagtcggcgtttctaaacggcgacttgaaggaggaggtctacgtgcaccagccgccaggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcagggaggagatgaaggccaccttccatatgagtgatcaggggcctctctctttctacctggggattgaggtgcaccaggacgactccgggatcacgcttcgacagaccgcctacgccaagcgcgtcgttgagctggctaggctcaccgattgcaacccagctctcactccaatggaggagagactgaagctgagccgtgatagcacgacggaggaagtggatgctacacagtaccggcgtcttgtgggaagccttcgctacctcacccacacggctggacttggccttctccgtcggctacgtcagtcggttcatgcaacgaccgacaatggagcactagcaggctgtgaagaggatcatccgctacgttgcggggactctcgaccacggtctctactacccgaggtgtcctggcaaggcacacttcgtcgagtacagcaacagcaaccacgccggtgacatcgacaccagcaagagcacgagcgggattctcttcttcctcggcgagtgcctcgttagctggcagtcagtcaagcagcaggtggtggccctgtccagctgcgaggccgagtacatggcggcctccgccgcttcgacccaggcgctctggcttgctcgactgcttagtgatctcctcggcagagatactggagcggtggagctcagggtggatagcaagtccgctctggccctggcaaagaaccccgtttttcacgaatggagcaagcacatctgggtgaggtaccacttcatccgaagctacttggaggaagggagcatcaaggcgagctacatcaacaccaaggaccagcttgcggacctgctcaccaagcctcttgggaggattaagttcctcgagctctgcttcaggatcgggatggctcaacttccccacaagacgacgcacaagacttagagggagaatgatggataagtctttgtggtccttggtgatggaataagccttgtggtttttggtccttgtggtccctctcttgcttttaggttgtttttcccttttaggacagtatcctttcagttttgcttttagcatctttcggttttgcttttagcatctctaggacagcatctaggaccatcacctttctgctttattcagtttggatgctctctaggacagcatcacgttcaaattttagactagtgtgggcagcaattagcttgcagccatccagccagctatggctatatatatgtattcaacctctctcgggaaggtatggcttttgtgttttgtgaatgaagaaaccagaaaattgccccatctcgagtgccatcctcttctcaatgagagtaaccattgaaattctaacatctggtatcagagccacactttcctgtaggctaaatatctcctgctccactgcttcccaagctcggttgagctcttagccagcagcagcagcaccggctgctcctccttccccttctccttccccttctccacgcagcagcctcccggaggcgcgccatgtccgacgttcggtctcggcgttcggtcgcctcgagcactcggcgtcagcaggatgccgagcttgccgcagcagaagagcgcaggcgagcaacggctcagaccgctacagcagcagcgagggcggccagactggcggcagcggagttggcagcagtcagggcggaggtggaggcggaggcggcggaagatgcggcacgtgcggcggaggtagaggttgagaccttgcgcagcagcatcaacggctccattgccggcgacatcaccgccgacagggagcttgaggagctggcaagaggaggggcacgggagcgggcagagcggtgggcagcagcccacctccacggcggtggcggcgacccaagggaccgcgcgctcgccgacgggaacccagacgggcgcgggcgtgccggcggcagcccggagcccgcgcgcggccctcgcaggcagcgcggctctccctcccctgaccggcgtcatggtcaccatggcgtccagacggtggtcagggactttggtcccggcggtgggtggcctaccctcaccaaaaccaactacatcgagtgggccgcggtgatgagggtgaggctgcaggtgtggcacatgtgggaggcagtccggtacggcgacgtcgactacaacgaggatggcaaagaaccccgtcttccacgaacggagcaagcacatccgggtgaggtaccacttcatccgaagctacttggaggaagggagcatcaaggcgagctacatcaacaccaaggaccagcttgcggacttgctcaccaagcctcttgggaggatcaagttcctcgagctctgctccaggatcgggatgacccaactttcccacaagacgacgcacaagacttagggggagaatgatggaataagcctcgtggtctttggtccttgtggtccctctcttgcttttaggttgtttttcccttttaggacagcatcctttcagttttgcttttagcatatttcggttttgcttttagcatctctaggacagcatctaggaccatcacctttatgctttattcagtttggatgctctctaggacagcatcgcgttcaaattttagactagtgtgggcagcaattagcttgcagccatccagccagctatggctatatatatatgtatccaacctccctcgggaaggtatggcttttgtgttttgtgaatgaagaaaaccagaaaattgccccatctcgagtgccatcctcttctcaatgagagtaaccattgaaattctaacacttggtcgtgattcttctttttgcttttgggtagtttcaccttttcaggacagcatctactcctttagcatatttttcagttgctaggacagctgcggttagtaggacaacagcagttagcatctcctttatgcctcctttatgctttattcagtttggatgccctctaggacagcatcccattcaaatttcgaattttagactaggagggtgcagcaataggctag

SEQ ID NO: 68743 - DNA, 2052 bp, Oryza sativa
gatcaggatcttcgtcaagctttgccaagtcatcgtcactatggattttttgacgagggatacttcaactactttggatctgggaagtctaatctggccagagtatgcgccccgacaaggtcggaaccatcgtcatcaacaattcgatctcttgagatcgaccaagcctcaagataagcggcgtatcgaaagatgtcagaccgtatgatgtcgaacgagtacgcaacaaggtaattggtagattggttttttaaattaatctactaatttcgtaaatacatccggcatgtatctacaaaggtacgcaatattttatatgcaatttatcgtacctattcagatcatacaacattgtcagatctataatttattatgtttacctagagcatgttttttatacaatatctattgtgcgagtgcttccgatgttaggccaactacggtctaatgctggggactcgctctgttctcttctgtatgaatcatgcttgtctacgatatacataatgcctggtatttaatttgctcgttatatcctgataatactataagattcatgcagctttttgagtacatactcgatattatctgctatatatcttgtcttccagacgatatttttcaggaacaattgagcacgtgagtaggttgtggtcgagtacaccccattatcgagaacattctcgacaaatgcggagttgtcgcacccaacctaccaacgaagaccgacgacctatctcatagcgccaaccatggctgcgctattcgagaaaaggttgttaacggataaattctcgtgaacgttgtcagcttgatcacccgacatgattgcgagcggacatctggatatgctataagttgggtatgtgagtcatgctggccacatgagatgcagatgtaacaaaccaactttagcacccctataggtgattgagaggctcctactcctggttctcgaaccagtaggacgtagcgatctctcgcgccttaacttctgatggtcgaggtacgactacggcaatagcgtagcggtcctcgcaccacgacttcagatgacttcagatggttgaggaacagctacgactagtcttcgaccggcagcgtagcggtcctcataccacgactccaaatggtcgagagacacctactcactggttctcaaccagtcaatcgtagcgatctctcgtacatttacttctagtggtcgagttacgactactatctggtcctcgaccaccggtgtagcgattcgcccactacttccaccgggaatgctattaggcgagcgatcgccctcgctcgcccagggcgatcagttttgcgcacccccccttccctccctccacctctccaccttgtttccttttttggcaccgcattactttcctattttagtaaatttatacacctaaagtttacacatctaaagtttagagaccaaaaatttataagtcaaaagtttatatatccgattcaaatttgaatttgaattcaaatatttatatatatatatatagtatttctatacatctaaagtttatacacctaaagtttatagacctaaagtttataagtcaaaagtttatatacctatttcaaatttgaatttgaattcaaatatccgattcaaatttgaatttgaattcaaatatttttcatatatagtatttctatacatctaaagtttatacacctaaagtttataggcctaaagtttatagacctaaagtttatatacccgattcaaatttgaatttgaattatatcttattcaaatttgaatttaaattcaaatattttctatatatagtatttctatacatctaaagtttatacacctaaagtttatagacccaaagtttataagtcaaaagcttacatacccgattcaaatttgaatttgaattcaaattttttatatatagtatttctatacataaatttttctaacttttatttttcaaaaaaaattgtgtagtctactgtagtagaaagaggagaaggggaggaggaataggggagaggagggaggagtatagggggaggggggcc

SEQ ID NO: 68744 - DNA, 7563 bp, Oryza sativa
gcggggatccctttttacgaagtggcggcgggccggatggacggcctgcgctccaacatggacgacctgccggggaacatgccgacgcccagccaccaagtcccgcggatgtcggagctcttcgtcaagcgcggcctgtcgcaggaggacctcgtcgtgctctccggcgcgcactccatcggcggcgcccactgcttcatgttctccaaccgcatctacggcttctcccagggcgccgacatcgacccggcgctggagccggcgttcgccgagaagctccggaaggtgtgcccgccgcggaaggacggcgacgacccggagcagtcgcccaaggtcagcttcgacggccgcacgtcggagaagctcgacaacgtctactactccgagctgctggccagccgcggcctcatgacctccgacgacgcgctcatcaaggaccccgagaccaagaccaccgtcgatctcttcgccggagacaacgccgtgtggcaggagaagttcgccgccgcgatgcagaagctcggcgccgtcgacgtgctcgtcggcgagggcaagggccagataaggaagcaatgccggctggtcaacaagccgtccaagcagtccaagcccacgtcgacgcggcagtccatgccggcgttgcggccaaagcgcaagaagcctcgcttgggcttgggcaatttcatccctggcttccacggcttcttctgacagaggtgaatgaaattaattaagaaaaacaagtactactccacttccctcccataggctcgctcctatggtttttctttttctttcttcttttttttttttgagagaggagcttttgctcctacggttactactacactctgctgcaactatatgttaaatttcttttcttaaaaaaaacatgttgaattgcctaactctctgcttgtaagatatctacattcattcatatcgttggtttcatagctataatggtgtatcaatgtttgtagtatgggttatatttctctctttacctaagaagaactggtggtttttttttccttttcacttcacgtgtcgcaggttgcaacaaaacatagcgtgaagctgtatttacgttttagttttgcaaatcttcgctggctgcctatgctttaattcctagtattctcctaggtcatgtgacagccaaacgtaccagaaaaatcatcgcaaatatctatctatctattactccctccgttttttaatagatgacaccgttgattttttctcacatgtttgaccattcgtcttatttaaaaattttatgcaaatctataagatataaatcacacttaaagtactacgagtaataaaacaactcatacaaaataaattataattacgtaaattttttaaataagacgaatggtcaaatatgtgagaaaaagtcaaaggcgtcatctattaaaaaacggaggtagtatatattaaaagtctattaaacttcctataaacgctcccaaaccgccaagcggcaccctataaatactcacaagtcgtcaagtggcacctaataaataagaaaaatctaaccatctatttttacatttatttttacttaaattgatggacccattattttaaatggttatatctattttgtaaaaagaaaaaaacacccgaagccaacatccgaaccaacgtacatactaatgaacgtacgtatatactacacgtacatcccatctgttcattccttattttctattttaagaagactaaaatcaaaattacttttacaggcaaaaaaaatcacaaatagaccaacaactaggcctagcagctctccctctgtcactttaaaaatcctatgaatgcttctaaatcgctgcgtggtgctattaaattagagaaattactagaactttttttttaaaaaaacacaaagcacctgcccatcagtttatacttaaatggatgcatttaggtggttatatttttttaataaaaaaatcccaaacctttttccttccttccttccctccccacccccgtgcggtgttaaaatttattaaacattttataaacacatctaagctactatatgacattcttaaattaaataaaatcttaaaaattttagaaaaagattattatatactaagagtccattaaacatcatataaatacttctaagcctccaagtaacaccttactgacgctctcagaccgccaagtgacactctaatccgaccgtcgatttttatttaaatcgttggatctattattttatttttgaaagttagatccttttttttaaaaaaacacacacatctaaaacctccccatcacgtacgtaccaacgagctatcttcatgagaaattaaaataaatattatttttacattgaaataccacaaaatagatctctactcgctaggtctatcaactctcgctctgtcattctaaacatcctacaaatgcttttaagcttctatgtggtgctattaaattaaagaaaatactagagaatcttaataagaaaaaactcttagctgctatatgacattcttaaattatagaaaaatcatagaaattttgggaaacaacatccaaccatcggatttgacataaattgatggacacattattttcaatcgatcgactcattattttaggatattagatctatttttttttcaaagaagaacacccaaacccctttccctcctcctttgcagcatccggtgttgaaaatccactacacatcttataaacgctcttaagatgttacatcattctcttaaatcagagaaaatcctaagaattctgataagaaaacaaaacatccaaccatcggtttcgacataaacatctgacacattattttagggtgttagattaatcatttagaaaaatattccaaacctccttcactcctgccagtgtacagcccgtgtacagcaagcaccattcttttctctctttttttatctcctaaacaattaaaattaaaattatctttataggcaaaaaaaaacataaatggacctccatctattacttatatcacgtcaggcatctaacgactttctaccaacttaattaatttctcttaacatgcatataagggctacgtgcctatataaattgaccttgatactttgttgttggatttaaaacccattcttaatagaaaagttcaaatatatttatgaggactgttagaatgaaaagtataaaattttaaaatacaatcaaataaaaaaaatgatattattggatttttttttggttgtaagatatccttctggcgagttaaaatactctaaattttctaatagcaacaagctccatttttttccagataaggaaccacctccattgtttcgacacaataatttcttattaattcaaaactgcatgatctcaagtaattttattttaaaatttacatgttgcaagagtaattataaaaaaatgccagcgttcgaagaacacaaaataagtttaattttagtttagaatataataaaaatatttcaataaaaaccccgcacataaatatccataataaaattttactcacattatataagaaggtgcctgcgcatgtacgcaggctacctttctagttgaagaaaagcttgacaacaagttgcaattagctgaaaaatcttgacgagaggcatggtgaccaagcagtcacaatgcagctatgctaaccgatgcatcagcatcaggctatgatgcaagatctgacggcgaggaagaacagaggaatacgcacaagatccgcaatccatcgcatattgtgtgtacaatctaggacaacccacacgcacagcggcaaaaacaacagaaacacatgaaaataacacatctggatatggggtagcatgctctcaacaattcagataacatgtatataaaacagaggacctgttctaaacagaggttggaaacgctgattaacaagtactacgcgaactctaaagtttcacacaagatagtcctcagatgtactacgcaatatgttagagacaagataaacttctcatcttgatggaagctttactggacaaaattctgtaggagcaaaagctgcaagggatagtaagtgaactacgacttcaatgcatataagatcataggcaaataaaggccttcccaccacagaggatgttactatctacagtgacaagtcgccacccagttcatcaataactctctcgagcttgaacaacatatctaagaaaagcaaaaagaccagatcagtagaagtgtgtggaattcgattagaaagtttctaaattagcatttagcaaaatggaatgctgagaaaaatgaattagtttcacgagttatgaaggaatagaagagcctgacaaatgtatctaagactagcaaaagcgctatagaagcatgtgaaaggcagattagtgagtttccagagtaatgtagcaaaaggaagtgttgagaaaaccgaggaatataaagcataccatggaaggcgccatcagatatatatgtctgcggcggaacaataatatatattagaaaatatagatttgcttatcaaatttacaagaaaacaaaacagtcaagccagacaattatcgattggatagatacctttatccttgtcataatatcacttgtttctctattaacatcaatttcgttagcagaagttgtggaaattgcaactgcacaaaatactgattggtcagggaaagaggacagacttttccagataaataagtgggaaatgagattgagactgtgtgtaccattatgggaagtatctaacatagacacctgcaaaatttaccaatataagcatcatttcttccaataataacattttgcaggatattcataaatatagtcacaaatacctcttgtggtgcatggtccgttgcagttactggatatggttcctcagcatctggtttaatatgtgtaaaaaatgttgccacaaatgaacaagtagaaataaacaaaaaatactgcaattgcaatgaatgtcaccaaacagaaagttgctaacctttctcagttttacatgaaaattgtgtcagcatatcagtgaaactgggggggaaaccagagaagacggtatcaatgttggtagcaaggagaggttgaagaagaggctcttctggtgcctcatggtggcgtaatgatggtgtctcaggctggcttaatgctggtgcctctgttctgtggataggctcatctggttctgcatggtagcctaatgctggtgtctctgttctgtggacaggctgatctggctcctcaaagcttgaagagtcgggtgttacttaatactcataacagaaatatattccacaactaaaacttgatacagttccactatttacctttggtgaattccactagaagcaatatattcagatgctgatgaatcttcacaaagatagtcacttccagatggtctgatatccatggtttcagttgagcattcctttgtaaacaaaccatatagaaatgcatttagtgcttcattaacattaaacagagcataagtcaagaaaatctcaaaattagtaaatagaataaacagaaaataccattactgtagtatcatgaattctatagctagcagtactgaaatttcaattgtatgaatagtaactttcaccactgtgatttcatatcagtaaactagggtctagggagctaacaaatttaagagaatcttgaagagaactggaatgtcaaaactcagaagcatcacaaatggttttatctaaccactataatatccagtagtcatgttcacacattgaacagaaaattacaatcaacattgatgaagattacaggttacaagatggaagtatatagtttaaaaatgggtagcgagtggtggtggactggtggtaaacacttgagcaaaacactattaggaatgatgagttaagagaataggcaagagaggtccatggaatattcatacaacataactatgaagaggtacacattgttggatgacagatataggaaattgcaccttaacacaatttaaaaatgattctgcatcactgagatgtgggaaacgtaaagcaaacttctggatctgtagagaaataaagtgcataaatattttggccattaaaaatgtgattataaaggttgtacaggttataataaatgcagtaaatatttgatggttcaagaaaacttgcctgtttggacttatcacaaaagctcacaaacaccactctgctcccacttattgggcattgtgtcacacatgtaacctgaggccacgaaaaattgagaatggacacaaaatgctcctcctgtgccacaagcaagaaaaataatgccaggttatgaaaagggagtatatagagaaacaacaaaaagtgtgcaaaagtcattctgcaatgtcacaaggtttgcaaggatagttgtggcaagataaaccaatttactgcccaggagtcgtttaggtggataacctttcccaaatacttggtttgaccatacattaaaatggaccactctaccaatccgttttcttgtttttgacaggaagtatcctataattctgcaacttctcaacataacacagtgtattaatcgtgtacagcttgtaatgaatacacatttagatgaacaatggaagagtgtagaaatgccaaggcctaatctaaacgtcccatccaaattacaaaacaatcagtacaattacaatcatttgctttcagttttcatggtagtaaaaagaaattaaaatcaaataaaaaagaatgaaccagcacagtccattttgtatcttctagtgaaaggaaatcgcattgttgattcctgtaataatacattaagggcacacaaagaaataagtatccactttgaattgcccaaagactaagtagcatatgccttccctgaagtatatttcatacttcttaataactagagatagataattcacagaatacacgatctagggcctgtttagataggaagtattggattcgatttccaagactaattcctcaagattataaaaagaatgaaatttcaaatctgatcaacaccagatataatcacaatgaagttacaaaactagttaaacagagtagaatgatccaaagttttatgtttcaaaaccaagggcaggagcttggaatagtccaaactacattagttggagcttgaatgccaaggaaaaaccaagatatgcagtaataattaaggaaaccatatgagcacaaatcactacctcccgcagatctaaatcttgcacggctaacatttgccacgtgacacatgccaaaagcatccattacttcatttgtgaagaaaaatacacatagcatgcgtagaccaaaataatatgataacatgcaatttgtcgcactgattgtttcatgaaagcattcatggatccccaaaacaagtggcggagggaggggggaagcaagcagggcatggcctccctccccacatgatttgatacctcctatgttaaaccagctccctcatatcaaataaattcaggatttccggctccgacacccacaatagaacacaatacacgctaattaagccactccaccaaaa

SEQ ID NO: 68745 - DNA, 578 bp, Oryza sativa
aggagaaagaagacaaaaatggtgacaatgtataatgagttgaaggcagcatgtgcaagtgataatgagacatgtttcgccatgggacgtgggcatcctcgggagagagaccgggtccctggtccccggtgtacccccgtctggtagtaacgtcgctataggcgtgaaatatcaggcctcgggtaaagtgggataatggcacaaactctctccttccactttcgccaagtgggagaggagcagagaaggagacggaggtgaaagaatagagagatggagagatggaccgacagatggacaaagagagccagaagagagagagagagagagagagagagagagagagagagagagagagtaagagagagagagagagagagagtgtaagagagagagtttcaatggttttgtatacaaaaatgaaaattattagatgcatagaaagctatagttaatggtcatcctttggtaatcatgtgggaaagtgattaaaacgttcacatcacgattttagaagatatatcctcattttgacgcgggttttaatctgcttttgttggccacagaacagctttaca

SEQ ID NO: 68746 - DNA, 1426 bp, Oryza sativa
tacccgcacaaatgcagaacccagagatacagaggaccagctgtaggattatttcatacaagggacttgagcatctgcaaacttcagtaacctcagtggacacctggaaccaattcttcatacatactgagggacaactatacatgcaaaatcctttaaagtgtttcaaagatattcttcatgagcacaacaagccttaaatttgccttttttttgagacggagtcttgctctgttgcccaggctgcagtgcagttgtgcaatcttggctcactgcaagttccgccttccaggttcacaccattctcctgcctcagcctcccaagtagctgggactacaggcacctacaaccatgcctggctaattttttgtacttttagtagagacggggtttcacgatgttagccaggatggtctagatctcctgaccttgtgatccacctgcctcagcctcccaaagtgctgggattacaggtatgagccaccgcgcttggcctaaatttgactttttaaaaaaactttactgtgtaatgcaatttagcatacttatagagactttattggacaacaggtaagtaaaattatccttattttacatatgagaaaactgaatatgccagctactatttttgcattgaacacccagaaatgtggtgatgtaaagcaaccattttattaagttcacagattgttagtattggaattttggatagggtatagaaagaaaatcttgtctgtgctccacattttctagagcctcatttgggaagactcaaaggcaaggaatgactcagagggaagaatcatctggaggcatgttcatcagcatggctagagggtgatgttggctgtcagctaggacctgagcaggtctgtaggctggattgcctccatgtgccccctctgtgtgacctggcttcctccacagcagggcagcctcaggagagtggggcttctcacatgcagtccagagtttcagggatccacgtagaagttgcatcattttttgtgatctatccttgaaagttgcacagcatcattttattaccaaaatgccagaggtttggtctaagtcctgctgttcactccacagaaagccaatcactgagacaacaagtattgccagggaagaaggctttaatcaggtgctgctgttgaggatatgggagatcagtctcaaattcacttccctaactgactaccattaggggtttctaaagcagggaagaaatgtaccatgtgcggggaaacaggaattagggagaggtagggaagaggagttcaccaacagaaagctggtgcttatttaagcagtcatgatgggtgaggactctggcatcccattgtctagatgccatgatctggtaagtttccttccttgatactatctgggaagcatggggatcctctagagtcgactgcaggc

SEQ ID NO: 68747 - DNA, 12790 bp, Oryza sativa
atttcccccctcttgattgcacgcggcgcgaacgggagcggcggcatttgcgggggcggcggcgctagggcacgggccaggcggcgggagcggcgggaggtaagggatgacgggtgggccccacctgtcagcgagggtggcgagcgggcccgcccgtcagcggcacgcgcgcggggaggaggccggatgggccgcgggggagaggagagagagggagggaggtgggccgagccggcccaagagggggaggggggaaaaagacttttttgggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaaattattctaggcataatttagaggatgtattttagggtcgttttgggacgcgacagtatagcatggttcattgcagagcaccggactgagaagtggcggagataagcccacgggggtcgctggggagtccatgcctctggtttttgagggggtgattatgatccaggaatggtgcactgtggttgattgtgttgtgcgaggggtaatgtcacagctcctttccgaggtaccgtggtggtactgaggcacatggtgacatgatgtggggctgtgtcttgtgggtacagtggtacacctctggccagagtaaaactattcgaatagccgtgcccgcggttatgggtgggttgagcaatgtttttcgtgattagtctcacacctctcacaataattatggatgttatacctggtaataatttgcttagctcctggtttggagttagatctgtacagccgggtatggttgttcaggatggttgagcctgtgcagcatgggtgtgctattcagtgttgattaaaatttctgattaatcactccactgtttttacttctcttaaaagttttgctaaatgttgtttttgcaaatgaacctatattatgccatcctttggtatctttgtgcacttgcatatttgctgtgtggcttgctgagtatgtcatatgctcaccttgcaataatcaatcaacctcagttgaagaataaggatccagaaggagaagacgtttggcttataccccagttgagctgcctgtgggagtggagccggagcttcgctagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctttctctttcaacttgagtagttctgagacattgaaacttgaagacgccaatgaggtctacttaaacttatggaggccagtcaagtggatcgaggaagaaccgaagtgccaagtggtcaagatggaatgaagtttggatcctaccttagaacctatgccgccaaagtgtctttgaggaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtattaacctggttaaggtcttgtctttagtgtaacccctctccttctatcttctctaatatgcaacagatggtgaacactcgcgccaatggaagtggaaacaataacaatgaagggaacccaactcttgctcaagttctggctcaacagactcagttaatgaacatgatgatacagcagatgcagaaccagctcaaccaagggaacaacaatgctccaccgccgcagaacaagttagctgattttcttcgtgtgaggccacctaccttttctagcactaccaacccagtggaagcaggtgattggctatacgctgttgagaagaagttggaattgctccagtgcacggatcaggagaaagttgttttcgcttcacatcagttgcaaggacctgcatcagaatggtgggatcattttcggatgaacagagcagaaggacaaccaatcacttgggtggagttcacggaagcattcaagaagacacacatacctgtaggagttgtttctttgaagaagcgtgagttcaggacattgaagcaaaaggatcataccgtggcagagtatcttcatgagttcaatcgtctggcacgttatgctctagaagatgtgcgtactgacgaggaaaggcaggagaagttcctagaaggcctgaaggatgaactgtcagttacattgatctcccatgactatgttgattttcagcagctggttgacaaagcaattcgacttgaagacaagaagaacaggatggataaccgtaaacggagaatgactgtattccaggaggcacaaggtagtagctagaggcagcgtatcaagccactccaaattggtgaatcttcttccgctggtcaaggacagtcgcaacaattgaacatcgctggtgagatcaaattagagactaatgaaagcaatgaagataatgttgagcaagctactcaattagtgccagttcagcaggatcagtctcaagagaataacagtagtggaagggagcagcaggtatgtttcaactgttacaagccaggccactttgcaagagagtgtccgaagccgaagcgtcagcagccgcaaggtcaggtcaacaacattgtcgtcacaggagccaatacagtgccagttgcgtcttcaagagttgcgttttcaagtgttacagctcagccaccagtttcaaagcagcagtagttttctttaaagccttagaataattatcggagttatggaataagatagactgcagtttacctatgcccttttctttctagccgttccgaatctcgggacgagattctttgtaaggggggtagatttatcacatcctgatttttgtttcaggatttataaattatttaataaattattattagaagttatattaaatgttcattaacttacaagtgaagttaaatgtgggaaataaaatttccttaatataaagcatggatggatttaatttttattaaattctccatgattaagtcaactctttgaaattttctcgaatttttcggagctcaattcctaaatgatacaaacaacagttcagtaattatttgatcattaatgatctaattatatttgttaagagtttttcttgtttaaaatccttaaattataaattgttgtttaaaaggaattattagaaatgattttaaaagcctagaagagaagatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctgttttggctttgggccgaaagccggcccaaaacctctctcttcctctctctccctccccggcctagtcggcccagtcagcccgcgctccttccttttctctctcagtcgctgacaggcgggccccacctgtcagggtcgtcgttctcctcgcgccgccgccgccgcccgaaaccctagtttcgcgccgcagccgtttccggtgaaattgattgaggggaaacaatctttgggatctcctctaccttttctcctttggaaacatcggctaaatcggtttggaatgtgtttgattcgagttcgaatcggatcggtctctttccttcaaaccccgatctttccttctcgtcgccggccgccgtgggccttcgccgtcgcctccgagcccctttaaaaggttccccaagctcttctctacctgccgccaccctcgccttcgcctctcatcgtccgtagtgccctagcgccatgtagcttcgcgccgccgtcgccgccgtcgctccagccgtgcgccgccgccgttccggtcgtcgttgtcgctcgggaaggccaccgtcgggatcgccaagtcgtcgccgtcctcgtccgccgcttcgccatcgccgaagatcgccggagcaccatcgccgccgtcgacccgatctccgccgccgtttcaacctcgtcgccgtcgccgtccgttgctcctccgccgctcctttggtcaccggtgagttcgccgcgtcgccctctacccgttggtgctctccgttcgtgccgaagcgccgccgttcgccagcgagcgtgcgccgtccgagccgccgagccgccgccgccggtggtgacgtcatcgccgacgtcatcgtcgccctctcccgtgagccggtcgtggaccgatcgatctcggccgtccgttttggatggatcgatctcggccgtccgttcccgtgaaccgttgctatgcacccggttcactgcgaaaccctagccgctgacacaataaataaccttttccttttcaaaaataattcattattgcgtcataattcaattaaaatcaatataagtgttttaatccgatttaatctttaaaatttcataactaattcatttgaactcagtttaatgtggttcaagttgcaaaaattatataaaataaagatctacatattaaaattatccataaattgaatttaatttatttaattctttataaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcctcgttttgcgtgttagcttgtcgtttccgtcgttgcgaaggttcgcaagtgcgtcggaagtattcaagaagattaattgaagaccgattattgcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataacttgactagttgggctatatatatattggttcaactagatattagatataattgcttagccatgcttagaaacattagcacactattgggataacttattattcactattatttaatggtggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaactttcgtatagcatggttcattgcagagcaccagactgagaagtggcggagataagcccacgggggtcgctagggagtccatgcctctggtttttgaggggggtgattatgatccaggaatggtgcactgtggtggattgtgttgtgcgaggggtaatgtcacagctcctttccgaggtaccgtggtggtactgaggcacatggtgacatgatgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagccttcatgctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagatatttagttgctcaaagctattttgtaaacacgattctagaactatacaattattaatcaaggccgtgaacccacacgaacctgccttaacccaaagcctacgatgattcagaccgaactggcaacccgaccctgggtcccagctcgtcccaagccaacccaggccaaccattccaccttttagttgttaagcaggttttaagaactaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaactcccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaggggacggtgtgaatccaattccacaatactccaacaattccatagtgtccaggttatatgaatatcccaaagtctagagttgtaaaatcacctaatgttacgtaattaaacagcgaagcatctacctaaaatcatactagtggtaccatgagtagagtgtccactagttggggttttgtttattctagggtgaacaaggaaataataacaataacaatattaaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactctatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatagatttattgcgtcagccgaggggaggggcgcgcggaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgcgggacgcgcccgaaggcggccacgccggcacagccgacgggaggtggcgcactcgcgccccgatggtcgccgccggcgaccaccggcgcggcggagcggcgcccgaaagaggggagggaagggggaagcgaatcggcggtccacggctcaccccgggtcgacggcgacgacgggaacggtgaccggagcgcgcggctcgggtagacggggacggcggcgttccggcgatcggcgaccgaaacggagaggtggacgaggtcggcgaggttgcggcgaacccgaaggaggcggcgccgaggcgggagagggtccggggcgacgacggcggcggaccggagctcggcggcgacggcggagagagagagcgacggcgcgagctcgattccgacggggagagagagcgacgagtggcggaaacggtggagggaggcacggggagtgtttatatatggttgggagtgagagagggcggtcggatgagggggaaacggccgcggaagatccggccgccattgatgcgccggcgaggtttaggggaaaagatcccgaacgaatccgatggagagagagagggaaaagtggggggaaagagggagggaatcatggggaatatttcccccctcttgattgcacgcggggcggacgggagcggcgggatttgcggcggcggcggcgctagggcacgggcgaggcggcgggagcggcgggaggtaggggatgacgggtgggccccacctgtcagcgagggtggcgagcgggcccgcccgtcagcggcacgcgcgcagggagggggagggatctgggccgagccggcccaagagggggtggggggaaaaaaggactttttaggatttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcgaggatgtattttagagtcgttttgggacgcgacacggcggcgcacggctggagcgacggcggcgacggcggcgcgaagctacacggcgctagggcactacggacgatgagaggcgaaggcgagggtggcggcgggtagagaagagcttggggaaccttttaaaggggctcggaggcgacggcgaaggcccacggcggccggcgacgagaaggaaagatcggggtttgaaggaaagagaccgatccgattcgaactcgaatcaaacacattccaaaccgatttagccgatgtttccaaaggagaaaaggtagaggagatcccaaagattgtttcccctcaatcaatttcaccggaaacggctgcggcgcgaaactagggtttcgggcggcggcggcggcgcgaggagaacgacgaccctgacaggtggggcccgcctgtcagcgactgagagagaaaaggaaggagcgcgggctgactgggccgactaggccggggagggagagagaggaagagagaggttttgggccggctttcggcccaaagccaaaacagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttctaggcttttaaaatcatttctaataattccttttaaacaacaatttataatttaaggattttaaacaagaaaaactcttaacaaatataattagatcattaatgatcaaataattactgaactgttctttgtatcatttaggaattgagctccgaaaaatccgagaaaatttcagagagttgacttaatcatggagaatttaataaaaattaaatccatccatgctttatattaaggaaattttatttcccacatttaactttacttgtaagttaatgaacatttaatataacttctaataataatttattaaataatttataaatcctgaaacaaaaatcaggatgtgataaaaggcctacaaaattagtataacacttttctgcgtcaaaaaggattttaacaacattgggctatattgtcgtgagcaagtgttgccgaagcaaaaacaaatgcttaagtccctaaggatcacaacttaaccacgctgatagcaaacttgctgaagtactgtttaggcccaggcccattagtactcccgataccctaaggaaataacaccggaagcaaagcgtcggttcgttttccccgccaaaactctcgccactttcctcattctctgctacagtgcaaaaccacaccggcggagctagggttcacagattcgctccaatccagccttcaaagctccacgaaaatctcccacgcaaccaccgcatcaatctcccatccattcccagccacatttcgaaccaaatcacatcatccaattcgcatccatgacggaagagagagaaagctttgagagccagtgggcgccatccgacgtaacggaggaaaacctgaaggagatggtggcgcacggtgttcttccggccaaggagatcatcgggtggcgtccagcatacggcaaaatgtttccaacccccgacatacacgaagtggttgtattctccatttcttttacggcgggttttctcttccaacctcaaacttcttctgaggaattctggatttctatggtattaacctgcatcacctaaatcccaattccatagtccacattgccaacttcatccacgcttgcgaagctttctagggattaggccgcatttcgctctattccgccgcatcttctttctcaagccccagccaaacaagagcaaaaaaaaccatgtgttgttgggggagccggttttcaactgagggggaccttgagccaaaaatacttctccatgccattcaagacctcgaacaaaggttggcatgcgaactggttctatgtacaaaaccccgagccagtgcttcccgggtactcttgtctgcctccggtatatcaagatacctggaattcgcttcccattggagatgaggcagcccaagcacttgcattgatggatcgcatgctgaggctcaaagagcaaggtctgcaaggagaacagatcacccagcattttataaaaagccgactagcgccaattaaagagagatcctgcacagcctttgaatttgacggcaagcatgaccccaaccgtgaagatccagattctcttgagtttaaagtcatgaaggagagaatgtacaaaatcttctcgaatgctatcgtggtcagttattcgcacttgctgctagtggtgccatacaacgccttcaaccctcctccaccggtatgtcttatacaactcagctattctcaaagcatacttttatcttctgtaaggtcaactgaaaacttggaatatcatgcacaggaattcgctttgatgaaatctgaccctccaattgctcaacgccgctcaccccgttggaagacaagccaggccagtggagggccaaaaatcaagcctgctgatcaatctgacacttcgaagttgactaatcagtctgactctcggaagaggaaattgatttcaagcgacgatgaaggtgatgatgcggaaaagatgggtaacaaaggggtgactggaaaatagtcaaagcaaaccaatccgaagaagaaaacgtccagtcgtcccatgcaaaaaataaggaagtcatccaggtatgtgtcatctagcaatttcttctgtttcgctagtcactcactattgaagcaaagctgatagcatgtctcaaatctgtagaaaaccatctgacatagatccctctggaaaagaccccacgtcaactgacacagagactggtccttcagcagaaactggactgactgccgaagaccgcccgggtaataatcaaccggcaaccgacaatgtagataccaacaacgagcccccgactggaaaccagtcagccgagactgaagtcagtgctgatcaggagcccccgactggaaaccagtcgggttcagaaccaaatagagatatcccagaagtagaagctcaagctaacaaccctcccaagacggacactggtgctagccctggaactagttctcctgttagggtgcaagaacctgctcgtcctcgactggaaattatcacaggtaaacacgtcctccaaacctgctttgatccgacaaactttcttcaattacttcactattattcatgactatctaagggccaatgattggcaatgaagaagaggtcctccggatacaatcggctgaagattctcgtccaccaatattagtcaagtgatgggatgatgaaatgcatccacagggaattgtaataaataagcaaaaggaagacgaggaagtatgcctgctgaaaaagacactcggccaagccactcgtcttgtaaatgtaggtctccctatatatagcctcaaccatcctgtcggtcactttagatgaacaaagataaatttgtggtgcagagaatccatcttaggaatgaggcgaagaccgcaaccctcgaaaaattagttccccaccttggaacccttgaatccaccagagaccagctacgcgaagctaaggagcttgccaagaaaactgagcatgatctgagagaccggatcgccgagctccaagactccaactttgagctgagcggttcgtcaaaaggtaaatatcgtctctgtctgacttgttccgtgttgctgtctatgtgcaacagaccaatgaaaagcaat

SEQ ID NO: 68748 - DNA, 8943 bp, Oryza sativa
  unsure (1)..(8943): unsure at all n locations
tgatgttgataacgcattctctctagggagggctttgtttgcagttaaatcctatttatgctgtcatggtgccacggtgggattcagatggttcaggattgttgaaagttgctgatgaagactatacaatccacgtctcaagacacttaactttctctaagtaatatcgtgaagtcttctggcttcatcattttatgacttcttgctacgagaaaatttgtaatgcaaaacatttcctattgttgtctgtagggaaattaagacatcaaatatatatatattttgcataggtctgtcctgtggggaaattgtcttgtttctattgacccactatcgggaagttggggtagtctctctgttgtagattagaatattcttatatgttatgctaagtgtaaaataattcaatgtagggctgacatgctggtgtgtggggtctcaacccagattacaatgagcatattatggtcatgttgagaaaaataaggaattgctgtagcgcatgctttttttcattacaactttctttttttcctactcatatatgtttgaatatgcttttttactattaggaattgctgtagcttatgtttgaatatgtttcaacaagagaagcgtatgtaaaatgtgaggaaaagaattggtactatttcttagcttatcaaaagccagtggatctttgttaaccctcacaatttattctgaatccctgcctactccatcaaaccttttatttctttcccgaggatgtatatgcaattaatgttggaaagtgtgtatgaaagtactttgttttctgctctatatgaattctcgctgatggcagcgatctacttctttcgtctcaaattagttatcttaccatttaaattttatcccataatattttgtcacttgaaaatattacttgttccatcaatcacatcttatttaaatttaaccactcttctattctcaactatattgtcggaggagtgggagagggtccccacttcatcggatgcttgggatgccatggaacccaccatgaaaaaatagaaaatgatgtaggactccaagtgttacttgagctgacgaagacggtccgtgggcagcagtagctcgggagcatgtctttcctacctcggtggcccaatgactactgcaggtgggaccaaggcccagaggacagtgctaggacccgaggtcttctagggaaatctcttttatgaaggggatttgactcggtcctatgcgcatctgtattaattatggggtgttacacatcttgtgagtagatcatggatgacatggggaacatggttatgcatgctatgtcgccccgaagaaaaagatgggctacgcgacgcactctcagcaagcattccacaggccctctcttaaaagcatcgatggctaatgagtgggcccatcgacaattgggatgaagactttggtagatctacttcacatgttagctggtagggagccaatcacatccgactagtctgtttggagagacagtgataagatcaagtatatcaatccctgtggggttggaccctgctctggtatacatgcatgaatgctgtggactccctttcacgtataaaagacggattcatgccacatagaaaatggttagattgtctggattaggctaagttagattcaaccctcagactcaatgaagaagggttcattatctccttgttgaagtaaaggtttatcctctcccacttagcacatcacaccaacatccattgtaaacttgatcatcatcacatagtgaaagaacatggagtaggttgttacatttcttaggggccctaacctgtataaaaccacctgttttcgcttactcattcacgtgccccaaccacgagcttggaacttataccctgacgaactctcaaggatggtatcttactttcccgctagaggagcttcttgcttcgacacacacattatttgataagggcattacagtcttttatttcaagccttagtatattatgccaaataatacagaaagaaataatttggaacgaaagtagtacgtaaattcgctgatctagctatgcaactacaagtacaataacttaatcattgcatcaaacctaatattgtcatcaattgtgtcaagccgtcattttgaatttttttttactaggcgaataaagcacgtggcaagacagagataaaaacaattcgattattggataggtaatttctgcaaagggattataattgggctgtgttcttttggaggtgttgggaacctctctcctccacacatgaaacagagtgatggattaacacataattaattaaatattagttatgaaaaacttgacaaatagattaatatgtttttaaagctactgttttatataattttttaaattaaaaaacgcattgtttagcagttttggaaatgtgtgcacagaaaacaagagtggtgagttgagaaattaggataaagaacacatgtcttgtacattaaaaaaagatgaggatgctggttgtggctacgactcacgatactggtatatatgattaaaaatatggtacacatgacaaatgacataacaaatcaattaaagcaagttgagcatccacccaaatagcatctgcagactgacatgtgggcccgaggtcctggacccacatgtcagtgagcagtaggaccgccgtcccttgctaatacatcaaacttggttgtgatttccttgccccatctaccaccgtaaaaggacagctattttgccttgctattatcagcggcatcaaggatgtaaagcatgtgccctatggggatgacatcaatgatgcgctactacaaagatgccaccgcctgaattcatcatcgttctagaaggctttgaaagcaaactgacatggttaagattgaaacgacatagcttagctatgtcttaaaacctatgacatgaaaggtttcgcatatggtttgcataggtttaatctggctagccgtcaatgctttttatgttgatcttattttcctattcatgctgtcttaatttgattacattaatcatccctttatcttttcataaaatctgtttggcatttgttgctgattcgttttggctaggagaaagaatatgagatgatacatttcgcttagactttagatgtccgaatctacgcattatcgtattatcatcattttagttggtactctgaaagttttacaatacatctctaaaatcggtaaaatgtttgtgctgcggaaggaattctttcgaaaattactgccatcggatctggatgtcgcgctgaggtgtgggtaggccaattcgggcgctggatccatcagcagccccctgagcagatttacgtcgcggtcgcggtgattgccgtgacgattgtgttgctgctagcaggtgatgtatcgattcatgccctagttactctagtttttcttgctttcaaattcaatcccttcgtccgatcctagatggctaggtggttgttggcaattttttgtgacaagttgacaactacgatcgtagcaccttatgccttgcggtgatcctagggtcgccaaccaccttgatctagcaaagagctagacctagatgggttttgacaaataaaccggctagcggagccgattctagataactacccgtctcgtgggcaaaacggaaggttttcaggacaaacctacaaagagatgttgcactctcgcaacggcggcagacggtttacggcgcaaaccgacaaagatggacaaactaagagaaaactaaaagcaatatgaaaaatgattcgattgattgattgtagattggttgttacaatagaaccggccatgtcccttatataggggttggtcttgccctcgacaggcccttctccatgtccaactcgggataaaagccaaagaaaacccgaaacatgtcttcccgagcaaggaaacctcgagacccgatgaaagacagtcggactcggacctgccggtcagaccggtcacacaccgccggtctgaccagccctcaaccggcggtctgaccgcccaatacacgatggtcagactgtcccactcgaaggaaaccggtagattttcaaattttagcaatctttcctattttaatcctaggtgccaaatttgggtgtaaacacatgccccccctgcctttttgatgaacaacgtgaatctaaaagcatagaacatgtttttggtcttagggcgataatccaattaccggccatagtacctcctaagcgtcttgctaaacgctcgggaagtatttcttcaagtatttcccgttgattactcgctgaaaatgctccccttgaagtgtctccaaaaaatatgcgtttcctcgaacaatgccgcatactcgataaggaccctcctaactaggagaccacttaccgaactccctagatcgagtacccaaaggcaaaattgtctttcaaaccaagtctccaacttgaaacaactttgctttcacccttttgttgtacgccttggccaccctcttcttctctttctctatctcttccaaagccttcaagtgcttgttgatgacttcatgaaagttgtctcccatcaacgtcttgtaatcttcacttgacaaatcatcttgcttgatataacgaagagaaccaagatttatctcaaccggtaaaacgacttcttgaccataaaccaactcaaaaggagtgactttagtggcaccatgtttagatatcctatgcgcccacaatgcttcggaaaccacttcatgccacctttttgggtgttcctcaatcttttttttcactagtttcaacaatgtcttgttacttgactcggcttgtccattagcctgagcgtagtaaggagaagaactcaacaatttaataccataagattcggcaaaattcttcacttccttaaacataaaagaagcaccttgatccgtagttaatgtttgcggaataccgaatctatggataatatgcttcaaaataaagtcaattacctccgtatgagtcgtattcatcagcggcacggcttcggcccacttggtgaagtaatccgtagaacctagcacgaacctatgcccctttgatgacgaaggataaatttgaccaatgaaatccaaagcccaacctcggaacggctatggtttgattatgggattcaacacggcggcgggcgccaattgaacattgccgaaccgttgacaagcttcgcatcccctataatatttgaagcaatcctcaatcatcctcggccaatagaaccccgctctcctaagcaaccaattcatcttgtgggccgattgatgagttccacaaattccttcatgtacctctcccatagctactttagattgatcttcatctagacacttcaacaagactctatctatattttggtgatataaatcttcatcaagcaatgtgtatttgaacgcttgccgctgaattttccgatcaaccttaagtgtgggatctttcagatatctaatcaaaggaattctccaatcctcctctgtttcctaggcacaaatgtccgaattcacaattaattcggcctctaaattgattgaagcgtgccccccaacgctctgcccagaaccggtcagactggccatacaaggccggtcagaccgctcggggtcgccggtcagaccggcgggatgtggccggtcagaccgcccctagtcaccagtgaactgcagagatatagcctagagggggggtgcataggnnctttcctgaaattttctcaacaatcgcagcggttaaattacagggcccggaacctcctggtgaagaacaccggaacttcctagcaatgatgagcagcccggaacttccggagttcttgcgtcaggaacttccaggcaacagagaaaaatgaaatcagggaagtaaaacaggtcctagctagagatgatcaggcacagagttgcacaagatgtaaatcacaagataccagcagattcaaacacagatcatgcacaagagagacaaaggcgattttttcccgaagttcggatcacacggatcctactctcctttgaggtgctcaaagagccgggtctcgattaaccccttgcctcacttatgcaaagatccgagaagaagtccacagccttcaactcaacacttctaggtcattttctagaattgagtgaccaccaagatccaactcacaattccttctagaaaagaccacaagtgcaagttgctctacctaggacaacctctgaaaactcagcacaagaatctttactcacttacctcgtttccttgcggaggtgaggaaaaccttcacaaactttcccgggacatccacaagatccttggaagctcacgggcgacacctaaccatctaggagaagatctccaagagtaataagcccaggtgatagcccacaaggtatccaaagtgctcaaacaaacctaatcttcaagctatctccaaaacactcctacactctaatctaatctctcaatctcacaagataggctctagatttgagtggaggaagcaaaggaagcttgggagtggctagaaaaccctagaacatgaaagagctgaagtggaatggccaaagggtgacctggggacgaaatccatatatataacggctaggtgacgtcatctagccgttactcacaagtttaaactggaaacctgccaggaggttccgggcaaaagtgccaggaacttccgggcaacacttaggaaattttttgcaatgaaacggtgcccggaagttccggccagaacctccgggtagccctctttgtcccggggagaaaaaacatttttcaaaaaatgattccaaaaatattttgactcatggatatgactaagagcactttgtataccctagaaccacacttgaaacccctcttaatagtacggtttttcctaaactcaatttcgaaagtgaaaaacctagtctaatcaccttcggtgtttttcgcacttaggaacattcaaattggggggtctccttgcattcttagccatcacaacttgctttgggactaaacttctgtgaataaacttgataaacacgttagtcccctttaaccaccttgtcattaatcaccaaaacccactagggggtttaagtgcatcttcaaccagtcagaccggccacgcaatgccggttagaccgcccctattccccaattttgccaatttcgcacaaagatttgaaattaagcaccggctcttctaataccagaaataatcccttcttcacactatagccagatgcctattgtgccaagtcatttgctctagaattatcatgcctagcaatatgtctaatagcaaaattatcaaaattggcaataatatccaagcatgaatcgatatacctatttagtgatccgtccaagcatttataaactccgacgacttgttgcaccaccaatttcgaatcaccaaaagcttccacgtacttagctccaaccatctccatgacttgtgtaagccgaataataaagcattgtattcggcttgattatgtgtacaataatattccaaacgaaccgatgcttcataacacatgccattaggtgaaaacaaaactaccctatgccttgaccttctttgcaagaagaaccatcaaaataaatcttccaaggtataacttcaactaggcaaacctcttcctcataagcaatatctacatgatggtctactataaaatcacatacaatttggcctctcatagatttcaatggttcataagccaaatcatattctatcaaagcatatgcccacttgccaattctcccacttagaattggcctttgcaacatgtgtttaataacatcggcttgacaagcaactatgcatgtactagataacaaataatgcctcaatttggtacaagcatagtataagcatagacaaagtctctctataaagacatacctcgtttcggcatccaaaagacggcggctcaaatatgtaataatatattccttgccatcctcctcttgcgtcaaaacggcaccaatgactttgtcttcggaggcaatatataaccaaaaaggctttccggctttaggcgcccacacaaggggtggagtagataaatacctcttcaactcctcaaacgcttcttgttgttttgccccccaagtaaaatcggcttcccttttcaaacgaagtataggaacataagcatcgattttacctgctaggttagaaataaatcttctcaaataattcaccttacctagcaacttttgaactcccttcttgcatgtcggtgctttgaaatcacgaattttttctatcttcttaggatcaatctcaactcttctctcatgcaccatgaatcctaagaacttccccgctgacacaccaaaagcacatttaagtgggttcatcttcaaactataccggcacatcctctcaaaggctaacatcaaatcggctatatgtccctccataccatccgatttgacaacaatatcatcaatgtagatttctaagataatacctagtaaatcatggaagatcaaattcattgccctttgatatgttgcaccggcattcttcaatccaaaagtcatgacaacccactcaaacaaaccaacaaatcccaggcacctaaaagccgttttgtgcatatcctcctccgccataaagatttgattgtagccgtcattaccatataaaaaactaatcaccttatgacccgaggcatcatttatcatcatgtcggctataggcatatgatattcatctttgggagtagctttatttaaatctctaaagtctatgcaaactctaatcttaccactccccttcttctccaccgggactatgctagaaacccactccgcataacgacatggcataataaaccccgccttcaacaaccgatcaatttcctctttgactcggtcatatagcaaaggattaaaacgacgaggtggttgcttataaggcctaacacccgg

SEQ ID NO: 68749 - DNA, 10023 bp, Oryza sativa
ggagtttattagagtagaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaattacgtaacattaggtgattttacaactctagactttgggatattcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtaatcgagatgtcatggcacagggccggtgtcctgctgctaggggctcagtcctgcctgcttgtcccgggagttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttagttcttaaaacctgcttaacaactaaaaggtggaatggttggcctgggttggcttgggacgagctgggacccagggtcgggttgccagttcggtctgaatcatcgtaggctttgggttaaggcaggttcgtgtgggttcacggccttgattaataattatatagttctagaatcgtgtttacaaaatagctttgagcaactaaatatctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggagcatgaaggctttggtgtctagctcgtgcctgccgtcaagtgcctgtagtcgtcgccctagttttccgctgtttctcgtttgtctttgtgtgtgctgggccttcgctgcccatgtaataaatgaactatttacgcttccgcttgttaaactctgaattgtatcaactcttggtgtaccttgcctcctgggacaaggaataatacacgcacgtaaggaacgcccgttgggttaattccggtcgtgacacgccgccgttccggtcgtcgtcgtcgctcgggaaggccaccgtcgggatcgccaagtcgtcgctgtcctcgtccgccgcttcaccatcgccgaagatcgccggagcaccgtcgccgccgtcgacccgatctccgccgccgtttcaacctcgtcgccgtcgccgtccgttgctcctccgccgctcctttggtcaccggtgagttcgccgcgtcgccctctacccgttggtgctctccgtttgtgccgaagcgccgccgttcgccagcgagcgtgtgccgtccgagccgccgagccgccgccgccggtggtgacgtcatcgccgacgtcatcgtcgccctctcccgtgagccggtcgtggaccgatcgatctcggccgtccgttttggatggatcgatctcggccgtccgttcccgtgaaccgttgccatgcacccggttcacagcgaaaccctagccgctgacgcaataaattcccttttccttttcaaaaataattcattattgcgtcataattcaattaaaatcaatataagtgttttaatccgatttatctttaaaaattcataactaattcatttgaactcagtttaatgtggttcaagttgcaaaaattatataaaataaagatctacatattaaaattatccataaattgaattaaatttatttaattctttataaatgggctttaattagatttaatcttgtaaaattcataataaattcatttgaagtcagaatgaggccgttcaagtctcataattcatctaaaattatgatctacatgtttgtttactttttatgtattgtttatttggtttttattagtcttttttctcgttttgcgtattagcttgtcgtttccgtcgttgcgaaggttcgcaagtgcgtcggaagtattcaagaagattaattgaagaccgattattgcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataacttgactagttgggctatatatatattggttcaactagatattagatataattgcttagccatgcttagaaacattagcacactattgggataacttattattcactattatttaatggtggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaactttcgtatagcatggttcattgcagagcaccagactgagaagtggcggagataagcccacgggggtcgctagggagtccatgcctctggtttttgaggggggtgattatgatccaggaatggtgcactgtggtggattgtgttgtgcgaggggtaatgtcacagctcctttccgaggtaccgtggtggtactgaggcacatggtgacatgatgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagccttcatgctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagatatttagttgctcaaagctattttgtaaacacgattctagaactatacaattattaatcaaggccgtgaacccacacgaacctgccttaacccaaagcctacgatgattcagaccgaactggcaacccgaccctgggtcccagctcgtcccaagccaacccaggccaaccattccaccttttagttgttaagcaggttttaagaactaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaactcccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaggggacggtgtgaatccaattccacaatactccaacaattccaaagtgtccaggttatatgaatatcctaaagtctagagttgtaaaaccgcctaatgttacctaattaaacagcgaagcatctacctaaaatcatactagtggtaccatgagtagagtgtccactagttggggttttgtttattctagggtgaacaaggaaataataacaataacaatattaaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactctatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatagatttattgcgtcagccgaggggaggggcgcgcggaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgcgggacgcgcccgaaggcggccacgccggcacagccgacgggaggtggcgcactcgcgccccgatggtcgccgccggcgaccaccggcgcggcggagcggcgcccgaaagaggggagggaagggggaagcgaatcggcggtccacggctcaccccgggtcgacggcgacgacgggaaggcggcggcgcggctcgggtagacggggacggcggcgttccggcgatcggcgaccgaaacggagaggtggacgaggtcggcgaggttgcggcgaacccgaaggaggcggcgccgaggcgggagagggttcggggcgacgacggcggcggaccggagctcggcggcgacggcggagagagagagcgacggcgcgagctcgattccgacggggagagagagcgacgagtggcggaaacggtggagggaggcacggggagcgtttatatagggttgggagtgagagagggcagtcggatgagggggaaacggccgcggaagatccggccgccattgatgcgccggcgaggttgaggggaaaagatcccgaacgaatccgatggagagagagagggaaaagtggggggaaagagggagggaatcacggggaatatttcccccctcttgattgcacgcggggcggacgggagcggcgggatttgcggcggcggcggcgctagggcacgggcgaggcggcgggagcggcgggaggaaggggatgacgggtgggccccacccgtcagcgagggtggcgggcgggcccgcccgtcagcggggagaggagagggagggggagggagctgggccgagccggcccaagagggggtggggggaaaaaaggactttttaggatttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcgaggatgtattttagagtcgttttgggacgcgacacggcggcgcacggctggagcgacggcggcgacggcggcgcgaagctacacggcgctagggcactacggacgatgagaggcgaaggcgagggtggcggcgggtagagaagagcttggggaaccttttaaaggggctcggaggcgacggcgaaggcccacggcggccggcgacgagaaggaaagatcggggtttgaaggaaagagaccgatccgattcgaactcgaatcaaacacattccaaaccgatttagccgatgtttccaaaggagaaaaggtagaggagatcccaaagattgtttcccctcaatcaatttcaccggaaacggctgcggcgcgaaactagggtttcgggcggcggcggcggcgcgaggagaacgacgaccctgacaggtggggcccgcctgtcagcgactgagagagaaaaggaaggagcgcgggctgactgggccgactaggccggggagggagagagaggaagagagaggttttgggccggctttcggcccaaagccaaaacagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttctaggcttttaaaatcatttctaataattccttttaaacaacaatttataatttaaggattttaaacaagaaaaactcttaacaaatataattagatcattaatgatcaaataattactgaactgttctttgtatcatttaggaattgagctccgaaaaatccgagaaaatttcagagagttgacttaatcatggagaatttaataaaaattaaatccatccatgctttatattaaggaaattttatttcccacatttaactttacttgtaagttaatgaacatttaatataacttctaataataatttattaaataatttataaatcctgaaacaaaaatcaggatgtgataaaaggcctacaaaattagtataacacttttctgcgtcaaaaaggattttaacaacattgggctatattgtcgtgagcaagtgttgccgaagcaaaaacaaatgcttaagtccctaaggatcacaacttaaccacgctgatagcaaaactggctgaagtactgtttaggcccaggcccattagtactcccgataccctaaggaaataacaccggaagcaaagcgtcggttcgtcttccccgccaaaactctcgccactttcctcattctctgctacagtgcaaaaccacaccggcggagctagggttcacagattcgctccaatccagccttcaaagctccacgaaaatctcccacgcaaccaccgcatcaatctcccatccattcccagccacatttcgaaccaaatcacatcatccaattcgcatccatgacggaagagagagaaagctttgagagccagtgggcgccatccgacgtaacggaggaaaacctgaaggagatggtggcgcacggtgttcttccggccaaggagatcatcgggtggcgtccagcatacggcaaaatgtttccaacccccgacatacacgaggtggttgtattctcccatttcttttacggcgggttttctcttccaacctcaaacttcttctgaggaattctggatttctatggtattaacctgcatcacctaaatcccaattccatagtccacattgccaacttcatccacgcttgcgaagcttttctagggattaggccgcatttcgctctattccgccgcatcttctttctcaagccccagccaaacaagagcaaaccatgtgttgttgggggagccggttttcaactgagggggaccttgagccaaaaatacttctccatgccattcaagacctcgaacaaaggttggcatgcgaactggttctatgtacaaaaccccgagccagtgcttcccgggtactcttgtctgcctccggtatatcaagatacctggaattcgcttcccattggagatgaggcagcccaagcacttgcattgatggatcgcatgctgaggctcaaagagcaaggtctgcaaggagaacagatcacccagcattttataaaaagccgactagcgccaattaaagagagatcctgcacagcctttgaatttgacggcaagcatgaccccaaccgtgaagatccagattctcttgagtttaaagtcatgaaggagagaatgtacaaaatcttctcgaatgctatcgtggtcagttattcgcacttgctgctagtggtgccatacaacgccttcaaccctcctccaccggtatgtcttatacaactcagctattctcaaagcatacttttatcttctgtaaggtcaactgaaaacttggaatatcatgcacaggaattcgctttgatgaaatctgaccctccaattgctcaacgccgctcaccccgttggaagacaagccaggccagtggagggccaaaaatcaagcctgctgatcaatctgacacttcgaagttgactaatcagtctgactctcggaagaggaaattgatttcaagcgacgatgaaggtgatgatgcggaaaagatgggtaacaaaggggtgactggaaaatagtcaaagcaaaccaatccgaagaagaaaacgtccagtcgtcccatgcaaaaaataaggaagtcatccaggtatgtgtcatctagcaatttcttctgtttcgctagtcactcactattgaagcaaagctgatagcatgtctcaaatctgtagaaaaccatctgacatagatccctctggaaaagaccccacgtcaactgacacagagactggtccttcagcagaaactggactgactgccgaagaccgcccgggtaataatcaaccggcaaccgacaatgtagataccaacaacgagcccccgactggaaaccagtcagccgagactgaagtcagtgctgatcaggagcccccgactggaaaccagtcgggttcagaaccaaatagagatatcccagaagtagaagctcaagctaacaaccctcccaagacggacactggtgctagccctggaactagttctcctgttagggtgcaagaacctgctcgtcctcgactggaaattatcacaggtaaacacgtcctccaaacctgctttgatccgacaaactttcttcaattacttcactattattcatgactatctaagggccaatgattggcaatgaagaagaggtcctccggatacaatcggctgaagattctcgtccaccaatattagtcaagtgatgggatgatgaaatgcatccacagggaattgtaataaataagcaaaaggaagacgaggaagtatgcctgctgaaaaagacactcggccaagccactcgtcttgtaaatgtaggtctccctatatatagcctcaaccatcctgtcggtcactttagatgaacaaagataaatttgtggtgcagagaatccatcttaggaatgaggcgaagaccgcaaccctcgaaaaattagttcccccccttggaacccttgaatccaccagagaccagctacgcgaagctaaggagctcgccggggtgcag

SEQ ID NO: 68750 - DNA, 12125 bp, Oryza sativa
cgcccaaagaccaaaacatgtactatgcttttatattcacgttggtcatcaaaaaggcacggggcatgtgcttacacccaaatttggcacctaggattaaaatagggaaattgccaaaatttggacgatctaccgatttcctctgagagggccagtctgaccaccgtgtgttggccggtcaaaccgctgccggtgggccagtcagaccgccggcatgtggccggtctgaccggcagagtccgagtcagactccgtattcgtcgggtctcgggtttccttgctcgggaaggtatgtttcgtgtttccatctgtttctagctcgagttggacatggaggagggcctgtagagggcaaaaccaacccctatataagggacaaggccggttcaattgtaaacaaacaatcaactatcaatcaatcgaatcgttattttgcttttgtttctagttctagtttagtttgtccatctttgtcgatttgcgccgtaaatcgtccgccgccactgcgagagtgcgacacctctttgtaggtttgtcctgaaaaccttccgttttgctcacgagacgggtatttatccatagttctatctatatcggctccgctagctggtttagtttatcaaaacccatcttgatttagctttggctagattgaggtggttggagactctaagatcaccgcaaggcgtttaggtgctgcgatcgtgcttgtcaacttgttacaaaaagttgccaacatgttggtttaaccttatctaggtcttaagtggaaaattttaggatttctaaataggaaaaaagattcaaaagttttagatgcaaattttgttgtccaatattttgggtatgttacaaacctatcccccttaaaacaaatgtaatccccgagaattggtttaggttgtggttggaaaggacggccgcagtgtatgtcagctcactaaaggcaccattctactcgtgaggtccttgccgttggtcccccggtaggtttgtctttggtggagatggtttgggagccaatccgcacccagatgatggaaagctacctaaggtttcgtggctatgttactttctgataacatgatatgatttattgatttataagtcttttcaaacataccagatatagtatatctaacaaacaaattctacctaatgttgctactagctgatcttcccacagtccctccttctcctaaaggaatgggagatggtgataccccttttaagttgtattatttaacttactgcaataaaacaacagaaagcccttgcttggtcgagggcggagcggtttctacttggtagtgtcatgtacagtccgtgaaacatgcaattgatggaaaagtagcactaaagcagcgaagtaattgattgttaggtttcacatcttctctaacatttaaagagtgctcaatcacctctctaggaataccaggcatatcagatggttttcacccatctttgtcaacttgatattgcgaaccactgggtctagtaccgggggtaccgccccgggtggaccactcggtcaggatgatccgagtggtcgaacatgattgatacatcagaccaccattgatattgggtacttcgagctgaactgcattgatttctctgtcgattagcttctgcttcctcttggactcgtaggcgagtgaattgcgagagtgtagatggtaagccctgactcggtttcagtcttaccgtcatacttctcaatcccagtgggtttgaaaccactcggccaattcactcgatgcatgtatctggtgaaggctacaactccctcatcaccgctgtcgggagagtgtcggggtcaatagcggttgacattgttttctctctcgtggtagtgctgattgagagtgttccttaggttgctaggagctagtgccctgaagtgctctgatagtcggaatcagccctgcgatccctgttgtaataaggggctggttgtggtgaccagtcggcgtgtcggccgactggtcttgacgccacgtatgttcatggcattgatgagagttggccctactactctcaggctctcggtaatttgtaggtcgtaatggcggtaggcggctgccgataggggtctgtgttgtagattcgttgccttgccaactgcttccggagctgcgtgggatggaggccgcgaccatggtcttcaccttgttcaagattggcgcgacgttgactggagcggcatctaagacaatcaaggtaacaaccatgacggcattctgttgaggtgtaaggaacacattggtgtcgtcaatgcgtgtttgacctataacctggcaaactctttgcccggcggcggccaactcccgcagtctacaatcttcttcctccttgcgcttgcgctcttcctcttctctcaacgctctaatctgaccctttccacctcagcaattctctaggccatctgtgtgtcggtctcgacattggccatgaaaacgttgaagaagacaggggtgtatagccatcgttaaactcggagctgtctacagtctctatgctggcgtcgtcgatcttgtcagaagagctgaagtagtcaacgatctcagtagacgagcaagatccaagtggctggagcaggacaccgacctccctgtagcctgatctgatttgagccgagactagattagatcgggaactacagggggaaacagatctagatccaaatgtcacttcgagaaggggtagaagtcgcaaggtgattgtatgccggcgtcctatcgaggaggccacgcgaaggagtttttgttgaagattcccccgagcgatttgaagccatctcgaagaaagaaactttggagtagatctcggctgcgtttgggagtccaaatggagccgagtggtttttccgtcccgactggttcgaatccgagtcaaggagaaaaatgttgccgaagtcgtccatgatgaacttgaggctaccgaagcgaaacacctgcccaggagagaagacgaagtcatcgatacccgaaggagaatccatcgcacttgtcagcgagaaaacttgatgcagcccctacctagcgcgccaactgtcaaaactagaattcggcaatacgaaaagtgggttgcgcaaagtatctaaggtggatgggtgatgagacaagggtttatataggttcaggccttctcgataagaagtaatgccctactcctgtttggggattgtatccgttggttgttgtattgatctgacgatcttagttccttatatagacggaggagacaggtttataagatagagatttaagttaatatggtttaaatctcctacaactactttacaatcttaccgaactaggactacacgtcatttccttgatacacaagtaaacataatacccaagtcttaattctttacatattctatatacataatctatcccttataactagtcggatagtgtagccgtgtaggtacatggtaaccataatcttcacaggtctactgggtcttcttcagcttgagagatgcgctgcaagtaagaaggataaaacagtgagcaaacaatctcatcgactaaagacggttccttcttttgtgtgtgtcgtggtgttgttggttatatgcactttgtgcagaagctgaatgctttcttttgcctagtgaaattaccattatctaggaaatataaattaaaaggcggttctatttcactggatgctactaaattttataaactaattcatggcaaccatgccctagtaaaatatttcatctgttgtaaaagaaaatgtgattctctttcaagcagtggtatacgtaaggacagttttttttttcctttttgaagatttggtcagagtgcattcagttgtaattggcacctatacacgtgtgggcctttggatccactgttggcaagctgcaactctgcagtcatgtatcaaccaaaagaacatgtatagaaaggtccttcggtgcaatgcaacacatatgagacagatattagctatggtactactatgtatatatgcacggaagtttacttagaaactaatctgggacttaccggagttgaacaatgggaaaaatgttagtgggaaaattaagcaaacagttaatttcgtagatacccctcaaaaaaaataatttcgtagatatgggagacaatgtttctgttcagatttcaaatgaggcctatgaacaattgataacaagtgaagaaaatctcacatatacctattgatacagtatcttttccctgttggtcgtggcccatcatcaaacacgtgccccagatgagcgtcacagacagcacacagcacctcagtccgaggcatgaatatgatggacatatcaagcttgcactttacattatctccaatgggttgataatatgacggccacccagtaccactatcaaatttggtcgatgacctaagaccaccagaaagcagtaatgcagaataatgagcagactataatactattgttttggtgcaaatcgaaactactatctctagcttatatgaaagaacaatcttctgctctgacatgacaatcaggaggagtgcttactcaaaaagaggggtgtcacagcagacacaatggtagatgcccggggttttggtgttccagtattccctgattacataacaaaaaacacaagaccaaaatgacatggtgtgcaactacacattatacttggattagagtgtaaagcaatcgtacccagtaaatgctctttctgtgcccttctgccgagtaatgtaatactgatcttttgtcaggcgcttcctccactcctcatcagtcagagatgtactgtagttcggtttacctgcctcagaagaaatgaatatttggctattagtgagaattgaaacaattgttggaacctggctacatacagatctggagtacttcagagttaagagcgtatgataaaaaaatatcttcaagccaggcggcattctaagcatttgctccataagaaagcagaacatcaatgcattattctcttaaagatttgctccacattgtgaaccctgaagatcaattgttctaacaaactataaaagaaggagctgctggcatagacaaaatcgatactagtcagctcagtgactcactgcatacaaatgcttgtaaggctctaccaggatatagcaagaatgcacaattctcttaagattaccttagatttgtaactgatgtgtgtttatactatatgttctgtactctgaactaaaacacagaattcttttctttctttctttctttttttttttttgtctttgaggtacacagtccgaaattcacacctataaagaatgtccgcactattgactggtgaatacacttgtgagtaacatataactgtttgaatgaaaatagctaaaaccactcaggatctatgtagctaacttataaaaatgtcttagttgcaaacttgagcgggcaataggggcttcactcccgaattacggtctagtaattttctaaaatgttcttaaatgcggaaagaattagacatagaaacggcctacagcagatcttttaagatcaatcaaactccctccttgtttgcatcgaatgcacatacaaactaatcaccattaattcaatttctatttccactcgcgaataattcccttgcatccaaaggaagcaggcaacaacgggctcccactaggtaggtaaagaagttagaaggtgaagcaccacacggcaccttgggcttgggcttgggcttgaccctgcggcgacggagacgacgacgacgacgacgaagacgatgaagcggcacccatggcacgaacggaggctcgcctgtagctagcacggctccacgccacaccacagcaaggcgccaaggcaggcggcggctgggaggcaggaggggcgcgcccgtggacgtgctctgaaactggaggaggcagcggtagcagccgcgtattgccgcatggccattttcttcggctcgagaggagtcgcgtcgtttggcggacggaccgaccagccgggcggatttgcctctgcgagacagagggattccgtggctggcgatgccgagacgtgggtgaactggatcggcacacgcagaagctgcagcaggcacgagcgttccagtctgcacttcactggaccagtccgtttcaattgccaaacaggggtcgcaactcgcacgcccacgccgccacgatccatcatccggccacccgggctatggattgtgtggcgtatcaaaatttctgtcaccaaattcctgcgtgagctagatgcaaatagaactctacgatcaagcatttatgtcaaaatttgtatggattaacagttttagctcaaaacatacgatcaagcatttctgcaaatgtgtgtgtactttgttcatagagtgaattgcaccagcggtccttaaactcataagcagatttcacctaggtctacgaacttacaaatcgcatatcaagatcctttaacttggtttattgtatcattccggtccaaaacttcattgaccgtggtcttgcccacgtggcatgccacggtggaccatcggtggtcacatacaagtgtagagaccaaccaataggtggggcccactaaaaaatcccttttcttttttctcctccttcctgttgctgacgatgatgagatcctagggccgcctctcccctcctctccaccaacaaccccctatccaccggtgagctagtgagttggctgtcgctaactcgacctgcgcccacgcagggtgagagaggaagcagccgcccggtggaggagaaatgctggaagatggggaattatttttctcatctactccactgacggcaacgacgacggagaggaggggaagaaagaggatccccggccgcttgaggagcctcctcggtggccgccattgttgacggtcgtcgtaaacaaatttcgactgtcaatataactaaaataatagagaattagcttatacttgcaatacatatttgttttcaaataatatagttccacttgtacaaggagaataacatgttgaaggaatttatcaaataaaataaagagaaagtggagagaacctcactcctaagcaagcaaatggataaggagggcccacatgacaggtgtaaccgccgaaaaccgcctaatctgccacaaccgtcattgggacccacatgtcaaccaccctgccaaacttgggggcctattgggctagctcaggttcggccaaaccctagcaattgcggctccagctggccttacacgtgggcgtctaggatcacatgctgatgacggttacgagggtaaaatcgacatttcgcatgccagtaaccgtcataccgaccctataaaaagaggagctcactttacttcacaacacactcaagcaagcttaaattcctcttcatacgttagtattagtattttagtgctaagtggagtagaatataatagtattcggagtcctcggagtcttcggaagagttttggtatggctcaagcaacttttgtattctcttctataatactttcgatattaatgaaatactcttctatatatatgttgggttcttactttatatctgtggttaccaattgtgtgggtagcctactagagaggtgcaatggtgcgggtttaatgtctaatttatcaattgctctatgtcatgtgcacgggtgtagagtagtatttagtaatgtaagcatcgtgcttagattattaaatatcattaattgggcatatatcctacgggacagtagagatgggccgttgatagtgacagctcagtacggatattccttcacgttagtatataatcctaagacaaattattggggaggatactcctccgtatttagccccagttggacggccatgacgggttatcgtaaggaactcggcaacccgaggtggtctctcgaagtaccaggagggcactgttagggggtattggccacacgattgtatactagcagatgtaaactaggatttgagtggatactagaagtataggaattgaatgctttctctttcttctttcacttagttagaattactttattatgaggatttgatcagcttcgtgtcactctacccctaacttaacccctgcctagactttgacaattacaagtaatatatgtataaagtgcattagcaaagttcactcttattatcttcccttgggattaaaaatatgttaccttggaatacttctgggcgaaatgctacaatggtatatccgtgcacttgcagattacttctgtaatcataaatataccaggactatttctggtgtcattgctgggaatgaatatttctagtaatgtcgttaagaaataccaacagtgtggctgtaccgggatagtgtaggtggcgaccggaaggccgctgctacgccgcaagtgatcgccggtgaccccttcaggatcaagctggcgttcttactgctacgactacttcccctacgccaatgatcgctggagcagttcgagggacttcactagggatggcaatcgagcgcgacaggcacaggtagtgcctacccatacccgtgcccgtgagattatttgtacccatgagtatgcccattactacattacgggtaaggattgttgcccatgcccatcgcccgtgggcgtgcccgtttacccgccacaacaaaagcagtggaacaaaaagtctacaagcttctaagttcgaatcgaacttaaaacatcaaatattctctgccttggtgtagtgtctctcctctggtggcgatagaggaacggggagagaaataaaagggaaaccgtagaaaacaaagaacgtggcttatgtatcctagtggattttgctcctagcctacatgtaagttagatttcgcgggtaaacgagcaaagcgggcatgggtagtgattacccatacccatgcccatttacccatcgggcatagcttttgacccaataagaaacccatgggtataaaatggagaacaaacccaaccctaatagggtttttatccacgggtaaacgggcaaatgggcacaattgccatccctagactgtgccctctatttccactccggctgacggcattgcagggggtacaaggaaaagcgcatcaatggcttcaaacaacggttagtaaccctaagaattccgtataagggtgatcatatttagacttagcactcatgttagtagattgcaaaatttacatttaggagtacacatttctggttgtatagttaagggacctaaaaaaatctcgctaataagtgaggacctccggtgaacttatttccacgcaatatactaggaagcgggccaggctgttccggcaggcccagccgcccaggcgtgccgatgcctccggggtccgggccaccgtaagcgggtacgtgtccactgtccagattcatccacacctgacccaggcacgcagacaagtctaggttcgccgtcgtcctcttcttcccgacgcttcatatagttgcctcgtcggcgtgcacgatcccccgccgatcaagctagccggccagccagcgaagcagctccggtgctacttcttgcctatacctcgcaacttctctcatggcggcggcggggaaggagccgagcagggttctggtcatcggcggcacgggctacatcggccggtacatcgtcgccgccagcgcccgggaggaccacctcacctccgtcctcgtccgtgaccggcgccggcggaccctgccaaggctgccgtcctccagggcttccgggactccggagccaccctcgtcaaggtcagctgccgccgctccttcctcgttctttcttttccccatttcgtttcctgttcatatgatgaattctgcattgtattatccatggtgaggaagtagtaatgggacaagtgatttggtttcttctatctgtcaacgaggattgattttttaatagatttgtgaaagggaaggaatgggagttccaaaagtcatccaacaaccttttcaacctgttcatttcagtaaataagataagaaaaccagtgtggtgatacgtggattagtagaatactatctccatttttaatagataacgccattaactaatgtccatttaaaaagattacgtaatacaaaaattttaaataagacgcatggtgaaacatgtccaaaagttaatgacgtcaactattaaaaaacagggggaatagtaaaatgttcagaaccaagtagaggttatggggtttaaatcattgctttgaaacatgactcaaagtaacacttttaaaaagaaactgcttggactttcaagatttcgtcagtgttcaagccacaaactaattgtctcagatgcagacagatgttcaagttaaagcttgaattctggttttaactgggttgtctcactgcgtagtgtgttatgatgtactaatgtgcaaaaaagatcttctgaaagctcgtggtctagtacaggtaaaatgtcatagagctgattgtttatatgcccttcttgatagtaagtgcagttgtcagattaaacagcaatgatatatctcaggttccacaatgattagtttatgcctcatggtatgatttgatttgatgctgacatataaaagttattcctttgctggataattagggagatctttatggccatcaaagtttggtggcagccatcaaatctgctgatgtggttatctcggctgtgggttacgcgcaactagcagatcaaacccgtattatttctgctattaaagaagcagggaatgtgaaggtgaccacctaaacttacattacaaacatttcatggctgttatacttcaaatttctgtatgcattgaagagtatgtcgttcatctatcatgacttgtgatgttgctttgtgcattaagatagccttcatggatgattttgaatattaagttgtgatatcactagccttgtttggtacaaataaccctgattctaattaatagaggttaatatctgttttctcttcccacacaataaagctctcacatgcaaacaatttaatgctggatgtatttttttatattttctcgaaactgtggtgagcttgctcatttgaagaatccttgaaaggtggcttaactatctagtttccatcattccttttgattaatgtggatagtattgtgcagagattcttcccttcagagtatggtaatgatgtggaccatgtacatgcagttgagcctgtgaaatcagtgtatgctacaaaagctcgtataaggcgtgtaattgaggctgaggggatcccatacacatatgtctcctcgaacttctttgctggtcgtttcttgccaagtctggcacaggcctggatcaagggccttccaaccgacaaggttatcatccttggtgatggaaatgtaaaaggtaaaactgatcatgtgtgcttattatgcttaccgtgtgttgttttactgcagaagatctctcttttttcaacgagatataaattgaacaagaaaaaaatacggacacattgcaatgcatatattattttttttattttgtcaaaaacaggagtctttgccacagaggaggatgtgggtacctacactattaaagctgtcgatgatccaagaaccctgaacaagatcttgtatctcaggccatcaagcaacattttgtctcacaacgagctcgtctcactctgggagaagaaggttggcaagacatttgatagggtgtacatcccagaagatgaagtcctgaagaagattcaaggtgagaatcagccatgttctctcaagtgcaatacttatgttcagtagatgcttatccctattttttcctgacatttgactttaattcagaatccccagcaccgttgaatgtcgtactgtcaatcaaccattctgtctgggtgaagggggatcacaccaactttgagatcgagccttcatttggagttgaagctactgaactttaccccgatgtgaagtacaccactgtggatgaatacctgaacaggttcctttgaaatctgtacaaatcctacaaggctcgaatatataaaatatggaatagatattagacagtgaaagttgtgtttttcaataagcaaaatttaattttgtacaaaacgctctagagtgtaacttattgagaacagtgatgctggtgctgtctttgctgccaccgccagat

SEQ ID NO: 68751 - DNA, 1905 bp, Oryza sativa
  unsure (1)..(1905): unsure at all n locations
tgtaacaaacaataactttcttacactcgggttcttcatcttgtacttgatttctcagctgctgtattggaacttccaaaggtacaacgcagatactggcccctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgaccttggcggggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaagccttggggagacttcgcatcttcatcatctgaggagacttgatctgaatcttcactaccagacactctacctccattagctaaaagatgctctgtcaactgttgtgcacctcgggaggaatttcttctctgatgttttgtcattcctggtggaggccattctgtgctggtaatgatcatcttacggacttcatcttcgttcgcattcgtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacttgatgttgcatctgactcgggttcaaaattggcatccgatgctgctgtagtatctctataagcaattggttctggttaatcaggtgttggaccactgccacacaactggtgtctggtgcttcattcactcgggagcttgaagtaccaatgtcctgacttctgaccatattgcctttctcattgtcagccatctgttgcaaagtttggagagggagagagggaaaacaaaggggagagacagattagaaactaaggataggaccttaacagatttaagtctttggctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctcacttcactagcggatcctgcagtcttccggagcttcggcaaacaattgacgacatcttcttcttcgcaaagctgaccatctagtactagttgaaattccgaagaaggaagaacggagtaaaccttntgcaaatagcattaggggaaggagaaaaaggaactttcgcannatagttttattcataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacaca

SEQ ID NO: 68752 - DNA, 1464 bp, Oryza sativa
agccaaaaggtgcatcctggtccaagtcaggtgaagagaagattccatctgcaacaggagatcgagccaagcagttccgagtggtaaagttttgctggaagttcgtcaagaagacgcaacggaagaagtcagacaagaagagaagaccgcccaacctatcttcttgctagcctcctcgaatctcggggacgagattcttgtaaggggggtggatttgcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggagggattgagcaagaatgagtacaaccacagtactcagcaagccacaccggcggatgcataattaatgcaagggaggtacaagggaataataatagggattaagttttgcagtaaacagcatttaaaagtcacttagttgcccaaagccatttataaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtcggtagtgctttgcaacagaggcccgagcttaatccttatagtggccggggtgctacttcccataactggcatgcacccaaaccccaccgaaaacaggttttaggggttt

SEQ ID NO: 68753 - DNA, 2322 bp, Oryza sativa
tatcctcttctcaatgagagtaaccattgaagttctaacaaaatttatggagtggcgccaaaaaaaatctctaaagaggataaccatttccataaacaagaatatgcattaagtagagtttcaactttcaattgttaactttgggtaagattccaaatgatgtagatactacgtgtagagcatgaggggcacaaacacaatcctatagtccaaattgcttcctaatctgttgaattaaatttaaggtctgcagaacagattttatttcctggttatcaccagtaactgactagttctcatctgaattttcatccccggcctcaacattttttttgcagatatgaatactactttgctttattgcgggacttcccagatgtgcagtttactctaaatggaggtataactactattgatcaagtgagtatcttactctagttatgtagttttgataatgcaattcctggaagttgctattttaatgaacaaattgcgtagcgagtccatcagttcaaattaggtcaaactgatgttaatgatacaattttccttggcaataaaaaaacaattttgtttcatgaatgcaaaaagaatatatttgttctctctgtacttagtactagacattcatgcagagaagtagctcttgttgcaatcagatataatatgcctgagtcaagtcatttttattgaacatcagttatattcatttgcaggtcactgcatccataagacaaggtgcacatcgagttatggttggccgggctgcatataataagtatggtcataattagaagcctttgtgtctctaaattctttgatgctttcaaacatgcaaactaagtaactagaatatgtttccttttgttgctgaaaacctgaaacagtatttagttgtaattttaattttggtatggaataaatgttcagtccatggaacatgctggggcatgtggacagtgaagtctatgggatgccgacaagacgctcttctcgtcgccaggtttagcatcaaaggatggttttgttttcagctatcaactatttcttttataagtattaactgaactccttgttttagatccttgagagctaccaggtttatggtgattcaataatgggccaatatggccccagcagaccaaacgtgagacaacttgtcaaggtgtgggttgcacttacatttaatgaaaacaacctattgttagctttatgatgtgatgtagcagggcatttatgtacttgtttcaccttataatgtaattatctgtgacgtatgcaccattgtgttgatcatagctttctgaattactcaagaactgttacttttgtttgcgtatagatagggattctactttatgcctaaaagcctaagatatgagttataaaagataattatagcacactaaatagaaaatagagttcattgaagaaaaggaaatgcactgatcaaacagtttcatctgtttctcctggtattctgagctgcttaattgtggtctaacagttgcgagttctgcattctgtgtattgatctggaaactagatttaatgcaattactatattgacctttatcagtccttttgtaaaatttatgagcttatgcaaatatgtgctttcagttactgagaaaatcgcttgattttgacagccattgttaaatttattccactcggaacctggcaatggcctttggaaacgcaaggctgactctacactgcgtcattgcaaggtaagttataaaaaaaaaagtctatcctttgtcatgccacattacttcttccaacaaatacaacagaagaaagatgcctatactatactcaaatgaattattgtgagacttggttttatgaatacttgtaaggttaattttgatctagtaaatgaaaatgaggaagctgttcaatctccaagtggtcaagtaatcatctcaaacacttaactagttttttttttctaacttaattatctgaatgttgttggtcatcattttatatgctagccagttatgttttaagctacctgaaaatgagaaaatcagtatgaggtgcacaatcatggatttggaattttacaccttgagggcatgtggcccggaatttccaaacctttcaaatatcaattaaataaatggaaaatattcaaatattaaatttaatttatcatttcagaacatttcaatttgaaactcagatgtgtatatgaaggaaccgaagaatgactccacccttggaaagcaagagccaattcatagctatattttgtttcactaatgacttgacaatttgtgcctttaacttcattcaaaattttcatgacgg

SEQ ID NO: 68754 - DNA, 713 bp, Oryza sativa
atccggcgtcgcgcagccgcgggaaggcgagcatgctggggaacgtggcggcgctgtccgtccggagcgcgagcgcggggacgccgagccgggccgccgcgcccagcgccgcgtaccactgcccgtccaccacggcgcacgccacgccggggagcagcgacgccagggcgtcccggaacggggcctcgcaggcggcgttgagcgcgaggagctgcgcgacgatgtcggcgccaggggaggtggcctcctcggggagcgccgcctcgtggatggggaggaaggcgaggtccggcccgtggcggtggcgcgccgggtcgggcgcgttggagcgcgtgtggaggacggtgacggcgagcccccgcgcgcggaggagatcggcgagctggagcatggggctcaggtggccctggaacggcagcgggaacagcgcgacgcggcggccggcgtggggttgccgttcgggttcccgttcttgcgtggccatcgctgccgtcctcggcgaggtcctggggcttgcgacttgcgaggtacaagcagcgagcgctagagagtactgacacggatttctttttcaggtcggtggagaattgtttcaacaaatgcggctatatgatattatgatgcgatggcatttgctaaggtagtacttccattcttatcacttgctcccttctttcaaaataaactaaaattaagtgaccagtatacatatg

SEQ ID NO: 68755 - DNA, 632 bp, Oryza sativa
ctctgatcagaggtgtacatctttacccacaagacacattttcctcacgtgtaaccacgtgtcacataccaccatggtatacggacggaagacatgacatagtttccaacccatcctagccataaacaagagtaccgacccaaccccacctacggccggaacccccgggacaggtaggcaggactgagtccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgtaacagaggcccgaagaccggtccttatatggccgaggtgctactatcaaaaccatgcaccccgagcccagcctaaaaccattttgagggttttgaatagaggggaggtgtgaatccaattccacaataatccaacaattccatagtgtcgaggtgataagagtattcccaaagtctagagttgtaaaaccacctaatgttgcctaattaaccagcgaagcatctacctaaaatcatactagtggt

SEQ ID NO: 68756 - DNA, 11646 bp, Oryza sativa
caatcccccattgagaaaagcatttttaacatcaagctaggagatattccaatgacgagtagaggctactgcaagagttcaaacaatggtcatgtgagccacaggagcaaaagtctcatgataatcacgaccatgctcttgttgaaaaccacacgctaaaaggcgagctttatagtgttcaagagttccatcagagcgagtcttgaccttaaagatccctttacacgtgataggacgaacatgagatggcaatggaacaagatcccaagtaccagtacgctcaagtgcaacaagctcctctgccattgcatgttgccattcttgatgaataacagcatcacgataagaactaggctcagcgagaacagtcgcaacataaccatagcgatcctctggacgaatcgtaactaaattacgatcccgaagattgtatctcggaggagcaacaggagaagcatcaacagaaggctccataacacgagggcgacgactatagacttgagtaagagggtttaggggaggtagcagaagcaagaagactggtaagcgcagcggaaggaagacgaagccagtcaagctcccaaagatgctgagaatcatggcggcgagggccagtaccaaccaggagacccatgcgtcgatcctgaacacaacaagagtcagaatcaagaataacacgacaatcatgatcaacaagctgtccagcagacatgagctgtatggtcaaatttggaacataggaaacaaaaggaacactacaagaagatgaaagagtcccatgaccaacaacagaaagaggggtaccatcggcagtttgaacagtaatagggactaaaggatgacatatagatgaaagacaagacttatcaggggtcatatggaaagaagcaccagaatcaagaatccacggaaaagtgagaaccaggaacaacaaaatcagattgtgcagagggcaaagcaactaaactagctaaacctgtcgaagcagaagcagtgaggcaacgcagtaacataaggatctcctgtgtatcagaactgcagaactgccagtactcttctgagaagaagagcgagtactcttctgagaagaactcccagcaaccgatgaagaacgactgcgccataaatccttcttcttcctaaagcaaaatgactccacatgtccatctcgatcacagtaagtgcaatgaagatgaccactggaagatgataccacttgagaagaagtatgtgctggtaaagtaaaggaaggagctgctgatgatgaagacactgaagctgtggtacgaacgagtactgaagaaggatgcgatataatacccgcttcacgaagacgaatctcctcagaatgaatctcagttagagcctccatcaaagtaacacgggggtgccgagcaagcaactgtgcacggatcgactcatactcagagcgaagacgtgtgaggaagtcatagatgcggcgaagatccatgtgagaccactggcgctgacaacactgacaagtacgacaaatatcaggtcccaaaggatcaagctggcgctagacagaggataactgtgtatagaactcatcccctgtagcatctccctgctgtaaagactgcttctgacgcaccatagcaagatatagagcatcaccagtaggtgcataacggtcacgaaggtgtgtccacgtgaaatgagctgaagcaagggtaaccacatcaccagtaagatggacctccatactagctacaagaatagcagaagcacaagcatcctcatccaaccaagtcttgtacataacatactgaccctgataagtttccaaagcatcatcatactcctcttgtgcctttgctctgtcttcatcagtagtctgagctgaaaaagtaggcatagcttgagccaaggggaaaggggggcaagctagctcaccaaaaagaacgtcccaaaggcgttgaccacacatatgtagacgcatatgctgagcccaatgattatagttgatgccatcaaaaataactgggcaacgaggaactgaaactgtgcctgatagagatgacattggcacggagcaacgggcgacggcgagagcgcaaatgaaagcggcaacaagcgaaagaacaggaacctctctctctctctcttttcttttgtttttcttttcttttcttttttttaacagcctcggagaaacacccaaacgctggtgcaactgcacaggaaaggcagcaagaggctcttttttttattattttttttagaaaaatcacccgatctggatcggtaccgattcgaaggaaacgaatcgacaccggcgggcaacacgaaacgaaatggcggttggcgctgggcagcaacgagcggcagctgctcgacgggcagtggccggagacgggtggcgaccggcggcggccggagacgagcggcgccgcagccgacgaggggcagcggccggagacgagcggcgacgggcagcggctgaagacgagcggcgccacagccgacgacgggtggcagctggagatgaggggtgggttgcggccggagacgagcggcgccgcaaccgacgaagggcagcggcaggagacgagcggacgacggtagccgacgacgagtgattgccggcggtgagcgacgggcagcagaacgaactggagctggtgacggggacgacaagcggtggccggcgagcatagatgagcggtcgccggcgcagagacaagcagcaccggcgaccacgacgagttcgatgaccaccgcgaaaaaatcgaccacaaaaaccaggtaacgtgtgtggaaaaatctttggatcatctaggacaagaagaaaagtctaaccctagtttaggctctgataccatgttatgaacagcacttttattcaccttagggcaaaaggcccaaatatatacaggtacaggaatacacaaatatacagaaaaaccctttacaaataaaggaatataaaatctaaatatacatctaacagaaagaagctcaaatataattggtaaccagaattttggtattaattggagccggttgggaacaattaccataggcaaaatgattgcccagctttacatttaggtgcaaatcagacagcgaattatttttatgaaaatgacttacagaattggtagctactttggctaagcttggcaccattagtagccctactaggctattatgccccaaaaagaacatcttaagtcatttggagcaagtaaactagtctaaaaggatatgcctactttgcactttattttatggtatctggccagaagcattgctacttaattagacttcactctaggccagatatgattacctcaaaatgcagaaccaaggcagactaggcaaggttaaccacttaattaggcttctcgaaatgcagaactaacataatcaaacttctatatcttgtaaagtaggggctatatgaagttcacccaaactgtaacgctatccagttttcttgtctccagtgccgtcaatggggacacaacagcaatgaaatattaaaatgtggacactgaccagttctcgaatgtaatttatgtaagtatggagatcaagatcttggattgttaaaaaggacatagacctctgttagaatttcaatggttactctcattgagaagaggatggcactcgagatgggacaattttctggttttcttcattcacaaaacacaaaagccatacctacccgagggaggttggatacatatatatagccatagctggctgctagcctattgctgcaccctcctagtctaaaattcgaaatttaaatgggatgctgtcctagagggcatccaaactgaataaagcataaaggaggcataaaggagatgctaactgctgctgtcctactaaccacagctgtcctagcaactgaaaaatatgctaaagggtagatgctgtcttgaaaaaggtgaaactacccaaaagcaaaaagaagaatcacgaccaaggaccacaaagacttatccaacattctccccctaagtcttgtgcgtcgtcttgtggggaagttgggccatcccgatcctagagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtgaaaaacggggttctttgccagggccagagcggacttgctatccaccctgagctccaccgttccagtgtctctgccgaggagatcactaagcagtcgagcaagccagagcgcctgggtcgaagtggcggaggccgccatgtactcggcctcgcagctggacagggccaccacctgctgcttgaccgactaccagctaacgaggcacttgccgaggaagaagagaatcccgctcgtgctcttgctggtgtcgatgtcaccggcgtggtcgatgtcgctgtacccgacgaagtgtgccttgccaggacacctcgggtagtagagaccgtggtcgagagtccccgtaacgtagcggatgatcctcttcacagcatgctgctgctccgtcgtcggtcactgcatgaaccgactgacgtagccgacggagaaggccaagtccggccgtgtgtgggtgaggtagcgaaggctccccacaagacgccggtactgtgtagcatccacctcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagtcgtcctggtgcacttcgatccccaggtagaaggagagaggccccagatcactcatttggaaggtggccttcatctcctccttgaacgccgcaacctccgcatccttggtgccgatgatcaccaagtcgttgatgtagacacccaccagcaaggcatttcctccattgccccgccggtagatggccgcctcgtgcaggctttgctcgtagcccatccccttgagcgtggaatccaacttggcattccacgccctcggtgcctgccgcaagccgtagagggccttgtgcaagcgtagcaccttgccctccttgccgggaatcacaaatcccggcggctggtgcacgtagacctcctccttcaagtcgacattcagaaacaccgacttgacgtccatgtgatggacgccccagccttcatgagcaaccagcgcaagaaggagtcgcacggactccatccatgccacgggagcgcaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggagtggctgttggtgctggagcatgtggagtcactggctgaggtggtgtcgacgaagagctcgtcgtagtcgaagtcgtggcccgagggtgtgttggtgtcggagtcggtggagattcgggggctggggtagacacgctcggtgaagaagagctgcctactcccccagctccctcgaagtggacgtactcgacggtgaagtccaaccatcgtccaccgccttgtcccatacccaccctcgcccttcgtcgaacacaacgtcgcgcgcagtgcgcacacgctgtctccgggtcgaggatgcggtaagccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccatctggttgcgccgctcgacgacgccgttctgctgcgggctgtacggcgtggtatagtggcgctgaatgccctcatcagcgcagtacgacgcgaattcagccgctgtgaattcgccgccgttgtcggtgcacagcacgcgcagcttgcggccgcactccgcctctgcagcagcctgcgcatgcctgatggcgtctgcagcctctcccttgctgccgaggaccatcacccacatgtagcgggagaggtcgtcgacgagcagcaggaagtaacgtcgtcctcctggtgtggccggtgtcactgggccacacaagtccccgtgcacgagctcgagctgctccttggctcgaaagctcgtctgctggggaaaggggagccgccgctgcttcgtcaccacgcagacgtcgcagagctgctccacgcggtcaaggcacggcatgcctcggaccatctccttggcactgagctgcttcagggcctcgaagtggaggtgcccgaagcgctcgtgccactgccacgcctcgtcgtcccgacgagcggcgaggcaaactggttgtgcgacttgcgcgctgaggatgtagagtcgattagtgcctctggttaccttggcaagaaggcgacgacagcgatcccaaatcctcatgagtccgtcctcgaccaacacgcgtgagccgttctcatccagctgttccacgctgatgatagaattcctcaacgcggggatgtagtagacaccggtgagcagcctgtgctcaccggacttggcagtgaaggtgacggagccaacacccttgatctcgacgccggaggcgtccccgaacttgacggagcctcggacgctggagtcgaactcggtgaagaactcccgtcggtcggtcatgtgatgggtggagccggtgtcgaggtaccacccatcagccttgtcgttgctggagccgttgcagagggagacgagtaccttcggctcatcaaggtggaggaaagccgctgcggccggtgccgctggaggtagctcaatgtttgcatgagctgggagcaaagccggctcttcctccacccgtgcgacgtggacctggccgcgtcgtggctgtcgacagtctttggcccaatggccaagcttgccacagctgcggcaggcgtcgtctcgtgccggcttgtggttgccggtggcaacgccctgggcgcctctgcgggcgccaccctcggcatgtcttcgcgcccaccgtagctggacacctccccgcgccttgcgcggcttacggccgcctgtcggggaagatgactcccccttcctcccgttaccctgagaggcctcccactgctcccgagtgagatggagcttcccgccgatggtgatgggccccaagagaggttgtggctcatcaccatcgacgaccttgaggcgacctaacgcctcctcgatcgacatcgtggagaggtccagcagagattcgatcgagcgagcgatctgcctgtacttctcagggacgtagcggaagagcttctcgacagctctctcctcgtcgtaagtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtccctgccgatgcgtgccgcagcgatggcgtcccaggcctccttggcagtccgcttctgggaaagcgagaactgcatctcgggcgggactgtagcgatgagggcatccagtgcccgccgatcctcgtcgtagtcgacgtcgccgtaccggactgcctcccacatgtgccgcacctgtagcctcaccctcatcaccacggcccactcgatgtagttggttttggtgagggtaggccacccaccgccgggaccaaagtccctgaccaccgtctggacgacgtggtgaccatggcgccgatcaggggagagagccgcgctgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgcccgctcccgtgccctttctcttgccagctcctcaagctccctgtcggcggtgatgttgccggcgatagagtcgttgatgctgctgcgcaaggtctcaacctctacctccgccgcacgtgccgcatcttccgccgcctccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgcgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcaatggttactctcattgagaagagaatggcactcgagatggggcaattttctggttttcttcattcacaaaacacaaaagccatacctacccgaggaaggttggatacatatatatatatagccatagctggctgctagcctattgctgcaccctcctagtctaaaattcgaaatttaaatgggatgctgtcctagagggcatccaaacttaataaagcataaaggaggcataaaggagatgctaactgctgctgtcctactaaccgcaactgtcctagcaactgaaaaatatgctaaagggtagatgctgtcctgaaaaaggtgaaactacccaaaagcaaaaagaagaatcacgaccaaggaccacaaagacttatccaacaacctcaatggaatacctgattgaatcattgacaagtagccttgccctgacaagtttggatcttgctaggtcactgtcctccttgtcactaataaagtttagcatggttagccttgccaagtgtaccaaagtaacagctacctgtaacattaggaacaacaggaaatcaatcactgtccactggagatggaatcatttcaaaaactgtgttaagtagtcgcaatacccagttagaacccaccaggtggactaggttccagctagttgctagtgacaaccagtattaaattgattgtatatgaaacggcaggaaaacccaattctcggtgttattgacttttcatgattccagggatgcaccttcaacagtaaatctcgcaataacatatttgtggaagactaaactgtactccctccagtcacaaataagtgtcgacttttcaaagccaaaagccaataagacataactttgaccacttaattcaattccataaatccaaaatgagttgcagaagcgtgacattatgaaagcttttttgatataacgaatttggccatgttattttcatatacccagatctatattctaaacaataatccctctgtcttaaaatataacaacttctagcactaagaattttgtccaaaaatattacaacttctccatcaacattctcttcccaaccaatcataaccctccaccattcaatttctacacctacctccacttctcaaccaatcacaacctctccatttaattctacttactttcttaataaccgtgtctaacactaaaacttcttatattctgggacggatgtagtaataattatgtcgcatggattctaaaacaacacttatttgtgactgaagggtatctatatggtaattattattttcattagattgatccaaatatttgaggatcatagcatcataatgctactattagagtattagttttgattgccagtttgccactagagtccccagttccccaccactaggcattttgctgtatcacctgacatgtaggggtgcaccgtgaactcaacatagcagatgcaggtcacatggtcttgtgtgtgccgtagctgccgcaaccatcagtcaacaatgacaattgccattggtgatatggacaatactctacctaaagcaagggagtcctacattcttcaacaaaacatttgcatttcttgggctcagcttctcaggacacagcatgcaccaaggaagtgaaacactaatgaagcaatctaatcatgtaatcatcaaactatggaaatggtgataatcaacatgaattggcgatgccaccatgacctagtaaaatacatatggagcaacagtgattacattgcttcccaatcaagcatcgtggcaggggcacatggcacaaatacctcccagtctgtgttaattgccaataaagcagagcttgtggtgaaaaactcaaatacctggtaagtgatctggcaaccataattttaagaaacaagagaattgtgatcatgtaagaaagctcgtgagttttttcattgagatgatgctttcatgttttatttccactaaagatcacgtgaaacattaaatatgatacaaacctgaaaatgttcctcagacaaaatcctttttctgacttcaaggcatctaaatataatacaaaaaataaaattatgttagtaagaaatttaaaaaacaatcaatggccaaaataaacagcttttacgctccacctttccaataattcttcagattccttcaacttccccatggtttgaagagtcattgttaagagttcagctgcattcgtagtgtcaaatgaatcccacccctatcaaacaattgcaaagacgaacattgataggttttgtaaaaaaattggatgattcatgataagatttgataaagacttaagaggttgttcattaaaagaatatgacatataaggttagcatggtccattaatagactcattatgaccgagcctgatattgctggaatatttgtgttaattcccttttcagtttaccgtggactatggtgcatacaaaaataaactactacagggagaggggatagggacaatatttccatcggttgctaagaatacagtattactggaacatggctgaggtggttggcttggtttgttctttccagggtgaagatacaactccatccttatatagctaggctaacttgacccataagggtatgtacaaaggtagagtcgctcttagttaatacatatcacttagagattatcctccaacaatagttgagacaacaag

SEQ ID NO: 68757 - DNA, 3293 bp, Oryza sativa
ccgcctcgcctcgctcgagcagcgcgagccctcgcctcgcctctgtcgccgccgccgcctcatcccccgctgctcgcctcctccgccgccaccgcctcgcctcgccgccgctcgccgccccccccgcttgccgttgtgggcgtgatttgtgagacaaagtgagagaagagagagagaggaagagtgagagaagagaagagagaggaaaagtgcaataggagtacgacaggtggggcccacctattttttaataaataaattgctgactggactgccacgtgtacgccacgtagaccaaaaccactatggattgggtcgagggaggtaattcgtccagtttgcatagttgggggtgaagaatgtccggttttttggtttaagggtataattcggacgaccgcgatagttcgggagggtaattcgtactttttccccatacaaataatgtccctggctaagtacgtacatcaaggttttgtcctgaatggcatcctattgtgctgaatacataggaaacaagttacaaaaataagaaagtaattggacctgttagataacagattatccatctaggtaaatttattatttttcatccccttcctcgccattcgttttgtattaaaaagaaagaggaaaaaaactaatagaaaatattgccatttctcttaagaaatgactacggaatgggaatccaaatatcctttggtttctgtccaagcttagacagaggtctatcagaccacacaccattgctactagacactggatcagcagctttttcggggaaccgtgcacagttcaaacttgaacttggctggttccttcgggatgattttcgtgaccgtgttgtggaaatctgaaataagccagttaagggccacaaccctgttcaaagatggaacaataagatgagtgctttgagaagacatcttcaaggttgggcggctcacaccagtggttcttacaaacaagaaaaaaataccgtacaaaatatcattgatgagttagacatcacagccgaggtacgggaattaactgatagtgagagagagcatcttgcttaatctagagatcagttatctagacttcttcgagaaaaagaaatcaaatggtaccaaagggcaaaagttactgacctcctacgaggggacaacaacaccaagtattaccatatggttgccaatggtaagaaaaggaaaaaacgtattttttgcctcgatcaggacgaagggaaattagaaggtaatatagcattgaagtcctatattactaaattctattaaaatctttttgggccacctgaggatacttccatcacactagatgaatatagaattgaggatattctgcaggtaacgaatgaggaaaatgaattcctaacggcacctttctcggaggatgagatccagggagctgtgtttgaaatggaacacaacaaagcccctggtccagatggtttcccggcggagttctaccagaatttttgggaggccatcaaagatgatttgatgaatctatttcgggatttccatgtgggtgatttaccattgtttagtctcaattttgggataattacacttcttccaaaagttcatgaggcaaaccgtatacaacagtacaggccaatatgtcttttgaatgtcagtttcaaaattttcaccaaggtcgcaacaaatagaattaattcgtggcagaccatgtggtgagctcttctcaaacaacctttacgagaggacggaatatcctagagggagttgtcatccttcatgaaactgtacacgaattacatcgtaaaaaactaaatggggaaatttttaaagtagatttcgaaaaagcctatgataaagtcaaatggcctttcctcttacaaactctacatatgaaaggtttctcgcctaagtggatctcttgggttgagtctttcatttctggatgaagcatagcggtaaaggttaatgacgaagttggatatttttttcagacaaagaagggggtacgtcaaggtgatcccttatcacctatattatttaatattatagctgacatgttgactgtacggattaatagagccaaagaggatggtcaaattgcaggagtagtaccacatctaattaatgatggtctctctaccttgcaatatgccgatgatatggttctctttatggatcatgacctagaaaaagctcgtaacatgaagttgttgctttttgtctttgagcaattatcgggtcttaagataaatttccataaaagtgaattatattgctttggtgaagcgaaagattttgaaaacgaatacatggaactctttggttgttccactggtcaatttccatttcggtatttgggtatccctattcattataggagattaagaaatgccgattggaaggaggttgtagaacgctttgaaaagcatctaagcagttggaaaggaaaactcctatctactggaggacggctaacattgattaattcggtgctaagtagcttcccgttgtatatgatgtccttctttgccataccaagagggatacttacaaagcttgactactttcgctccaggttttactggcaaagtgatggtaaaaaaaaaagtattgtcttgctaaatggaacatactgtgccgtcccaaggaacaagggggattaggaattcatgatttggaaattaagaatatggctctacttagtaagtggttattcaagttgctctccacggaaggggtttggcaacagttgatgcgtaataagtatcttggtgataaacctctttctcaagctcaatggaaggcaggggtcacacttttggtctagcctcatgaaggtgaaacgggactttcaccgttttggatcctttataattaaagatggctcccaaattaggttttgggaagacaaatggttgggcaattcaaccttgaaagaacagtatccttgcctttacaacatagttaggcataagcacgctacagttgcacaagtcttcgaaaacaatcctccatctttttcatggcgaagagaccttataggatcaaactagcggcgtggaataatttattaccgtgcatcactggttttcatttaactcaggagcaagatgagtttcattggaacttaacctcaaatggggagttctcagtgaagtctcattatctagctctaattcacagcattgttcccaacattaataaccatctttggaaattaaagatacccctaaaagttaagatttttctttggtacttgcaccgtggagtggtgttaacgaaggacaatttgataaaaaggaa

SEQ ID NO: 68758 - DNA, 41646 bp, Oryza sativa
gctaccgccgccggatctagcctcccccgtcgtggcagcggcggatccggcctccctcagctgccgctgccgggccccttcgtcgtcgtcaccggcctccctcatcgtcgaggaggcggatccggcctcccccgttgacactgcagccggatccggtctcccccagccaccgccgccgggccccttcgtcgtcgtcgcccgccggccttccctgtcgtcgaggaggcggatccggcctcccccgtcgtcgcggtggccggatccggcttcccctagccgttgctgcgccgccccttcgtcgttgttgcccgccggcctcccccgtcatcgaggaagcagatccggcctcccccgtcgtcgcgacggcccgcgtcggtggatcaagagttcgcggatcgagagacggagaagggagagaggcggatcgagagctcgcggcggcctgcggcggagaggtagaggctgcgcctcgccgctgctcccgaggcggtggagctgcggcaacgggagccggcggtggtggggagagggagaagggggaggagaagggagaagggagggaggagaaggtggaggagaaggataaggacggagaagaataaggataagggcgggcggtggatttattggcctcaatttttttcagcggtcttcactacctgccgccagcgaaaatcacgttttcactggcggacagctaagaggcccacctcaaaaaatagagtttttttttatggcggatctcttagcgtggccgccagcgaaaatcggttttcgctggcggtccatggccccccacccctcgaaatatttttactggcggttttcgcgtatggccaacgccatgaaatatcgtttttctagtcgtgaatgtattataaaaatgataaaaaaaaactaactatggagaagtgttttttaaagataaatttactttagtgatactatttgcacatatcaaatcttgttactttgatatttattgacgatttaagtttttaagatttggctacacttattgtacgacaatgtgatctatttgaaaacagttggaggggatatctttgatttgccctcttcagtttcgtagttcttgatattttgaacaacgacacagtgttctaaacatattttgactatatttttctattataacatataaaaataagtaaatatttaatattatcaaattacttttaagactagcgttttcaaaccaaatattttaaaatctatatatagttaaagttctagttattttatttaatttcaaccttacctaaaatatgaagaattatagaaccagataaagcaacaatatacatactatatacatatagtaatatggtaaggacacaagagcatatgcatatcagcatatatacttgtatacatgcacgcttactttgagatgatcaccacctagcctagcccttttttttccttttttttttgttgcagtgagcgagcaagcatgcaacaaagtgtgcctctcttttggcacataccattattgtgtcttgttggaacagctagcagcatgcctgcctgcctgccttgaccacacacacactgcccggccagctcaaatgcttctgatgaacagagcgagagatcagctttgcaattcttaatcgcccatatgtaagtacgagcaaaagctcacctgaaagcacaccggacactagcaaaaggctgggatacgttgcttagtttttggtttaagataataataataacaacaacgttaataatacacagtagccgatagcgaaagagcgcagctttccgcttggccatttgtgactactccctcactcccaaaacaagcgcaaccatgacttttcctgttcaactttaatcattcatcttatttaattttttattactattagattataaaatgtaataatactttatacgtgacttattttttatttttttaaaaaaaattaaataaaatagacaattaaagttggattagtaaacttatagctgcgcgtattttgggactgagctactaagtgatcgtggtttttttttcactctagctcttgtactatgacagttttactgatgtaccccgggggtattttacgcaggaaaccctagaggttggggggtcgccgccgccgctgggcccacgtgtcagcctcactccccactcccccctacacggtagccacacgggctatttgctcgcacgcctcagtccacctcccctgagctgtgctgctgcgctgcgctctcggactcctcccagatccccaatccccccacgctctccggccatcgcgggtggagcagggccgccgccgagggctgggggggagcgcgagtcccggggatccgagccatctgccggtgggcggcggcggcggcggcggagttggggttcgtcgtcttggtcttgggtcttcttcgtccctcgctgcgggtgggtagcgcagcgtcggggcagatccggctagccactgcgacgctgaattctggagatccccgcacatggagtcgcagcgaggtccgccgccctccctccctctctctctctctctctccttatttagtagtagtatgtatgcctgtgctgtgctgcctcgagaacaaacgttcaccgcgtccccggcggcggcactcagccggagcacgcggctgcggtgtggatcgccctggctttcaggggtgaataagggaacaatttgttgtgaagactagtagcttatagtcaatttattcaattccttggtctatgtgtgttgtttataattcaacataaggaatgctagttttgtaaagtaggattaattcagtgctagggttgccactcaattgaacttcaaggccaataggcacattttagacgctcagagcgcaagaactaagataatgatttagctcaagttattctgtgggagacaaggaaaacatcagtttgtacgattagtttcaaaaatggtgccccaggagacatcgtataagctcttttgagcctaacaagtgttgtgcatttcacattacaaacaagttggccccctttgatttgtaggaaaaacataggaaatttggaggatttcaatcctataggaaaaatatctatgaaggtctttgaaacaaaggatatcttatccttccctttgaaattcctatagagattttgaaggaaagttagcaagagctctaacctcttggaaaatttcctttggagtctatctctctcatccgattcctgcgtttttcctgcgccctaataaattgaccattcttgtatttttttcctgtgttttgcaatcatctgttctgcacttatattcctttcaaaatcctgtgtttttccaaatcctcctttttttcaatcctgtgcttcaaaggagcactttctgtgttacaatcacataacagcacaaacaagaccttgttctttgttatactcaagtgaagatgccatctataatttctatacactacatcttattatcagtatgccaatttttgtgcacttgttgcctctgtttggttaataaatcatctcaacagtagttcttgaatctgttgttaatttgatgaatatatatcaacttgagaaatctattttgtagatacgttgagcatgagtgctcttactttgtccatatacaaatttctatcttctctattatacatttgcttgttggtactttaaagtaaaatacaaaaattgatgtgcacaatgtgttgtacatttaactttctggctcaactgggaagccgtgccctttctttacctgaaatttatttgtttgattgcttctcatttgcatgatgtagcactaaccaatgggacatctaaacttcaatgctgaattgctgatcatatcatttactttctgttacctacttacctgtacttaactaaaaacctaaaatttcttgaagccctattgtccaactgtaacatattttttgacaatttttttaatgacatttggcagggcaatctcctgatcgtggatcagacgcatcaggaccaaaacagtctagtgtttcatcacatggtagacaaaggaattcatcatcttctatctgtaaagattttctccggaagtttgtggacaatgaactattgacatcaagcctagaggactggttctctgggcacagtgaagactgtggtttcaagaagccagcatttgatgttccttttgacctaagtgaactacaaaattttgactatgctatagaaggtgttactttccaacagctagtacggatgccaaatgctcttcatgcctcaacatcagatatttttgaagctactgcacatcttgctttggaagattttcttcatgcaagtattaagggtttgtgggaaactttctggggccctgatgaatcgatgcctttctctgttgcctgtatacacagcacaagctccaaattttatcctgctgagaaggctattagcagtgggagacttgatggcgtttgtgcaacggctgtattgctgaagagtttaaagcattcacaaggaaggtgggatcatattgttgtactggctttgttgagacctgatattggaatgttttcggggcagaatgaccaacagccatctccggctgttttgggggaggcactattctttgccttgcgtgttctactttctcgaagccttagtaggtcttccacagttcttcaaaattcagattgtgtttacgtccttcttgttgattcacagtttggaggagtggtaaatgtccaaggtgatctgaacaagcttgattttgatttgaacaatgtttatgactctgctgcagagtggataaaaaagcatgcacaaatcacagtttcttccatagaccgcgtatggaacaaacttggcaatgctaactggggcgacattgggactcttcaagttctccttgcaattttccattcaatgatccagttctgtggtgcaccaaagtattctcttgatgaactagctacagagcatagttcccgattacagagccgaagatcagaaagacatttggttggcaggcaagctaatacaaatggtttgtttcgattccagcagcaaagtcattctcctgaaattgttgaagtacaagaggagggagctgttaatgtaaaaccaaaggaaattttgaagcttgaggtaggatctgttgtattgatggaggatgctgattggcagaagggttttcaaatcaatgatattcttacagacagcgaacctcctatctatagtgctactcctgtagaagaacctaccaaaacccatctgttgtatgtaggctccagcccttctcatttggagccagcatgggaagatatgaattcttggtatcaagttcaaaggcagaccaaagtacttactttgatgaagcaaagaggcatttcaagtagatatgtcccacagatggttgcttctggacgtgtcgtccatccaggcccttgtaacaagcctaactctagtgggagttgtggccatccatggtgcagtactccaatacttgtcacctcgccagttggtgaaactatttcaaatctgattcgtaatgggctgtttggtgttgaggacgctctgagatgttgtcatgactgtttgtctgcgcttgctgctgcatcatctgcaggaatccgtcatggtgatatccggccagagaatgtgatccgtgtgagcaatggttcaaggcatccatattttgtacttattggatggggccatgctatcttagaagacagggatcggcctctaatgaatttattcttctcatctacatttgctctacaggaaggcaagttatgtgcagcatctgatgcagaaagcttaatttatctgttattcttttgttgtggtggagtttgcccagagcttgactcagttgaaggtgcacttcaatggagggagacatcctggtcaaggagagttatacagcagaagttgggtgatgtctcagcagtgctgaaagcttttgcagactatgttgacagcatttgtggaaccccatatccgatggactatgagatatggttgagaaggttacgaagaaccatcaatgaagatcatggcaaggagattgatacatcaagttagtactgcagctcatgttagtgcggaagtacgatatggaagatcaagaatggtcgttccataccctgtattgttgttgtagataatttattcgcctgtctcgtaaaaggtccataacttagtatccccctccatcttgctccatttcatctaaagggtatttccatagtcacaatctgctgctgatatcctcaacttggatttctgaaaatggtgtcgcctttgcacaagactgcagtagagatcttctgaggatatctgcaacatgatttattttggcgagtgctcctcttaagtctttgcttttcttcgggtctcgagtgtgtggtatagttgatcaatttttggtccttttgcttttttgaaattgttccagaatggatttgtgattagaggtggtgtggcagagtagcattttgttctgactaaattattttgcgggtgctatgttccaagtgcacctagttcttgtaaatgttgttcttgttcagctgtacaaacttcaatcatgctaggctgcaactgctgggtgttgatatgttcgatgaaatgtcaaaaaaaaaaagttgttccccttatgtgctataaggagcaggttttttacctgacgggcatatattgttgtgagaatttcaggccatagataatctggatatgcagacaaattattgtttctttggagattcagttaatggcgtgacgaatagaattcaactgtacgtgtatcctactcccttcatctactttcgatagtcatatttccaaatctaaaaattttatttttttccaaatctaaaaaatttatttttgataggcatatttcaatccaacaacttatcatctcaataactttctcaaatttaatgcatgattcttcattgttccacacatgattggctacatgaacattgagaaatgtaaatattaatgaatcgcttatttacgaggaatgactagtagcatgtttaaatggatgataagtagaattacttatccttgatctatgtgtcaagatgaaatatgactatcaaaagtagatggagggagtatcttatttttgggggcaatttggcttgactagttgggtttcataattatagttctggaagtttgctagctccctccaccttttccaacaatgagcaatagaatcattgttgttaattactccctccattctataatataagtcacaactaccgttctatatattataaggcataactacctttttttttattttagatgttttataatatatggcatacatgtatgcatacaattaattaggacttcttctccattaaattattatttttttaaatcctccatcctcaatatctctaattctattggatgcatacattatatttattagggtgatctaaactagaagatgataataattattttttcatctttgggttaagggtggttgtgctttatactattatatactattatagaacggagggagcaatgatataatagtagcataattttccatggtattgaattccttttgatgttctcgagtacttgaaatacttgtacgcagcgcacatagttcatttcagtgacgttcgcagattttgctgtaaaaaggtacttcaccctgtgcgagcatatgcatatttctgaaaataaaaggcattttcggagtgaatagtcggtaatacactggtggacaaaccctttttaatcccgtttcacaaccctcctatattcccgcttatataactgggactacaaatcaaatcatttttagtcacagttgaaataaccgagactaaaaatgaatatttagtcccggttggagttaccaacatggactatagtccctcttggagttaccaaccgggagtaatgttctttttttcttttttttcctgctgcttgcatgatttcgagccccacaaatcactcatattatccaccaatcattcgaacaccacgcatcattcacaaaatccccaaatacatcaagctgcattttctatccccaaatacatcacaaatcattcacaaaatcacaaaatcatatccacaaaatcattcacacatcacacatcacacatatcagaataagaaatccacatcgctcagatcggccgcacatatcagaaaaagaaatccacatcgcatagatcgaccgcacacatcgcacagatcagaaaaaaaccacatcgcagagatcaggtgccgttcatccgccgccttgccggcctcccgcccggccgcctcgagctccgccgccgcctggggagcgttgccacccgccacccgcctcctcggcggccggtgcccgcccgctgccgcctcgggctccgctgcccgcccgggaagcgccgtcgccacgccggacccgccggcctcgttggccgcctgctcggccgcccgccgccggcctcgcaggctgcctgcccggccgcccgcctcgctggcctcgctggccgcccgccgccggcctcgcaggccgcctgcccggccgctcgccacttcgcggccctccctgccgccgcgcgccgcccggcctcacgtggtaggaggaggaggaggaagagaagagaagagaagggagaggaatgggagaggagaagggatggaggattgggtgaggctgaggatggagaagggataagggaggctgtttaattaatgagaggggaggggagaggaagggggagagaccgaggcggccgcgcgcgggcgcgtggcttggttgattttttggtctcggttggtattaccaaccagagctaaagatcaaaaagtttttaaccgggactattgtggattttgggcgaccgagtaaagatggtttcttcaccagtgttagctcagggaaagatcgtttatgtgagatttttttttgaaataatacgattttaatggaaaatcgcaaaaatataagtcggttaggcgaaattgcaagtttagcaccctatcgaacatccgtggttcgacagggtacctattgaacaaccgcagttcaacagggtacctatcgagagttcgacaggtgataaaataattttataaaagagaaaaaaaacactgtagagcactgtagccgtgctcctatcgaacattgcctgttcgatatgtcctgccgcacacctatcaaagttttcatgttcgatatgtccctgctgggtactgtagcaagtacttttttttttttaccaactaccggtcgaactgcagttgttcgatgggttcccctatcgaaccacggttgttcgacagggtgctaaacttgtgattttgactaaccgacatatatttttgtgagttttcattaaaatcatattattttttaaaaaaattcgtttatgtgaccccgaaagtccgcaagttaatagttcggtagagccttttagcttagcttagctaatcagctgcacggaaaacaagatagatatgcatgattaatcaagtattactatgaatatgaataaaatatttgtttaattttgtgaaaaaaacttttatgtagatactccctccttccaaaaagaagtgaatataggactggatgtgacatatactagtataatgaatctagatagatatatatccagatttattgtactaggatgtatcatatctgttattatgttagttttttatgagacggagggagtagtttgtcacgaaacataacgtttaaccattccaaaaagaatacatactcacgtaaaacgagtagcccagcttgtaagctttcccgagcgcaccctatactaagcgtgggtgttcggtttattcggtttgtttttttaagctatatggaattcagtttcttaaaatgtcaaccgatcgatgcaaagttctaggaaaaaaaaaagaaccgagcaaaataaaatgaagaagttcggttcagtttttctggggcttggtttttaccgaggaagatgttgatcgtacgccgtggtcgacttcgagcgattacgcacgcttagcgcccgcccagctacactcaaggggcccgcttgatcaaggaatggggtttgtgtacgtgttagctctcatatattttaagggccttagtaaaaattgggttacatgcatgttagtgggtcttgtgccagttggattggctacagagtgcacacccatttagaccatgttcggaagataggtaaagctgtaaaagactaggatcctggcttttttcccagcctagaagggaaagcccaccacgaaggggaaaaatccccagactacccaaaagttcattttgcaaggtccgggaaggtaagtttcctggctgaatacccccaaatcctaaggaaattcatccatgatcctacctcgtagaacgaatcccacacgccgccatctcctctatacgatgcgaacgccgccacctcctcttgcagcgaatgctgcctcctctcaccccatccaccggagctgccgcctctagatgcatcagccggcggtgcttcccttcctccctggtgctgtcgccgcctcccttttttccttattgccggtgcccggtgctgcccctcttcctccaccactgccaaggatctcgggtacatgctgctgggcatcaacgcggccttctccaggcctagaaccatggcatcaagtacgccccttcactcctctcgccgccgctactcatgtggaggaagaagtggacaggaagcttatgtttttctggcttctctccttgcaagatctttcgccacttccttctccgtccggccaccggatcttccctaaatccaataaggaccttgagaaactcggcatcttctactatctcatccaggtgtatacatttcaattaattttacgtggatatatattttcctactgttagaacttgtgtggttaagtttgctgcatattgattatcttgattctttcattattcagagcgtatgttagttgatatcttgctaagttaaaatctttaaagtctagttatagaactccaagttgttagttcattgttttcacttgcaatgagatgctattattcataccttttgaatatggttttctgatggcaagcagcgcatgtaattcaaaatgtgaaatttcatccccagtattgctctttggattgtagaataattcagattcagaattatcgtactgttctttactccatgtccaaatactctgctcagaccatgtttcaggctatggctgcacacgcagatgaagcattttgtactaatcactgaccaaaattcctcctaaaatttgcacattggatgaagcttaagattttcgtggcacgcttttcaaactgctaaacggtgcgtttcatgcgaaaactttctatatgaaagttgcagtaaaatatcatattaatctatttttcaagtttataataattaaaacccaatcaatcgtatgtaaataccacatcattttacgtaaaaaacttaatcttcatcttcttctttttcttcttcatctttagaagaaaaaaacaccaatgtagttttgcagcaaatctgacgagttaaagctctgaatcctaaaaaaatccccaaaaaacactctctgtatctgaagagtgaaatatctgaatatgtagatgtaaagtcatatatgcagcagttaagcacgtagaatagcagtctaccagttgccaataaacaatttttttttcatgtaatgattggtgaacttatatcctgatgatgatattttaagttttaccttttttgacatctttgcaaggatcactcttttcctcactacattttttactactatcaatgggaggtattgtctaatgaggaaatcaattttatcttgtatacctctgaaattttagctaatcccttctatacctttgaattttgcttactttcttatatacctctaaaatttggttttgatcccttccatgcccctttcgtcagttgaccatctaatatccataagagtgaaatacatggccggtccttaaacttgttgtgtggtgtcacttaggtccgtgaacttaaaaattgcacgattaggtccgtaaacttggtttaatgtaccaccccagtccaatcgtcctttgactatatttgaccgccaacgtggcataccacgtaggcaacacttttattctcagcccctccacatataccttcgcacataacttaccctgaccagtgcatttcaacccaaatccccccaaatatccctaaatcggctagggttttgatggtgagtttagcggaaggaggccgagaggtagtggttgtggcagcctcggcggtgagattagcggtaggaggcagcgcagtgaaacggggttagcggtggcatagtgcggcgggaggcagcacagtgcagcgggaggtagtgcaatgcggcttgcacgctaggcatccccatggattctccaagctcgtcctcatcttgaagtcgctggaagaaggtgttgttgatcaagtacccgttgcataaggataagattattttggagtgcagagcaatgtcaattgctaatcgggaccacatcttctatacatgcaaggagaagaatgagagggaagaacaatttgagattttttcttgggattttggtgtcgctatatagctacaaggagatatatgtgacatgttgtgatgtggaggggcctaagagcaaaattgttgcctacgtggcatgccacgttggcggtcaaacgcagtcaaatgacatttggactagggtggtacattaaatcaagttcatggatctaaacctgcaattttcaagttcacggacctaagtgacactactacacaagtttagggaccggcaatgtattttactctttcgataaaaatgaccattttaacttttggatgaacacataaatttatgaattacataattgaaaatgtaaaagtttgtcgcatgagactattatagttatgagtttgttgtgcgatacattatttatgacaaaatttatttttatataataaaataaaaatatatatttatttttttaagaaaaaaatcataaaaatgaggagcattcatacaaagataggactaccaatgctcacgatattttctttatgaatgctcccaataaagaaaatctattgccctattaaaatttcaaataaaaattttaatttattacatttttatttatgtcaaaaatttctgcactaattatttagtctcattagtttcataaaatgcacgtactatgcattaaatttctgcactaattatttaatcttattattttaatcattttttaagcttatattcaaacctaaataatcaagggcataaaagacatttgcaaccaaacttaacagtgaaatgaaggaatcaagttgaaatttcagagatatagaagggatcaagaaaattacaggtatatgaaaggaattgagtgagttttaatgcttaggtcttgtgaactctgtgaaggatctgttgcattgtctagtgactagtggcatgtagttagtaaatttgattaaggtgcataagctactatggcactaatgagaattaattatgattcattattggatagtcactaagttattaaataaaattgtagaagaattacccacaatcaaaagttagcactatgccagaaccctacatctgtgacagcataccagtgacgggcctatgaattggtcacagatgactgtcacctttgacgggttgctaggtttgctgtcatcggtggggcatccggccacggcccgtcacaggtatcccctcacctgtgatgggccagaaggaaaagccgtcacaggtgaggaagtgacgggttttcctcccaacccgtcactcgtatcctctcacctgtgacgggccgtggaattatgagccgtcacaggtggtggtccgccacctgtgacggattttttttatggctcgtcacaggtaggtcaatacctttgacgggcaactcaattgaagcccatcaaaggtatgaccaacacctttgatgggcttttttaatctaacccgtttgaggtgtgttgggtctataaataccccacaaactgccaactgctttccatcccgaccagttcaatgttcacaaatcggttgggagggcaagggggggcgaatttttgctaaaattcaaggtaaaaaacacattattctccattcattctcaatatatcgatcatcatatatttttctttgtatgttgttgattttagatggatcgtagatggatgtactatgcgcatcgttcgtctaccgagtatagagagggggtcactgaatttgtcacatttgcggataatgacagaaaatgtaggatgcacatgttgtgtccatgtagggactgtaagaatgaacagatgatcgttgatagcgatgaagtgcatgctcatttgataatgaatggattcatgaagaaatatacctgctgaaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacaatgaagacgcagaggacaacgacagagattttgagaagtttagtaagttagtggaagattgtcagatgcccttgtatgatggatgcaagtcgaagtacagcaagttgtcatgcatgctggaactcatgaagcttaaggctagtaatggctagtcggacaagagttttacagaacttcttgagctgtttaaggacctgttgccagaggggaacaatttaccatagacgacatatgaagcgaagtaagtattatgtccgttgggcctggaggtcagaagaattcatgcatgtccaaacgactgcattttgtattacaaggaatacgctgacttggatgtctgccctgtctgtggggcatcaagatacaaacgagcaaagagtgaaggtgaaggaagtaagtcaaagaggggaggccccgcaaaggtggtgtggtatctcccaattgcggagcgcatgaagagaatgtttgcgaataaggaacaagctaagctagtgcgctggcatgccgaagaacggaaagtcgatagtatgctgaggcacccagcagattcagtacagtggaggacaatcgataggatttaccaggaattctcaaatgacccaagaaacatgcgtttcgcaatgtgtacggacggcattaatccatttggtgatttgagtagtcgtcacagtacatggctagttctgcttgttaactataacctttctccctggttgtgcttcaaaagaaagtatattatgcttgccatgctcattcaaggaccgagacaacctggcaacgatatcgacgtgttccttgaactaataatcgatgacttcgaaaggctatgtaatgagggcacacgaacataggacgcatatgcacaagagtatttcaacctctatgcgatgttgttttgtaccatcaacgattatccggcccttggcaacctttctagctaaactgtgaaagggaaatggacgtgttcgtgagtgtatggaggaaacaagaagcaaatggtgtctacatgggtcacaggagatttctcccaaggtatcacccgtataggaatatgagaaagaatttcaatggacacaaagatacagccggacccccagcagagctaacagggatagaggtgcacaacttagtgatgggaataaccaacgagtttggaaaaaaagagaaaagttggaaagtcaaaagagaagagcatgtcaaaggaaaaaacagaggagcatgtggaaaaacaaaagacaaaagagatgagcatgtggaaaaagaagtcaatattttggagactaccataatggaaggatcttgaagttcgccactgcatagatttgatgcatgtcgagaaaaatgtatgcgagagtttaatgggattactgcttaacccagctactacaaaggatggtctcaacgcctgacgagatctggaagaaatgggtgttcgctcggaactacatcccataaccacggaatccggcagggtttacattcctccagcctgctacactctctcgaaagaagagaagattgatttgctaacatgtttgagtggtataaaggttccatctggttactcatcaagaatcagtaggctcgtttcactgcaagatcttaagttggtaggaatgaagtcgcatgattgccacgttcttatcacacagctgttgcccgttgcaataaggaatacttttcctcctaaggtgcgacacacgatccagcggttgtgttccttcttccatgcaatcggccagaagatcattgatcccgagggactagatgaactacaggctgaacttgtgagaaccctatgtcatcttgagatgtactttcctccaactttctttgacataatggaacatattcccgtgcaccttgtgaggcaaacaaagtgttgtggtccagcattcatgacgcagatgtatccttgcgaaaggtacctggggatccttaagggttatgtacgtaaccgttcacaccccgaggggagtatcatcgagagttacaccaccgaagaggtcatcgatttttgtgtggactacatgtcagaaacatcttcaattggattaccacgatctcatcacgaagggaggcttgatggtgttggtactgttggaagaaagactgttaggttggatcggaaggtgtacgataaagctcatttcacggtactgcagcatatgactgaggtggtgccgtacgttgacgaacaccttgcagttctccgacaggagaacccaggccgatcagagagttgggtcagaaataagcacatgtcttctttcaacgagtggctgaagaaccgaattgccaggttgcagaacctttctagtgaaacacttcagtggttatcacagggtcctgaatggagtgccaccacttggcaaggatatgacataaatggatacacctttcacacggtaaagcaaaacagcaaatgcacagtgcagaacagtgggttacgcatcgaggctgctagtgacggtggttggcgtgatcaatactatggtagagttgagcaaatattggagctagattacttgaagttcaaagtcccgttgtttcgttgtcaatgggtcgatctttgcaatgtaaaagttgacaatgaaggtttcaccactgtcaacttagctaacaacgcgtacaaggatgaaccgttcgttctcgcccaacaagttgttcaagtgttctacatagttgacccgtgtaacaagaaactacatgttgttcgtgaagggaaaaggagaattgttggattggacaatattgcagactaggatgattacaaccagcacgtccacagcataggtcaagaaatacctctagaagatgaggaagaagaagatggcgttcaatatgcacgcgtcaaccatgaggaaggattatttttgtaatttatgtacgtagtttatgtctacatgtctgttatctatatgactctaatatgttcgcaatgatcaatagtatattgcttatgaaatagtcaaataaaataattaagtgaagcacccactagaagtgaaataaaataattaagcaagtataaccatcggaacaaaaataaaataaaaatgtagtgtatgtggaaatatgttaaggaaaataaaagaactaagtgaaatagaataaaattaaataaaatattgtagtccatgtagtcaaactcacctgtcacaggctctaactgtgaggccgtcacaggtgcccagaacgctgggcccgtcacaggtggcctcagctgtgacgaacccgctctttgcgcccgtcacaggtgacctcacttgtgacggccccacagttggcgcccatcacaggtgagtttgactagggttaacctagggttggacctcttctagatccagatccggccactctctcactctcactcactctctcgaccgccacctcgaccgccgacgctgctcgccctcgccgcctcgccctctccgccctcctctccaccgtcgccgcctcgccctctccgccgccatctctgccgccctctacgccttcctctccaccgccgcccctcgtcctctccgccgtccatccatcgacttccccgacctccccgaccccgacctccccgacaccgggatccacgatgccgtccacctccacctccacgacgccgggaccccgaccactgccgccctctccgtcgccatctccaccaccactgccgcctcgacctctccaccgccgcccactctgccaccatctccaccaccgccctcgtgtgtttgccgccgtccgtccatcaccggccccgacctccccgaccccaacctccccgacgcctggattgacgacatcggcctgcaccgccgaccgcctcgacctcttcgccgctgcctctccgccctcgtcttcgccgccgccgggatccaggacgcctacggcctgcgccgccttctccaagtacgccaccaccctccccccttcctccttttttcgatggatgaattgcattgtttagatgaatgaaatgtgatttgttgtttcgattgttggtgctgctgtgtagatgaattaaatgtgatttgttgtctgtagatgttttggatgaatgtaggggctagattttggatgaatgcaatattagaggaattattctattggtattagaggatcttagcatgaattttgctgcagtggatgttcttttctttatggataagaacagattatctacacttgttgatttatatacccttgttatctatgaataggtgaattgcatgaattattgtttatatacatgatttatatacccttgctgtctatgaataggtgatttgcatgaattgttgtttatatacatgatttatatacccttgctgtctatgaataagtgaattgcatgaattgttgtttatatacatgatttatatacccttgctgctgctgttttagaaattattgtgggctgttttattatctacacttgcccctgcttgataaattaattgtgggctgtttaagaaattattgccatgggtatgataattttttttgatgccttgctgtctatgtttgcccatgctgctgcctatggttgccttatattaaatagccagtgatgaatgctcaagaacagaaatacctctaaacttgttctttttttaatgcataagaacagattatctacacttgttctttttttttatgtacacttattcttttttgatgaattgctgttgctgctgctacccctgctgcccctgtgccccttattcatttttttatgcatagattatctacacttgttctttttttaatgcataagaacagattatctacacttgttctttttttatgcataagaattgcccctgaatgcctgattttgatgaattttgatgattgttataaaatgaattgatgctgctgctgctgctgctgctcttatagaatgagtgttctttttaatgcataagaacatattatctacacttgttcttttttttatgtacacttgttcttttttctggattgataagaggagactatctacacttggttcttttttacgctttactttgggttgcttttccctcctattagctgatttcctcttctttttcccttcatgcaaatgatggtaattgatgcataatttctgagcaaaactgaggccatatgtttcatagtataccccgtattacattggttctaatgttatttagtataatggtaggaaatttataagctttttggggaaaattagaccatgacaacgcccggcgcaaacccgccctccccaacacctgcaaggatacaggaaaagcaaacccagccacggagacagttgccgaaagtcatccctcgacaacggcggtcgaacaatccaaaattcatgataatttataggataatttttcaccatatgaccacaaaattttagctagcaccccttagcatatgttgccttctgtctgcgctgcagaatcgccccaggaataacatacgtcgatgtcggacgggacaagtgcaagtaggtcgagtagaaatccccggtcacaaaatatatggccgaccacattgcaagttataagagaggttgacgctagtggtaggcccacggcgccgaggactgtcattggaagatggtctaactgctgcgggctggcggcacgtgagaatttcgggatcctccataaagatatcgacaaggtcacaaaagccgagaaagagcgagcttggacggcaatggagaaatggttcacatttccggctaaagcaaaggataggctcaagcggaaggcattccataagatgggcaaagcttggaagaattggaagtcgaagcttttcaccgagtttgtcaacctgcccggcaatcatacgccgttcgatgaataccctcaaataaccgaagcagtgtgggaggaattctgctctctcaagaacacccaagagtttagggaatcaagcgaggcacatcgcctactgcagcagcggaatgagcacccgcatcggctgggcaccgcagggtacatcggcaagaaggcaatatgggcccaagaagatgcagccgctgcagcagcaaatgtccctaccccgttttcagacatccctgaacaaagagctcgcaactgtgcgcgggaaggggtaaggtcaacccagacggctctgtcacatttgagaacaaaagtgatgccgtcgtctatcaggaactggtgagttcactacttaacctaactaatttccgttcgtataaagtagaagttcgtataaacgactcttttttttctagttgggcttggttgctgaacaagcttcacaaagcgaggttgagtccgcgccgaagaggcgcgaagatgacatcctcacaaaggggctcggaaccaaagaacatcctggccggactaggggaattggtagcgatgtgccctggaagcatggactcccgcagtacagctcccaatacaggaaacggaaagtctccaaggaagaaagggacgctcgtttgaaggccgaacttaaggttgaggtcattcaagaactagaagctagcatgaacgctagggtggaagaaaggtttaacaaggtcctcgccaacatgaatataccccgaggcacaacacctgctgtgcatccaactcctcgtgcacaacacgacgcgagtccgtcacagcataggagtagttgtgcatccacagaggtgccggcccctggtctcccggtcgcaccactagctgcagtggaccacatagaggtaattgatgttatccgatctatatctaataaaaaacctttacacgttccaatattaaattcaaactttcacatgtgcagggcgtagcacagtgtgtcctactggcgagggtccacccaactttcgctcccgaagtcgctgagggcatggctttcaagccctcggttacagacaaggtccactgcgcatacctgctagctgggtatgccaaggtgtccaacgatacagtaaaggacacctggtcaggctatccgctgcccgtgccccccaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcctgatggagctaatatggacttggcagatatagctcaaagcttggctctaataaagaccacaagaaaggctgatagctccccgccacttatcaagggccagaagcgtgaacgcggcaaggggaaggtcgggaagttggcaccggagccaaaaaggggcaaggctgtgacgtcgatgccggtgagcaaagcggggaaggtcgtgagggcgccggcccaatttgagctaggcatgctattggtggaggacaatgtgttagccgtgatgggtattgcttgccgagagctacataagcaatacatgaagctaagcaatgccaagcaaaaaatgagggtcatccatagttggacatcacgaccaccaaccgttcctatcatcgcctgcctatataactataggctttgatgacctcttcgacctttttaggatccggaagttggacactggtcttctaaaatgctactccttgtaagtgcataccttctatacttgtgatatgattggactatatctcctaattaaattagttctaatatgtaaatgttttaaggttgtgttggatcgagagtcgtcgccttggtaatcaggttgggttccttgatccatccatggtgaacgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcactgaaatcaccaaggccttaaatatggcttggggcccatatgtggaaaagggtggtaggcacaaggagggcaaggacgaactttatcatgacaccaagttcgcatgcgcacaacagatcgaagaccaatgtggtttccacgtgtgccacaacatgtcaacacttctaagagaggtgaaagatttcgaccctgaggttgttgctaatggcgaataagctcatttcaataccaacattgctattcaaaacgtgctaacctcttatttattaaacagaaaggtagaactggcttcaagatctcacccatcaaccccccccccccgctatcagaggcgaagtgtgcgccttcattcttgcagaaataatgaacaagaaaggacgttttcacgtcaaatagactcatgaatttggctagataatttattgtgacgtaaaaaagatgtttttataatttcttgtgatgtaaaaaaatatgtttttatcgagtgcaatgtaatttactttcatatgtgcaatatttatggtagtttactaaattgtcatcaaatttaatcaactacgatttacgttatactattcatttattttctcctttttttttcttattgacaggtcgtggaggtcgaggacattatgactttaatccatttggtaagtatatatgcggttctatgagcaatgaccgaaattgtggctttcaagaggtgtgaatttgctgtgcaaaattgtggcatttgaactgcatatgtgaatgatgtcaatttttgatatggatctgtgttgttggggatctgtgatatttgagatggatctgtgatgttatattggaggggtgactcgaatatatctgtgatgtatctgtgtttcagagggcatggctagcaaatcctgaggctagccaatattgagcatttattttttttctggaattaactcatcagtgacgggttggaacaaaaatccgtcaaaggtaaactcacctgtgacggactagcaaataaaggcctgtcagaggtgacctacctgtgatgggcctttacttttgaggccgtcacaggtagatcacttgtcacagcttctatctacggagaccatcacctctgacggcctttatttaaagggccgtcagagatgagtcacctgtgacgggtcccaactcgccctaggctagcggagaccaacacctctgacagccttctagtaacttgcccgtcagaggtgggtgtcacctgtgacggccggccacccgtcaaaggtgggtgtcacctgtgacggtcggccacccgtcaaaggtgactggactcatcagtgaccactgatcactgaccatgcgcgaagccgccaaagatgagggtttgggcccgtcacaggtgaccttggccagtgtagtgtagattagatggggctggtcatgggctgaagattagatgaaatattcctttttgtgactatcaacatgcatgcagttagctgattattaatgaagagttaactgccatgatgcctggaatttttagaagtgcattttcaggtgcctgtcatgcttttgacacaaatgaatacattgactttgccatattcttttggtgtgcagttttctgatatgtgatgtctacgggccttttgtttgctgcaccaaggatgcaaggaaacgtcttgtgttatacctgggaaagtgttgttactatatactccctcaattccaaattgatctctatatattttataggtacaccaaaaccaagaaaagctaataactctctcatactatatttactctagcaacaaactctatgcatgcaccatccccactatttcctagctaatagcaaatcaagatattgcatgtgggttataaatacttgtgtgcatggatgcatgcatcaatgtccatttactccaatgcacaaataacgaatatacttaatgaatgaacacaaatatatagatcatttagcaataacctaaaaaaactatatgtagatcaatttggaatggaggaagtagaactcttaaggaaaccaagctcaaattaatattaatgatttagctttagttaacatagttttatcttgttcaatttaatacttgttattgtgagagacatgtgcgtgttctaaactcaatgtgcattggcttctaatgttggttgcctgttctttttccaatactgtaacaattatgacatggattttgtagctggtcttcagtatcatttttaattttccaaaattttcatagttttctaggcttttttatgtatttttatgcattttcctgaaaattcagatttttgttgtgcagtatttcgaaatttctacgtgatatttgaattttttttaatgaaattataaaactgaagtgatatctcacggctcactattattgaaacacaccaatacacaaagatcccatggtggaggggattgacgaggggattgagtgttgggaggggatccacccaagtggtgtacgttttccctaggaaaaaaatcctccccacatacttatcaaacaaggtctccctagtagtgttttccctggaaaaatcctccccatataccgaacaaggtctcaatgagtgtttttgactaggaaggctttaccatcccggtccttgtaaatttatgagctgagattacaacagtttgcgtatctgttcatctagagctattcaatctcgtgtttctgactaggaagactttcccatcctgatccttgtaaatttatgagctgaaattacaatagattgaatatctcatcatctagaactattcagtctctagacgaactttatttagccttatcgatctgttactattaaatggtgacctctctctctagtggagtaaaggattgggggtctttgatattgctccgtatggctacgctgcaacctgcagttgcgttataaatacgttaattaacttgcaaccagcagtttaccaaacaaatataaacgttttcttttttgacaaaatatatataaacgtatttgcggcatcaaccgcagcatcattttctatggctggctactgtggctacagcgctgcactattgcagcacggccacagccagtgctctaacgagcaggtccattcgttacttcgataattaagctaatagatggggtaatcattatcataaaatccaaaaatgttgctatcaaaacaatttggctcatatatctcgctatttgaccgcctctttgttacttcatccgtttcacaatgtaagtcattctagcattttccacatttatattgatgctaacgaatttgtctagattcattaaagattcattagcattaatatgaatgtggaaaatactataatgacttacattgtgaaacggagggagtagaaccatagccacattgcccccatccttcccaaaatagtttgtggcagtggatcgacacttccatttttttcatctttcgtagtggattggacaccggaccgaccggtactacgtactctctggtttgtaatactttctccactccatttcatattataagatatctttatttttttaagtctattttttaagtttaatatatttatatagaaatatagcaatatctgtaacaccaaaatagtatcactaaatataattttgagaatattttatattgtatttgttttatattaaaaatgttgttacgttttcatacaaacttgattagaattacataagtttgatttaggaaatactaataacccttataatataaaacggaggagcactggtcggcttaaatatacaccaatatcttacattttagatggaggtaatataatttattttgtttggacttggtaaaacattagagtaacactttttcatatttaaatgaaataaaacatttaaatatatgtccaaagaacaacagcgtaatctattaaaaaaattaggggtgggtagatatgttatacacactctttttggcttcacacacacactcggacacacatctccaatcttgagcacacagccacacacacacacaccatatcgctcaagttccaatggaggtacaggaactagtaccgtcgccatggtcgtcgtcctcgtccttcctagtgctcgtgctggccaccttgctcttcgtcgccgccttcctccggcggcgacagggagcgcggcgcaagtacaacatcccgccggggcctcgcccatggccggtgatcggcaacctgaacctgatcggcgccctcccgtaccgctccatccgcgacctctcccggcggtacggcccgctcatgtccctccggttcggctccttccccgtcgtcgtgggctcgtcggtggacatggccaggtacttcctgagggccaacgacctggcgttcctggaccggccgaggacggccgccggcaggtacaccgtgtacaactacgccggcgtgctgtggtcgcactacggcgagtactggcgccaggcgcgccggctgtgggtcacggagctcctcagcgcgcggaggctggcgtcgacggagcacgtccgtgccgaggaggtgcgcgccatgctgcgcggcctgagccgccgcgcgggcgccggcaccgccgtggtgctcaaggagcacatgctcatggtgacgctcaacgtcatctcgcgcatggtgttcgggaagaagtacatcgtcgaggagggggagggttcgtcgccgacgacggcggaggagttcaggttagggttttaaatctccagctatagctgccgttatcttcggctataataagtttgagaagggctctagctattaatttgctctcatttataacttagccgctatatatagctccatttagcctggtcggtattgctgctgctataaactatttgagaagactaactgctaaatatcttagcccgttattcaaaacgttggttggttcaggtggatgatcgaggagatcttcttcctcaacggcgtgttcaacatcggcgacatggtcccgtggctggggtggctggacccgcaggggtacatcgggaggatgaagaggctgggcggcatgttcgaccggttcctggagcacatcctggacgagcacgtcgagcggcggcggcgagagggcgacgggttcgccgccagggacatggtcgacctgctgctgcagttcgccgacgatcccagcctcaaggttcccatccagcgggatggcgtcaaagcattcattctggtataactacttgtttcattattaaatatacttgacgttttatatatacttttatatatcaaaaacagaggaagtctatgctacaacatactgtttcaattcatccaagagaataaagcatatgcagtttttttttaaaaaaagatattaagattgtggttagaaatggttgcgtggttggttgagataggaagatgacggagaaattaaattaggagaggttatggttgattaagatgggagtatgtgctagtaaaagctttgtaagcatcttgaaaaaaaaataggtgaaaccccgcacattgctgcgagaatttactatgataacaataaaaaaataacttgtaagatagctagataacatcagattaagtaaattaatgtggtttataataatttaaatttaaatagtatgtagaatggtgattcaaacgtaaaaagtaaggttgtatgactttatggaagaagaaaaatagagagatagtttggacgtagattaatcatctaaaggttaaaaataattgatgtgatttgacttaattagaaaaaaaaagagaaagataatttgtaccatagattaatcatttaagcactaactaagtgagaatgaactatataagtatataggatatcattaaacataataaagatatacattgaaacattatgtgaattatgctggatgataatttaatatgtttgtatttgaaaagctcttaaattataaaaactataaagatatagcaagtttacatgatgtttaaatgtgatgattgttagtggatgatgatgtggcatcttgttaattagtggatgatgatgtgacatcttgtttagtgaatgatgatgtagcatctttgcatgttaagtttaaggagttagtgggggataactttatagtaagataggatttaaaactccaaatgttctaataaaagcgctagtaaaagcattgtaagcatctgaacatacttacatcgaccattaacaaaactattgaatactccgcgtgtttgtagcaagaaatttacaaaaatgttttggacagctcgtagaaaaaaattttgaaaatcacagtaaaaaaccaatttataactcatatattctttttttgacggtctaaccatcaaatgtaactataatatatttatagtgtaattatattataactaatatataatcataaatgtaatttagatgtaaattatatgtaactataaaaaacaagttagctcgctgatagtgatgggtgcctacgactaaaagatcacggattcgagtcttggcgcgtgtaagtggtttttgtttctcttgtcacatgcaggaatctcagctactccgttctttttgaagcagaataaaatcatgaatttatatgttaattaatgtggattgcacgatagtatttgtcatcttgtaaataatagtacatggattgttgtgatatccaaattaatgatgcgtggcggctgcaggagctgatcacgggcagcacggacacaacatcggtgtcggtggagtgggccatgtcggaggtcctgaggaatccgtccgtcctcgccagggccaccgacgagctggaccgcgtggtcggccgccgccgcctcgtcgccgagggcgacatccccaacctcccctacctcgacgccgtcgtcaaggagagcatgcggctccaccccgtcgtgccgctcctcgtcccgcgcgtctcccgcgaggacgccttctccgtctccgtcgccggcgccgccgctagctacgacatcccggcgggcacccgcgtgctcgtcaacgtgtgggccatcgggcgcgacccggcggtgtggggggacgacgcggaggagttccggccggagcggttcgccgccggcggggagcgcggcggcgtggacgtgaaggggcaggacttcgagctgctgccgtttgggtcggggcggcggatgtgcccggggttcggactggggttgaagatggtgcagctgacgctggcgaatctgctgcacggcttcgcgtggaggctccccggcggcgcggcggcggaggagctgagcatggaggagaagttcgggatatccgtctcccggttggtccagctcaaggccattcccgagcccaagctcccggcacatctctatgatgaataattcatgcactgacgggccgcatgcatgtatgctcgtatgtgcgctctctctctctctctctgagttcatagttatattttactgcagagtacttgtttatttatcgatctacacgcagatgataaacggagtacagtataatgaaaaaaagtttttctttttttttactgtacctttagatggtcctgggtcgtctactagttcagatccaaagaccagcgatataatttgttttttttaaacagtagacggtaggagatctaccggatatattagaagaagagagttgatcctgtttattaggaaaatcaggtcaaaaaccatacaactgtacagcttactaaaaggaaaccggcaaaaaaccttacacaaaagacacgaaaagcatgcgataaaactacaaaccacagtagtgaccgaggggagagcaataccttcaaggcgaagcctccaaggaggtgaacaacgacataagccactgtcgactcccgcccaaagaactaggctgggttttcacccaaagggagagagagtccacaaggcaacacctccaagaaggaaacggcgcccgcaggcatcgatgtcgccgatcctggaagaccagacaaggctttcgcttaagattccctcaaaggtgtagagcctataagaaaccagagtcaaagtgttaagtgttatcgttgcccagctcatcggctagacccgatgcagcaactccgactccgtcttaacacagaaactctagcattgtagagggcaagcaccccactcaaaactcggcactacgacaggttcatacagacacaggacacttaaagcatcggcgagacccaaaagccttgactacagacacactggaccccaaacacggacaaacacttctcctcaataaccgaaaggctccacgaccgggtctggagacggccaaaagaagagaggagcaccaaggagtgaaggagtcgtggccggcatgaaaaggaactgagagctgaagtcaggggcaacaaagaccactgtgtcttccatgattccggcaaggaactccggctatcgcgggacaatccttacgactgcagcaaccaccaccaacttcaccgccagcgcagagaaaggtacaccagggcgagcagaagagcaactaagaagaagcgatggtgagaggaagggaggaagggatgtggggtggggggaggaaggaaatgaggggcctcagcagctgccggcgatggccggaggaacagagaggaaaagagaaaggaggaagaaagcaaggaagaagaaacgggtggttgcagggacggcttccgcagttgccagcgacagggggggtggccggacgccaaactcgccaacccggagccgactgatgccgcgctgccacgcgggcactggcaatccgccgcccacgctccggcgcccgcacggccgagcatgaccgccacctcgtgagcagacttgcgcgacgatccggccgcctcgcaagtcgccagacgccgcagcagccgccgccagccgggccacctccgcttcacgccgccccacgacaccgccaccgacgcaccgtctagatccggcgacggcgtctagctgggatccctcgccgccgccactccccaccgccggcgaaaactccacctcccccatgcctgagaggggaaaccaccgcggtggagaagtaaattaggaaacaaattgcatgtcatttaataggtaaaatttgttggacaaacgagactaaatcagtcgattaggaggcacttgacgaggcggcggttagaagggacgatgcatcggcggttctgcgtaattcagatgaaggcgacgaccgtagtaataacattaaaggtttgcaacctcgccagcgcagggcaggctggaacaaggccattctactcgactgctcgtccttgccacactagtacagatccttctatctgtgacgggctctaatatgcttagaaatagcgggccgtcacaaggaagtcatctcaatcgggccgaaaagtgcccgattgagatatggtcgcacagacatgttagatgggtataaaacttaagcccgtcacaaatgaccatcatctgtgacgtgcaccaacttgaggcccgtttgagataacaactaggcccgtcacagatgactcatcagtgacgggctatatacttaatctctatcgggcattaactaaagcccgtcaccgatgactatttttccatttttcatatgaaatgtttatatttgtaagttgactatagcaaaataattttacgggtagtaaatgatttcaaatggaaaaaatgtcaacaacaaagttgtataacttatcaatatttacaacttttagtttggtcatttttcaatataacatttttttgaacagtttgaatttgaatttaaaaatatgacaacttcaaacaacattttcaaatactaaatgatttcaatggaaaaagtcatcaacaacaaagttgaataactcatcaagatctaaaacttttatttttgttatttcttcatctgacgaaatgttattaatattattcacaaattttacatatatgtgttatagtttataaaaccagataagagatatgtcaattttataaacaatgttactatcactttgtcgtatgaagaaatgaccaaaataaaagttttagatcttgatgagttattcaactttgttgttgataactttttcagttgatatcatttagtatttgaaaatattgtttgaagttgttatattttcaaattcaaattcaaacggttcaaaaaatgttatatagaaaaatgaccaaaataaaagttatagattttgatgagttatacaactttgttgttgatgactttttcagttgaagtcgttcactgatctaaaattctatttgaactttttaaactttgaatttcaaatttaaaattgtttaaatagagtcagatggagaaatgaccaaaataaaaattttgcacctcgatgagttctacaactttggttttggtgacttttccatttgaaatcatttagtaaccccaatttgacatcctggcctagggcataataggattaatagaatactcataccaacatgttacaattacttttccagaagccaatctctaaagaattttgacgttaagtatgcttggtctggagcaattttgggatgggtgaccgaccgggaaatttgaaagcgtgggtgcacacgagtgagggctagccaaaaaatgaaatttatttaattttggaatatactcatctgtgatgggcattactcaaatttgaacttcctgcgtgggtgcacacgagtgagggctagccaaaaaatgaaatttatttatttttggaatatactcatctgtgatgggcattactctagcataagttaatgtaatgcccgtcacagatgattaatgcccgtcacagataagggtcatctgtataagggtcatctgtgacgggcgctagttgtggcccgattaagataggtcatctgtgacgggctatagtttgactggtcgtctgggtcaaaactatcggtgacgggctttacttatggcccgattgagatagaatcatgcgtgacggccgtttgcccgattgagatagctcttcacatcagtgacttctagcatgtgacggacgccatgcccgattgagatgggacttaccgcccgattaagatgagggtatccgttctagtgcctgctccaaaaatcccgcgttagccgttgcttagcactaggatgggcgcctgcgattggcggcgcggtaggaggggtggtgccgccatgcccgtgctcgcgcgaggggaaggagaccgatggcagatgatggccaagagcacgagattgtggcggtggccggccgtcctcctgcatcgtcaaatcatgatggattgttattggacctgcaaactcagcccgtttggtccatcatgaataagttcactttgactccattactctgaaccgcaaaactagatatcttatctctaaactgttaaaaccggtgcaatttgattccctcgacgattttaacgtggcatgttaaaaaaatcaaacttataatatgaaataaatagtcccatgaaaaaaaattagcagcccactcccaataacaaccagcaacccatagttctaagaagaaaagaaaaaaaataaaaatagcagaaaagcaaaataaaaataaaaaggggcaggcgaagagaggaaagagaagacgaaggagaagggagatcctcttcccgctctattcccttcccttcccttccttgccgacccccgtaatattcccttctcctcctcctcccgcttgctttcctttcccctcactctctctagctcgctcgctcccaccacctttctttgctttctttgaccaccaccattgtccccctccgctccacatgctgtggcgggcgctgtggtggtggcggcggtgggtcgccgtcgcgggcgcggtggcgtggttgttggcggcggcggtgcggccggcgggcgcggcgtggtgcatcgcgaggagcggggcggcggagaggacggtgcaggcggcgctggactacgcgtgcggccccgcggggggagccgactgcgccccgatccaggccagcggcctctgctacctccccaacaccctcgccgcccacgcctcctacgccttcaactccgtcttccagcgcgcccgcgccgcccccggcgcctgcgacttcgccggcaccgccaccatcaccctcaccgaccccagtcagtagtcctctcatctcctctaatcatccaccgccatgaaatccatccatgattactgtagtatcatcggttcattgtcctgcgtatccatccatctctgcttctcttttgcttttgcttttttgttttttgcttggtctccgagtatgtctgtctcttttgcttttttcctgcttcggtattaccattgccacactatactagtgctgctttggtagtagctgcttttcttttctgaagctttggtgttgtttcttgcaacgtctttgccgggttcgtacgattcatatccatctttctttctctagtttcctgtttgctaacttttctttctgttttctagtacgtaatcatgtgataaaccgataaagacaagcaatgtcagtcagcatctttttttgaaaaaacttttcgattgtttcttgtgtgctatctttgccttcccgctggtgataatcctgtagtatatcttcctttaatcttattgttgtagtgattaatcaggatctatctaagctaataatgctcactgccagtgccacaagagcatggatttcccttttcctgtttgttagttgttacattcattgcgcaatctgcaaattattctttgagaaaggaggagggaatgctttcaactccagttcaaatgaattcaactcaggccaatattattttcactattatttatgctccacaaaatcgatgactaactgtagatgagtccatgttataaaactgacataatgaagtgaagtggcagaacatacttaacatggctaatgtaaatctaatgacactactgcaaacacccgaacagaacaaaactgtattagggccatccatgtctattctaagctctttgtatttatgttaaaaatgatttttttcccttggggtaaatttggtgagacgtaaagaagtcagttcaagataccacttaatacttgatttgggggagaaaaaagtatgcatgactcttgtgctagttagaaccattgaggtggcagcctttctactattggtgttaacatgttgattgattggcttaaatgatgtttcctgacggagaatttcagataacgtattttctacaaaacaaaataccttcatcatgcaagtgcaacaggtgaatttatttatagccatcccaatttatcttcaatcctctttcgaagtgaaaaattgaataaaacacaccataattatacagtcagaaacgagtgatctacatggacatttttgtgattgtacatgcactcaaggtaagtttgtggtatgtatgtcttcaacaaaaacattcttaaggttctaagttctagacgttgattgctacctagcaccttctatatttctagcctacatgtttacatgcaattggcaatgtaacaaatgagttggatctgtaatggaagtattggaatcggaaataggtcttgaaattctcatatctaagttccctttcttctgatatagacatgtccttagtttttcctttttgtttctcttttagttttcttagtgcattgaggttgctttatattacatctactgtgtgcatccaatcatccatgctttcttgttatcttcttgagatctctcaaggtgcatactattttaactctgtgtgtacttctctctgtttttttttttttttttgcgaggtgaactgtgtgtacttactctgcttgttcctgtatttcaggctatggatcatgcacctacccagcatcaccaaggtacacgcatcacatattatcagtttattgatctgctccatatggagtacatctgctgaacgttcatctagaaatcacatctcatataaccaagcaaaatagtcttttagaagataaaattgagtaaaagcgcagcagcatacagagtgtctgagttgtatagatactagcttttagagctctctgatattcagttatttcacttcacagctattcttaactcccaccacaatggacagtgctcacttaattgcatgaattagacctgtacatcaaaataataatgccagttggtgtaactaatgggatttgaaagtaaacaccttttgtaaatgcattaagtccttaaagtgaaccaagtcagatccaagaaaaaagtttcattacagtgctctccttacagaaaatttctggttttccaaggacacagcctaatacacattgtcagtgtttgtacagaaaaaatcgtaatgatggtttattttttggtttagtatataactagttgggtggcccgcacaattgcgcggctagcacccatataaaattatatatttttaatataattttacttcaaatttattaaatagttatctcattgtcttaaaatttttaaagactaaaccttattatcctcgtgtttctattttttttagtttttaaaagtcacaacggttgctaccccttacttctgtcatattattctttatttgcttgcttgatctaccactagtttctatttattctccttggaacctttaaaaattggatcgaaaaacttataggtttagagtttattatcctgttcggcatcttttttataatttctagaagtcccgtcgaacactgccattatactcatctacgaccgtccactgcatcttctatttattgtcattgctattttaaaaattgaacataattatcgtttaggttcattttttttactttctagaagtttcggcaaaacgtcagcaactttgtcactgtactcctctacggctcacctgctgccgcccttctttattgtcgttgagattttaaaatcaaacaggattatcattggggtttttttttatttttttagaagccctaacctttaaaaattggaccttatagtttttaagtttattatcttgttgggttttatctttttataatttttagaaatcccgtcaaacgctgccaccatactcctatatgacccgtccgccacatactctttattgttattaggattctaaaagtcgaacataactatcattggaattcttttttttttactttctagaagacccaccaaccattggcgactttgccattgtactcctatacaacccgccgctgcctcttatttttattattattgagattttaaaaatcaaatatgactctcattggttttttttttactttctagaagtcgcgccacccgcctcgaccgattgcttcacgacctgtctgttgtaattccttttaatcgtcattacgattgtatttggtgttttattaatagtttttagatgtcccatcaaccgccaccactctgctcctctatagacctgttacttaattaatctcgtcatttgtttcatatggttttttcttttagtaatctttattttttatcaccaaatttagttatttataaattgtattcctagttgatatcttatttttctttttctcatttcagaatttatattatttttcgtattgtgttctttgatatttttatttttattttcagtttagttgttttaaaattgtattcctactttaactctctttttatttgcctaatttcagattatattttattttttattccgaattttagttaatctactattgggttcttatatgtactcttatttcaatattgtttatatttaattctaaattttagttaattttaaattatattcctacttgaactcatcttttcgtctcttttttctaattttgattttctttatttttattccgaattttaattaatatggacccttcttccaatattccttatttttaattccgaatttcagttatttttaaattgtattcctacttggacttttcttttcttttttttttgctaatttcagattttattttatttttattccgaattttaattaatctcgtattaggttcctatatggactcttctttcaatacttattatttttccgaatttcagctatttttaaattgtattcctacttagactctttctttttgctacggattttatttcatttttatttcgaattttgattaatgttgtattgggttcctatatgaaaatttctttcaatattgcttacttttaattctgaattttagctatttttaaattatatttctacttggactcttcttttcttttttttttctttttctccgattaatgtagaaatttctagcccccacagcgaacgtggtgccttctttcaagggtgttttaataatataatagatagatagatgttagtgaggttagcttgttaggatacacactacagccagacaacatggtttaacctgagttagaattcttgttttgagtaactcgaggaatattgtccaagggattgactattgatcaatccatgtatactcaaaagcgaaggggggacaccacaaaatagatttctgattgaaacaccaagtattcacaatcaaatttgatgtttattcgcaaacagttgtgtgaactctgcaaactactacaacattacaaaggaagtttagtatgaagctgtagttcttttctagaaaagaacctctgttcatttttaaatgtatttttgcctatcttttgtaaaatggaaaagtattttacgaaattgtattagaaatggattcactttgtgtagccgtgcattttatttattaatcgatgttttgagaaaaataaactgcatttatttttctgaaaaaaaaacatgtgcattttagcccttaatcgaccgacacgacacacatataaataagtttttattattctactgtgctttggattcaccagaaatcgtaacattcaaacctgtaatgttgctcaatcgcattacaaagcagatcaacagaaattacgttactgatgactaaaccgtaagacagttgaatataacaaaaagaaatagtcagtctgctgatcaaggtgagatctctgttttttttttctgtgcagcactgcagggcagtcaggatcaaccggcggcataccatcaccgccggccgccgacggcggtggcctgagccccccggacctcggctccagcgacgactctggcgccgccgcccgatcccgcctcgccgccgcgccattccttccccggcttgctctgtcctgtctcctcgtgtacttgctgcacacgcagcggtggtgatgaagggtgagagatttatatagcattgcatacattgttgcacaaagcggaatttgtaagaaaaagaacaccacatttttgttgatgggagacttggagagtagtggctcgtgtcgtgggcgtacgtagctagccgttggtgagaacctgcccccgttcaagctgaaaggggggctagagtgagtggcaacttggatcatgttggattcatatattctcttttgtttgtcaatctgtttgttgtttgagttttaagatttttcgtttagttttctagttttgcttttgcttctagttgtctagttactccaaaatatcaaataattctattttttaagtgtataataattaaaactgaattaattttgcgctaatggcttatacttattttgcatgcccttacttaatcctcatattcatgggttgcaaacaccacctaatgtgtgaaaccagcccaccacattgggccaattggcaggcaaattccttatttctcatgacccaaaaggacaatagatgtcaaataagattgtgtattttgttttctgttaaaatgatagtgtcaagggagcagcttagaatatgttcgccaaataggttaggaaatcatatctgcatccatttcaattttttaatcccacttctcataattcatgtcgaaacaagatttcggcaatactaaaaggggtggctatcaagctgaaaaagtggatgggttaagagacaaggaattttatacaagttcaggccttcttaatcaagaagtaataccctactcctgtccggagattgatccgccgagtatattattgatcgtatgatctgggtaaaaaaacgtgcccctagagacacccggacccttccttatataaaagaagaggtccgtattacaaaatacagtccatatccctaacggaataggtagttacaaataaaatacaatcgtaaccgactaggatctcaggtattaccttgacatacaagtttagaatttaacccgagtcattttaaagatattctatctatacatggcaccccatacccagtcggactatacatgccgtgtaggtatggggtatccataatctccacagtagcccctaagacctttacagtcaacgaaatagtcttctctcatgatccaaaacgataatccaagtactccgacttcttctcccctgatctcccgagtaccaaaatcaaagactgtgaaggtctgaaaatagaaaaaaccaggtgcatcgactagatgcacctaattaggtgtagcccccgactatgtgattagttaaaaaactaaacatatagtcaagatgcaaacaacatccaaccgagtggttttataaccgaatatcatacagcaaagaatatgcggcgttcaataaagcatccagccgaatgctttagctttaatatatcaaaaatggagatatgaagaggcctgagtgagaaacactctaaagatctataaatccacacatatgataagaatccgagtaaaaactcttaaaaagatccatcaaacgtggtataaatgtgataacataacaggtgatgagtctaaatagcctaggctatgactcacgccataatcaaaataagcatataacatgccgagtaaatgactgtattaaaaccagtcatctcaataaaacccaaacagcctttgcagcctaaaaaggtgtcacgcccggaaattcactagtaatttccgaacttatttgtgcataaaatcctcgtccaggaatcagccgaggtacacaaactgacaa

SEQ ID NO: 68759 - DNA, 15152 bp, Oryza sativa
  unsure (1)..(15152): unsure at all n locations
gattgggttttttatgggacggagggagtatgcaagaaggtggttctttcaaagctcagctgagggaatatatgcaagaagatggttctttcaaagctcagttgaggggacctctcagttctggagagggctccacgaagtgaaaaatttagtgtaatatatgtgttgtgagaggaatgtgaacaatggggaggcacaattctaggaatatgtgtggatgggagagttgcttctttcggtaggcttgttcatgaatttctgtagtccaatcaatattttctttttagaaaaaggtatttgaagtaagaatgtcttatttgaagcatgctatactaactaactaattaatggcatgtggccttattgctgatggtcatgtactcatacgtgttagctgcttcagagaaagatccagaaatgaagtgaaaccacaatgatttggcacacaacttttttgaatcagatgtagatgttcaaaattgagagtgtactgatgcctcaatcatgttgataggtaccctaaaaaatactgttaatagtttgatacactggaaagcgagtataattgaggttaccgtatttgtaatttgtgatatattggcatatgcatctggtgagaaacaaagagaaaatatgtatgcctcaagctagaacacgataaagtaccagaagacaatcaccttattagaagagagatgtccttgcacttagtaaaattcatcgagtgttgttatgtagtgggtagtattccgatgtaccaataaatcttcagagccatctatatatacagcaaaccgattaacattgtgcgtgctctcgcgatagcctaaacgagtgacccctcctttaatcaactagatggataccccgcacgttactgcgggaggattgtgtgataatatagtagatatgagttctaaaattttctctttttttttacctttatacaactgttggtatttcttaacgatattactagaaatataattcctagcaatggtgcagaaatatttctggtatattatggttacagagttcatccgcaagcgcacggatataccattctagcatttcactttagagtatttcaagggtatcgtatttgtttaatcccgtggtaagattataatagagagaaccgtactaataatttatatattacttgtaacaaccaaaagtctaagcatgggttaatataatttagagggtagagtggtactaagtagaagcatttatactcttattcacaattatctaagctaactggaaagaatatagaaagatcttattcctatacttcatattatacatacatattatacatacatcctagttatatccttacttatctaataccatctttccgatgctctcctggtgcttcgagaagccatccctgattgctgagttccttacgacaatccgtcatgaccatccaaccggagctaaatacagaggagtaccctccccaggaaattaacttaggactatatacacgcgcggaggaatacccgtattgagctgtcaccatcagcggcccacttcgcttccacagcatataatcctaaatgatgatatccagtaatttaaacactacgcttaaattaccaaatactactataatatcatcgtcatgacatagagtcatcgtatacacgatcattatacccacaccattgcatctcccagataagctagcattataataaatataacttgcatatataataaagttggtattcatatactcggaaagtagtacaataccaaagtagtataaagaagaatattctaaataaagtacaagtcttacatccataagtctgattctcgacatcgtccgattgattgatcgtctattttgatgtcgattctcctccattctaggttcattctttgcaagaggttagtaatcctaaagctagtggaatatttattattaaacgtaaatatgcattgcaagcataactagttctcctttattttggtagtattgatggtcaaaactaatcgctaatgaccgtcaacaacaaccgtcctaaaattttctttcttacctactatacaattatttttttcatgtgtttatctattcttatacttttatcaattatcttgaggttataaatgattacgttgtatggtgtgccttttgggggaagagacgcaatttacacccttgatgaatcatccaaaggctaaaaacaattaaggtgatgtggcttcatgagagaagagagaattagcattaactacacttggtggggatgaactttatagatatataggatcagtgcacatacgaccacaagctcctttctaaaaaggtcaccgcgcaacaagaaaatggacatttggccacattcaaaaagtggtttcgctagaatgccattccgaaaacgtgtttcgctaaaatgacaatatgaagcgcgcaatcacagccactttgccattttctccattttcatcattttcaattccattttcactggaattcggcttggagggagcgggggaggcggaggtggtgggagattggggcggcggtgacgacttcgtcggtggtagtgctggtgaggaaggccgccgcggagagccaccacggtcttgggcagccgcatccgccgccggacggcgccgtcctctgccgaccacttctccgacaacgggcacaggcgacggcgcgacctctggtgcccgctgccaccaccttccccgatgatgacgagcttcggctaagttgataaggggcaattttgtctcatcacctagtagaggagagaaaatctttttgaaaatgaataaaatgataaaaatggcaaagtggcggtagacgcacgctccatattggcattttatcgaatcgcgtttttgagatgatattatagtgaaaccacgttttaaacatggccaaatgtccattttctgccgcgcaaccctccccagtccccgcacacgccttctcgtgagaatgaaccgtgtgttgtgtgtgcttttcctactgggccgatatgaagcccataaacaccacgagaggaaaaaaacatatggggagctagggttccacctcgatccaaaatccaatggacaaaataatattcataaaaaaagaagtacaaacaagagtcaaaagcaaataaataagctccatcctgagacctaaaaatgcctcctagtttcaagcttatgtacattccatcacaaatttcatctccttttctgatactaaaaaaaatggtgggaaaaaggcaagttatatagggagaaagttatttctaaattatgtaaaagttactccctagaaatatataagttacttttcaaactagtttaactgacttccaaaagccctgaaaagactgcatcttctaacatgaaaaaaaaaggttatgttactcgttttgcatctcttcatgtttatttgtttatactggcaaatactccctctgtctcataacgtaagactttatagtattccatatctatatagatgttaatgaatctagacacatatgtatgtccaaattcattaacatctatatgaatgtgggcaatactggaaagttttacgttatgaaacggaggaaatacatatctacggtagggataatagttacttcctagaatcatataagttacttttgaataacacatatttagcatcataatatcttgcttattacctatatagagtattagaaaagaaaatctgagataagtttactcaatgaaaaccatccatatctgtcgacgagtgatactagtagaccggatgattagggtattgggatacattggaacgaggatctaggtaacacgacatcaagcaagtagaagacaaggattatactggttcagaccccttatcaggtaatagccctactctaggggattgatgatggaaaactacagattacaatggaagtagacgaaatcgatgataccgataagatcgtagtcgaggtattcgacgagatctcctggcaacttggcttcgcgtactctggcttcgtaaactatggtgggtgtgttggcgatgagattcgatgccttgcacccctccttgggggtcccttttataccgtggattatcttgatctccaagtaagactcggagacattggatcttatacgatataacagaaactctatcctctccgagcaggactttggaaattgcttggctcgtagagatattttccataatctgtaacaaattcctacggcgtacacgggaacaatcgatgtacgtgaaggtatgccatatccgtatattttataactcataggatataaggtatgccttatccgtaactatgacaatatctttaacatattgacatcaaatcatgcacacaaagcgcaaaaaaaaatgcatcgtgagactccgatccttttattcctaaaatataaaggattttggaagaatatgatatatttgtaaactagatagtgtgtcacatccctccaaaatcttttatactctctccattaaaaaatataagggattttgggtagatgtggaatgagttggaacatacttcatgtctagatttattgtattagaatttgtcacatccatccaaaatttcttatataattggacggagggagtactttccatcaaaatcttcatttatttattttataggatcatactccctccgtttcatattataagtcatttgattttttttctagtcgaactttattccgttgaccgattttatagaaaaagttaacaatatcaaaaatataaaattagttttattaaatttaacagtaaatatagtttgataatatgtttattttatgttggaaaaagtattatatttttctataaactagaaaaatcgcccgtgcgttgcaacgggtaaagatgttttttcaatgatatactaagagctgagtaaaaaactgaaaatattgggatcactatacattataattgaaaaaggtaatgaaaattttaatattgggatcgctatatattacaattaaacaagttaatgaatatcttttctgggttttggccgaaagccttccttccttttagccctaggcaagtccgctacctccctccgtttggcctacttacctccatttggtctgcttccttcgacccatcaaatccctccctccatttggcctgcttcatttgactcatcaaatccggccgaatctttctcgatcacccaaaattggttgatgattttttatccactcgatctcctatttccctttttgtcccnnnnnnnnnnnnnnnnnnnnnnnnnaattaaaaacgataagggaaaatcgccgtcattatcgacaactgttagattaaatctgaccaaataaaataaagctgggaaaatcatggagaaaatgataaatgaggagtgggaatcgatttttttttgcaatcaaattagagtagaaaacacacgattgatatggcgtcggtgcagcgccagggttcaactcgggagacgtgcacagaataaattggattaaaaaactgagtgagaaaaaccaaaagggagaaaataaccggtgacaaaaaagttgacgaaaaaaccaaaaggtccgggaggggcggtgaacagatcggatgtaaaaaacggaaaaaaaataatagcacgtgcgggaaaaaaaaactctttcgcgtgaaagaaaaagtcagaaaaataccggtgaaaaaaaaccaaacggaattttttttactggcgagattttttttttcctttttttcaatggagtcggacgatttttttttttcaatttttactgacgcgcggcagaagcttttttatcgcttctgagtcggacattttcttttcctttttttacctttttagtcgcactattttttcctttttttgctcggccttttttttccttttttttttactcggaccttctattttaccggctatggaattttctcgtactttttaagtagagatagaaattaagaccgtaacataaaattaaaaccatatttgatataccaaagtaccggaaaaacatttttaatttttataatagtagagatttaagttaaacttaaaaaaattgactaataaaatacttcatccgttttataatataacactttttagtgttgtccatattcacttagatgctaatgaattgtatacatatagattcattaatatttatatagatgtgacagtgctagaaagtctttcgtcgtgaaaggtgtggggccagtgtcctgacacgagtgccctgggcctgcagctcctccgtctcaggcgacgtcggaggcagagctccagtcctcgatcgtctgctcgctgctccggcgggaggacgaagaggagcggcggggttgggggtgctcccgcctgcccgcccgccggccagccagtaccctatggcagcagcttccctactatgccatgttattgctagatccgcccctgctggccggagccgccgctgcctcctccactccgacccccacaccgcgcaccccctcctcgtcgccttctcccgcctctgcgcccacggcccgctccgcgacgcgctcgcgctgctcccggacctcgccgcggccgggctcacagcggaccccgtcgccgtctcccgcctcatcaagctctgcgtccgccacggcacacccagcgatggccgcctcatccaccgccacgttttcggcggcggcgatgtggcggcgccctcctgcagcagcctctttgtctccaactccctcgtctccttgtacgccaagttcggcctgctcgacgacgcactcaggctgttcgacggaatgccgcacaagaatgtcgtgtcctggacgaccgtcgtcgctgcgctggccaatgcccgcgggaggaaggaggacgcgctgcggctttttgtggccatgctcagggacggagtggctcccaacatgtacactttctcgtccattctgggtgcttgcagcacgcccagggtgctcgcggcgatgcacgggagcatcgttaaggttgggttggattcggatgtgtttgtgcggagctccttgattgatgcgtatatgaagtttggagatttggacggtgggcgtcgtgtctttgacgagatggtaacacgtgatttgatcgtgtggaattcgatcattgcaggattcgcgcagagcggggatggtgtcggggcgatagagctttttatgaggatgaaggaggctgggttcttgtccaaccagggaaccttgaccagtgttctccgggcatgcactggtttggtcacacttgaggtggggaggcaggttcatgctcatgttctcaagtatgacaaggacctgattttgcataatgcacttcttgacatgtattgcaagtgcggtagcctgcaggatgcagatgccttgtttggcaggatgcctcagagggacgtgatctcttggagtaccatgatctctggtttggcacagaatgggagaagcattgaggcattgaaggtttttgacatgatgaaatctgaagggcctagaccaaaccacataactatggttggagttctctttgcatgcagccacgccggtctagtggaagatggttggtactactttagttcaatggagaaactcttcggtattcaacctgagagagaacactgcaactgcatggtcgatctacttggtcgggcagggaagcttgatgatgctgtgaagttcatccatgagatgaactttcagccggactcagttatatggaggactcttcttggggcttgcaggatgcacaaaaacgccgatcttgcagcatatgcagcaaaagagatccttagactggagcctgacgaccaaggtgcccgcatattattgtcaaacacgtatgctgatttgcgacaatgggcagatgctgagaagtcgtggaagatgatgagagacagaggggtaaagaaagatcctgggcgaagctggatcgagctgggtaagcaggtccatgttttcattgctggtgacttgtctcacccatgttcagagagtataattcaagagctgagccgacttttcagcagggtcacaaacctcggttataccccccagacagagtttgtgttgcaggatctggcaactgagcagaaggaagatctattgaaatatcatagtgagaagctggcaatagcatttggaacgatgaacgcgatggaacggaagcacataatgatcatgaagaacctcaggatctgtggtgactgtcatgcatttgcgaagctcgtctccaagagcgaaggcaaggtgatcatcatcagggaccctgttcgtttccaccatttccaggatggagtttgctcctgcaatgattactggtagggatgaccggcactgtcccccattcgcaaggtgcaacgaaggttagcagtgagtagtgaccacatcaaaggtctgatttgaaaatgtctccaaaaatgtcctgtccgtgtgctattggctggatgcacatacatgtcagcatacagcactggacaacatgtacggttgtacatgttactcctatcacatcaactccatatgttctcctacagctgatcctgagccacatctagatttcagtggaagtctgaaagaggagcgtgagaaagaaagagctaagctagtcgaaaggaggaaaaagaacaaggacggaatgcaaaaaaagggagaggagaaagagaaaggcaggaatagaaaccgcagccatagaaaagagaaggcctgctggccagccttcttcccccctcttccagctcatccaagccagcagttgtcaatcattttccccccgacttggaatctctgcaaaacacatgcacctataggcaagtcaaaagacatttcattatctactgtatgtatgttcttggaaagaaagtttgctttggatatacatgctaataatatcttgatgcttagcaaacaataatatttggtactccattttttcattcttgccatatgtttgtattcagccaagttaggtcaatatgcttgaattctgggtggagattattgtgggtaaaaaaaaaatgtcaaatgcatgtgatgtatgggtatctccacagttagcctagggggctcatataatttgacaatgagtatggtttccaggaatagctcatgttgtcaaattgattcaaagtacctatcctaatatcctatatgcataaagcctcttgacatgttggttaattattttcctaatctaggggagagcattatgatgtaatgtaaactctataaggtaaagcaactcagagcatcaattatcttggagttgacgggacaccagcagtttttggtgaagttgacaaccaatatgccatgatggttatttatctgaaccagctgaagggctacagagtccaccccagtagcagaaaatgtgccctttgtccaaagatgataggactcctgttagggatctttcaagtagaattgctgggatgtgttagattgaacaaataacagttgatagcgtaaaagaacaaaaataaagaagtttgcctgtggcctaggggattcaaatactttagtccatgtttaatctcttccctcttcccatcaggcttgaatgcttgatcctctgagaaccacaacacaaatgtctccgtgccatcctatttagctttgcatatgcttcttaacatcccaagatctacgatagatgagagaaccaccatcaagcataccatttcagtacagcaaagccctggaattatattaccaagttgtcaagttaaatacgctatgtgttcctgccattttttttttacttctttgaagttagtgttcattttatgtttttgtatttctaccataattcatctgaattctctttgacaggttcaagggaagtggctgtaaggtcatacatggtgcgtataatgatccatgtgtaccctgctatgtagttgttatgacttctgagatgtgcttgggtatcggacatggttaatggcttgtttcaagtttcatataatttcaagtttcaagttatgataaaacagtgataagatcattgccagttaagactgaaataatgtgctgaaagtttgtctaatttttgtgaaaactgaatcccgagggctcttcttcctctgctattgattttgaaggttattgtaaccatctgttgatgaacaacgacatcatgaagttaacagagtatcagtctcctaacaaaaccagtaaaatgagttctgttatttgccttttctttctaacgcagagcctgtttatgagccaacttcataaattactaggctttcctggatgatcggcctgttacgaatttgtgttgcgcagcatgattctatcacttggtagttctttccttcgtgaaggtgtctacttgacttgttggagtctgcttctgtggatttagataactttcacccgcatccagattccatttcttcctgttatgatagcatgcatatcacatgtactcccttgtccctcctcataaagtctgttgttctagcaagtcaaaagcgaattaaacaagagattcaaaaaatcagagcaacaagaagaacagagtattattgattcggttactgaaacgagggggaaaaaaagttgaactgacactatagataaacaaacaagattctctctacaaacaaaataataatgtgatctacagaatcctcccccaacgaggcgatcaggatccctctgatccagtgaatagtgaattccattccatgtgatgcgacgtggtaacgcggggaaaaccgcgctacgaaatccagcaagcggtccacagtgcgactgtgcgagcccgcgagtccccttcattccaaatcaaacgatgcaactgcaacggagacagatttatctattaataactgaagtctcaatctcaactctcctctctctgtctttctctctacccacccgctaccaatccccttcgctccgctccactcctccggatctccgccccgccccttccatctccggcgccggcgagaatggagctgctctgcatcgggacggcggacaccaagctggacgagctgctcttcctcgccgcccgcctccgctccaccctcgccgccacctcctccgcgcaggtgggctggcgctgctctctcgcccttctgctctgctactcaatttggttcccgcgcgagatgtagactcctagggaaataggggaatagggagtaggagctctatatcggtcccctcactttgttaatgaatctctattaggggggaatgagttagtgctggatgttacgggatgtgatcgtctaggatttgcggcttatacagtgattggggagaattatcatggtaattagcatgttcataggttatgcaatcattatatattacttttgtgcttagtattgagaaatgataatgcctcctcactagtcttgaaaagatgtttattattgtagaattatgcgttatttaagggtgtttagttttgggatttttactcataataatttaatcaatccatagtgttgtattaattgtttttcatttctctatatccttgcttagtcggttaagcgttatctacacttacaatgtaccatcccttttggaccaaccagaaaaccatgtaccgtcccatgcacaataccgaacataactcatcatgtaccatcttatagaacttctaaggaatgtgattgttcaacattgttgtaagaacacatttctgaaaaacttccagctatgatatacacaaagcaaagtttcagaagtaagaaaagctggtgaggaattttaagaaacaatttttttgccactgaaaacagcaggttgatagaaaaaaaattacaaagtatcttacaaatcgggactaaacattatttggatatatgaattagcaaaatgccacaattcatttaatggaggctgtagtgttttttttttttttgaaatagatggcaggagctctgcttattcattaaagaggagtagaatcaacaacattacacaaataacacttatcctgggctgcagacttagttgaaaaccgcaaagatacccttaacacactatcacttctctcacaacgcacactgccccaaccatgccatgccacgcgacagctgtactagcccaaggaaatgtgcatgcttgtgatagtgagtgcctgcttatagatcaaagtggtgactttgagggtgaatggctatggtgactcttagactggtggtggcagcatcagcatggcctccatagcaatgtgggactgccatgccctgcttgagcatattgtttgccatcaccatggccttctcaagcataaccctcatctcaattggcagcaatggctctattaaatggaggatcttgggtatcttggcagcgagatcatggatgattaattgctctgataccgaatactatgattactagattcatgaaaggtactcttcgctgggatgatagctaggcgacgttggggaagaattagttcctttgttgctttttcctggataatgagaggtggccaccataatgccatatatagtgagcctcttgattattttatataatagataaggattataacataaggtagctaattcttataaaatggaaattagagataatagagccaatcctttctttgtgccatatgcctggccttgtcttgcacatgctgtacggataaccattgttgtgttacatatcggaatggaaaattgtctgcacatgtggcatttttgtgcacagtttaaattgcttggctacttgcagaattttttcaattcaacaattttcttatgaaaagttacatgctccttggatatactgtagatttcttattttcctttgatatagtggtgcatcatatggtgtaatgacataacaggttcaagtaagccttgtggatgtctccacaactaagaaggtgacatcacaagattttaagggcaccacatttatctcaagagatgcagttctttcgtgtcatttaggtgtcgatcaacatgaacttcctagtgacagaggtgaagcaatcacactcatgtcagaggctctccagagctttctaaaaagaagatatgaaagtggtactctgctaggtgctgttggattaggaggcagtggaggaactgccctaattgctcctgctctaagatccctgccactcggagtgcctaagcttattgtatctactgttgctagtggccaaacggcaccatatgttggaacatcggacttggtgttgtttccttcagttgttgacatatgtggcataaacagtgtcagccgtgttatattatctaatgctgctgcagctgttgctggaatggtgcacggaatattaatggaatccaatgaatctgatgaaactgccacaaaaccaactattggtattacaatgtttggtgtgacaacaacatgtgtaaatatggtcaaagaaagactgagcaaagaaggttatgagacacttgtattccatgccacaggtgtaggaggaaaagcgatggaagaactagttaagggaggtttcatacaggtaccactttctggtaaattgtgatgataactcataatctcagttatcaactccttatgtaactggtagttgcagagttttttctttctcacatttatttggttgcatatagggtgtattagatataacgacaacagaagttgcagaccacattgttggcggtgttatggcatgtgatgatacaaggtttgatgcaattatcgacaacaaaatccctcttgttctcagtgttggagccttggatatggtcaactttggagctcgagatacgatacctcctgatttcacaggaagaaagatacatgtgcataatgagcaggttaagtataacaacactttccaatggtttttattcatttttgaccaaaatatgcttgcatgattattgctgaacttgtttcttcaggtgtattttcccttgtaatgcactatgaaggtataatcacattagatggttatgtcaactcagtgctacaacattggagaattatcagtaaatatgttattaaatttttagataaacattatacataatttactacatataatgctattaaggtttcaggatgatttattgttgtacagaatttgtatgggggtattttttttgttgcaaggatatgaaaatttccatctccttattctgtatgctgggtgcatttttttaaaatgtatcattgcagggcatttgcacaagcgttgtgttgtctaaaatgactctttagaagtccaatttcaagaaatattctcttatctcctgtaccattgtttgcgagtgctacatacatttcctctttgttacaatcagtaacaactctcttatcttacaggtttcactgatgcgaactacagtagaagagaacaaaaaaattgctgagtttatagctgataaaataaacaaatcttcatcgaaggttattgtttgcctgccacaaaagggcatctctgcaatagatgcacctaaaatgccattttacgatctggaggctacatctacgctgctggatgaattatgtagccgtatagagaaaactgacaacagagaggtttcctcatatttcataaattattgccttttatttttatctcttcaagtgaactaagctgttttagattattgacaggtcaagatgcttccatatcatataaatgatccggaatttgctaatgttttggtggacgcattcttgagtatggatgtaaaggcatctaatacaataagtccagaaaacagcatggtccaaactaatcaagatgtaaatacaaaagaatattgttcaacacagagaacttcagatagttctatcatatggagatctccagtagattttcctgatgcaagaccaggttagttcttatttgatctgcatatcatgagctaaaaacatttttatgctcacaaaggaaactgtagaggttatcaaatatctacatattctgattccatctacatgttcgtcgtttttatcatagaaattgctgcatgaggttattgaagttatctgatgctcactttggtattttctgttcagcgttactgaaacatctagtcggttgtgagagaatggttatctattaatttatttatgtttcttatagaatctgcagccaacatcatggtgctttcctcttttgttttatttacttgatttcctgatgaactactgt

SEQ ID NO: 68760 - DNA, 1556 bp, Oryza sativa
ttctcccggttcggcatcgcctccttcgggttcgcgcgacctcgccgacctcgtccacccctccgtttcgcccgccgaccaccggaacgccgccgtccccgtcaacccgagccgcgccgccgccttcctccgctccggtcgccattcccgtcgtcgccgtcgacccggggtgagccgtggaccgctgtttcgcttcccccttcccacccctctctcggccgccgctccgccgtgcctatggccgccgccggcgaccataggggcgcgggcgcgccgcctcccgtcggctgtgccggcgtggccgccttcgggcgcgtcccgcggctgccatgtggggcccggccgtcagccgcccgcgccctcgggtgcggctgacgcgtgggacccacgggcccggccggcgtaagccgcgtgcacccagtccaccgtggaccgtggggctgccgcgtgggccccactcccgtggacccggtccgcgcgcccctcccctcggctgacgcaatagatccgattttaaattaaaatttaaatgaagaaattcgcaaatatccattaaagagcatataaacttcaaatggccataacttggccatttgaactcggaattggaccgttcaagtctctaatttttccttaagaagtcaagaacccatttttgtgctttgtttctgcttgttgtatggggtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttacaaaattatgttgatttaaattattgcattatcgctttatttaaattcccgcgttatcactgttttatttagccatgcctatttacctttgttatgaccttattattattgttattgttattattaccttattcaccctagaataaacaaaaccccaactagtggacactctactcatagtaccactagtataattttaggtagatgcttcgcaatttaattaggtaacattaggcggtttacaactctagactttgggaatattcatatcacctggacactttggaatggtttggttgttgtggaattggcttcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtgacatctctagggcaaatgaaggctacacgagctgcggcccggtagtcgagatgtcatggcacagggccggtgtcctgctgctaggggctcagtcctgcctgcctgtcccgggggttccggccgtaggtgggatcgggtcggtactcttgtctatggctaggatgggttggaaactatgtcccgtcttccg

SEQ ID NO: 68761 - DNA, 6608 bp, Oryza sativa
taagtagtatcaatcagggatccattgggaaaatatttagccttcaacacccttgcacacagactatcagggaactctaacacacgccacgcctgacaagcgagaagagcttgattaaacaatctgtaatccctgaagcctagcccaccacaacactttggttttgtcaggcactcccacgctctccagtgagtctttcttctaccattctccgagccccaccaaaaattcctggtgagctttgttaggtcgtcacacatagaatccgggagcttaaataagcccattacatagaccggaatggcctggattacagccttaaccagaacttccttcccacccgaagagagaaaattttcaccccattggatcagccgcttccagattttactctgtaggctctgaaatctccccttgttcattctaccttctggggtgggaaaaccaagatatttatcttcaaagttgctcttttctatctagagaatctgttttattacctcagtgatctcgagggaggaagcatcatcgcacaaaattgagcatttagccgggttgatcaactggcccgttccctgcacataagtgtttaaaacatctttcaccgttgctgcctgtgcctgatttgctttgaagaatagaagggtgtcatcggcaaacagaaggtgtgatatgcccggcgcattgcgacagatactaagggggggtcagagaaccttgttggaccttctccttcagcaaaagagataacccatccgccacgaacaggaaagaaaaggcgacagggggtctccctatcttaatcctcgagagggagcaaatgatcgtagaagagttccattgaatttaacagaatatctcaccgtggttacgcaagtcattatccagttaacctagcggtgagcgaaacccacccgattcattgccatctcaaggaaacgccaatccaccttgtcataagctttggacagatcgagtttataagcacacgctgccttgttagctttcctgtttttctgaatatagtgaaaacactcaaaggctaggagtgcgttatctgttatcattcgccctcggacaaaagcgctctgttcctctgataccaattcatcgagcatcggtctgagcctgttaaccaggcacttggagacaactttgtaaagaacattgcacaagctaattggccgaaagtccttcaattccataggttgctcaatttttggaattagaactatagccgtattattgactccttctggcatacatctagtctgaaagaacttactaactgcactgatgatgtcctctttaatgatcccccaatttcgttgataaaagcgggcagggaaaccgtcagggcccggagctttcaatggtccaatctggaacaaagcctgagcgatctcttcatccttgaagtctgcacagagcaggtcattcattttagccgttaccttagcttggaataatctgctgacagattcagggttcaaggtcgggtctgcagcaaacatctcctggaaataatcagttgccattgattccattgctattgccgtacggggcacagtaccctgcaaatcttttagttttgtgattctattcttttttgctctccataccgccctactattaaaaaaatttggtattcttatctccttccttgagccaattcactctggaccgctgaagccaaagcatttcctctttgtataacagttcattcatttggttagtggcaaaacgaatttgggaattatcagcatctgaagcaatcaagtcccccagcttcttccttgccttttcaagttctctacctacatttttcacttttgttttgctccaggaacgcaaagccgccatgacttttgcgagagaccgatttatgtcccccaagtctgatttctcgctcgaactggaccaagaatctttaatcacctgtgctgagtcaatctctctttcccataggatctcgtagtgcagacatttctgtctaggctggttgttttccactgaaacaagcttgagaagcacagagcaatggtcagaacaaggtgagacaagatggacaatttgagcggagggaaagatgtctctccaaccattattggcaacagcacgatccaatctaacctttacattgttccatccatctctcctattgtcataagtatgaggcacaccttgaaaaccaaggtcgtgcaactcacaatcctgaaaaacatcccgaagggcttgcatttgagactcattcctctgggttcttgaaaagtgctcgaattgccacatagtctcattaaaatctcccataaccagccatggaaggtttgaggtttggctgatatttctaagcgcagtccatatctgatggggattttcaacccgaggttcaccatgcacaaaagtaacatgccacaagggatcatccggagacaagcgcacatacacatcaatgaaattctttcaaaactctgacatcgacggaaacatattcatgccaaaacaacgctaaaccaccactcatcccatcactactgacacccacaaaacctttaaaacccaatcttctacgcacacgacacactttttccaccttttgcctagtttcacacaggaagagcaaacgggcatcggcctccttaactaaggagcacatatcacgaactatcgcggtgttgcccataccacgacagttccaggctaaacaattcattgctcctggcgagacccagccataggtcttgccagtttaccagtagcccggggactggttgcttccatatccaccgctgtgttctcagccttctcatcctttttgaaacgctttgaggctcaagcaggaacccctgtcttcccctgccccgatccttcctgagattcactctgatcaaactccaacagagcctgttgcactttgcccattatcttcagttgagcattatcagaccctttcctcttgattgggctgatagtagcctcattggacacgtcctcagtagactcctgttgagtgcccaggttcctaatggccgggatcatctcgaatgatggaagtgatgctgactcatccccagctgaaaacttatttgtttggttcttacgggacaaagtactgtcagacatatgcagcgagccagccttttcagcaagttgagcgtcaactaactcatccccttcctcttctctcgaatcaaaaccatcgtaggcatcgattctgtttggtgggtcagtgtagaagcggtctccctgtttattccccgctgaagaagagctagcactacctgcgcctctgaacacaagcttcctctgaaccccagcactctgatttgccttaaccttgctgattttcctttcgaaagctttaagaggagagcagcgtagatcagcagagcacatgagtggttcagcctcattggctaatcttttctcgcactctttatctgagtgaccaatgaaaccacaaaagaagcagaagtgcggcaccctctcataacgaagattgaaccttctgatttcctcagcacctttgatcttgattttgattgcaatctgtcttttcaggggacgattaaccgggagatcaacacgaatgcggaagaaatcatgcttgttgctgccattttgctgcacatccacttccctgaccttgccgagtttactcccatacagctcacctctagctttgttcatcattactaagggcagatcatatatccttacccaaattggcactgactccaaggggaccatcgatggactcaaaaggccattgaaatctgctacaatcagagcatctcctctgtgaatccacgggccgccttgtagaacaaacttatggtctccctcagcattaaaggtgacgatgaaaagattgtcctttagagatttgtaactcatctccgctctgagtcgccaagctctacccatgtcctcaaataaggccacctggttggggaatttgagcgaatagaatctcgctaggatagtccatttcctgcacacttgacttcctcctcgtcaagttccacttcaattgcatcttcttcttcctccaaaactacaccctccatatgtgcttcagaacccaagttgacgcccgaactagattgcactaccacatccaccgcttgatcatctgccgggggtgccgccaccagatcttgcccagctttcaccagagccctggaatcctctacctctttgttccccagatccaatacggcgtcatccttcagcttcgggcaggtaaccatcgcattgatggtccctttgtcgcccccactgagagattttgccatgagatggatattgagagaacactgcccaaaacctagatcaaaacctgacaggagaatctccagagtttgcaaaggatgtatcgttgtggaaaccacaggtgtgtttttataggaggaggagacagagtccagatcggattcatacacatacgtctttccaaaggacaaaactgagacgaagttacgtagatgatcaaacctgccagaaccgattgtctcatgaacattccagaacttgatagccaacagagaaatacctaagaacgtggaccgcttccatagtgggacaggtctcttcccaccagatgagagaggattcccaaactgctgaagaccaccagagatatttccatgatctccagagatgcgaacagcagaatcaaacgtcacagaaccaaactttgttggtggaacagagacgaactccatccaaagaaccctcccaaaggagaagatggccgccacgccccagtcgcctgggcgccgccaaaaccctggcatctgtaaattacggagccaatttcggaatcaccatgaaagtagaaaaaaaaactagtcaatttcatcctctaggcgtgtacgtatttgcttcattgctttacactacatagatcgactcttcactgctttcgattttatgaatacacaagtcgaatgcatatacatgcgcacacataccacactcatgtatatacacacgcatgtagatgtgtcctagctagcacacatctaaagagattagaggcataggctcacatataaggatgtgtggggtacatccgtacatgcttatcattgaacacacccacatctacatgtattgcctcatgtggttaaacctaagaaaatttgagcatccatgcgaaccataatatttaaatttgggtgagcagtctaactaataattgagctattgctcgtagtcttcaatcgtatatcttgctagcttggttttgggtaggctcaaattaggcctgatcaaattaacggggctaggcaaaaaatagctctgagacaaaaatacaagcctgagctgacctgagcattctcgtttggtggctttttgggctttcgtgcttcaaaatgtagtcctgaccctgacccagtacaccattgagttgggccgggctcagtttgagcagccctagctcaaatgtgccaacggggttccaaggagaacttggagacgtttatgagctgtggcagcaacagccaggcaggcaggcaaattaaagcatacctttatcatacttattgcacatatttaagcctaaaagctactatagcttttgcaatgtgattatacatgcgagtacattaataatcctatcattgcattgaatactatcatccatggagagttgcattcatatcctgtacctttgtttatctaatactaccacccacggctaccttcggaacctataaggaaaggcatgtgagacattaaagaggtgtttatgttggttatctcactttgccatgtcacactttagttatgccacatgtgtttattttgttgtcgcacctatatcatcacatgccacacttttatactcttattaggatccatatgtcacattcttaaatttgtagctaaccatattacacatgtggccaattatttccgagccacagttatgctatcacctatcatgtcataacttatctaagcttagttatgataacgttagacatcaatcaaaaatctagtttctccttggaaagtgggcgggctggcattgcattgcctaatgttggcggacccccgcatgcagtgcaagtgaagcggctaaagaatgtgaggctacatttcgtctcgccaacgacttgccccgcatagctaggcagctagctaccgcgcgcatttaatttaagttgatatcgagcatgcatgggtacggtacgcgccggtcggactccggtggtgatcgatcaatggcgaggctctcaacagctgcgtggccgttcctggccgcagtggcggcggcgctgctgtgctccgtcgacgcggtgatcgtcgaaggcctccaggttgggttctacaaccagacgtgcccgtcggcggaggaggccgtccgtgacgtcgtcacctcggagatcggcttggaccgcaccatcgccgccggcatcatccgcatcttcttccacgactgcttcgtcacggtataacactaacagtacacatgtgtgttgtccgtacgtacgtgtgatcaatcaccttaatattggtattacgttgaagaatcgatcgatcgttgatggatggatatatagggatgcgacgcgtccatcctcctcgacgagacg

SEQ ID NO: 68762 - DNA, 11288 bp, Oryza sativa
aaggggttttgttggggaattttggtgtggaatagtggagtggatgtagtagtggctgcgtcccacagtactactttattgttttttaagtaaatttcttagtgtacaacttaagaaatgagcatactacttaacaagtgggtataacttagtacaagaacttaataaataagcatatgggtacaaataattaaaaggtgggtatggttttagcacataacttgattgagaagtggtgtaaaaacttaattattttgagcatttttggctatatgtcatcattttttttaatgtactcagttgttaatatacttatgtagatttgtacaagcatactttttttttcattctagtaattaaaagtcaaacaaattttactgtgtagaaattttaagttggtatttgagatggtgaaaataatatctaaatcaatggtgcaaattgagtaatatattcttacaaattacatcaaacattgtaagataatatctacgggattgctatgtgatgacatattaacattgtgaaaaaacttacatagcactcattaaccaaaatagcatatctagttaagttattgcaccaaaatactaaatacccactttccatgttattgtacttaaacgtctcattctcaagttcgtgtactacatcgtacccacctatcaacttgttatactgtgggtataatttacacttcttaaaaagttataaaaatgaggagcactcatacaaagataggactgcgaatgctcaccatatttttttatgaatgctcccaataaaaaatatattgtcatattaaattttaaataaaaattttattttattacatttgttttatttttaagatttatgtcaaaattttccgcactaattatttagtctcattttctacctaaaatgcatatattgtgcactcaaacaaaatttacaatagttttcaaggtcatatttaaacctaaatcatcaagcacattaaaagatatttgccaccaacttaattggtgaaatgaaggaaaatgtgacggcaggggcatggaagggatcaagttaaaaattcatgagtatagaagggatcaggtaaatttgagtggtataaaagagattgcgtgagttttcaagggtatacagaaaatttactcttcagatttagatgatctctcttttggtagatgatctctcttttggtatctcgtcaccttgtctgccctgggctgggctggtcacttcatcatcacaatctctatcgcctcctaaaaggcaatcctttagacttcgtctctgagcgaagatttatctcctcggcacatcatggacctttgtgcgttttttaacctcaatattttcatcttactagcatcacgtgaatacggatgaatggtttatagcgttcaatatattttaaccccaatggttttattggtggtcaatttttacgtagaagcactagttcttttgtgtgtgtgtttttatatagagatgtgttcggcactcccttttcccaacactcctctctcgttttccgcacgcacgcttttcaaactaataaacggtgcgtttttagcaaaaaaaattctatacgaaagttgcttaaaaaaataaattaatctatttttttaaaaaaatatagctaatacttaattaatcacgcactaacgaaccactccgttttccgtgcgcacttatagtgctgggaacgaggggcgccgaacacagccaccaaagtgtagcagagatagacacgatctttgatgaaccttaaaccgccagcatagaaaggactgataattcccaaacaaacttctcattacaaaagtgggggaaaagaaggaaaaagaaaaggtgcataagaataaacgattcctcgagcagactgaaatcatagaaaagacatcaaagaggacagaaccacatacataggtactatgcagatttaaatttgttgataatccttgcagataacacaatgcacagttctactcaagtcaactgacagtgaaagcatgttaatataaaaagtggatctcctatgatccttatcttcacttcagttcacagctaatccccctagttaacaagtctatgcgaaaccactcttatgcatcaacaaggtatctacagtccaaataatgcatggctcctcgccgccacatcaccctcagttgaagcagttaacccagaagacggcgaggatttcatagagtggatcggctgttgttggtgacccgcattggaagcatgcttaatcatcacactctctgctgatttggggtcactggagagaccagatggaccaaccgcggtcttggtcttcttggcccggcgcttgggcggtggcgctggcagcatttcatgggaagaattgctgccgctcatcaagctctttctgtgcaaagagcagaaatccatgccccattttgcactcgtggcacatccttgaaacttgcagcgcctgccgccaccatgtttgatgcagtaatcactccgcccttgtgcactcttaccacatccttcaaacttgcagcgtcttcccccaccatgtccaatgcaaaagtctgtgttcccttgggcacccttcacacaaccatcaaacctgcacctccttccaccaccatgccttacacagcggtcagtgaggccttgactgctgccacatgctgcattggggcatccagtgacagcgcagcgcttgcctccgccatgagcaatgcataaaggtgtgcccccatgtgcaccctttgtacaaccttgaaccatgcagccctttgaaccgccgcggtgaatcttacagtacattgcatttccctgggctcgcttgctgcaaccctggtacttgcacatcacaacatcaccatcaggattatagattcctgcactacccagatcattcccagcattttgggttactctgaacccactctctccttcgtacttgattgaaatttctgatttggagcaagctactgtactggaaccaggttcaccaagcgggcgacctccaccatgggacatacataatactgagccatctggtacaatatgagggcagccaagcatttggcatcgttgccctatactgtgacttttacagagcaatgtctggccttcaacaacattgttacacccaagtctctggcatcgttgtccaactgcttaataagaacaaaaaaacaaaaacccaagaaagatgtatgcattagacaaatattgaaacatattcaaatttatccaagaactaaagcttctccacacttatttctcagtcaactacattatggttaataggtaaactccagaaaggcatttaaatgggaaaaatcattgttacactatgttcccaacagactgtttaccatgtctacttctacattcagcaatgccaccagccgttgggtatcaactactgttcatcatggtcaaatagactttatctgtactcctttaaaagaaggcaatggaagtagtagcagttcatttgtcatccaaacaactatgcacaacattgatttacgaaatacttcttgaagttcttcaatattatacaatatccctaaaatatattcttctttgttatgttgtcctactaaggcatatggtgaccaaacagtcacatttatatgtagcatgaaagctaattttacaaatacagtatagcaaaaactgtcaagcactctgtaacaaaagcatgaaaggcgtaacagaaagaacttattcataaatttcaaacaatattaccatatctactattcatttttacccataataaacatccaggctttagccagtctttaaagaagtgcatacatggtacggaaaggtaggttccaaaaaaaaacataccaacagaacgaccatcagatgcacacatctgtagacaaaaggataaaggaagtgtcagaaaaagcttgctagactagacagcagaaaactgggagaggatagcttacatttaactgaatcatattgccacgctccccaaaaatgtggtgtttatcagcatccatgcctagaaaaagtacatggtcaggtctaccatatagatcagcttataatataagaaagttgtgaaaatggttgtgcagaatataccatgttgaaaagaatccatgaaatacacctgcatggagcatttaacaaattaaattaacaaaaaaggtaatcttaagaattaattaaattatttgtagactattcaaataataccctttgctgagaaaggatcaatatgtccaatcattaatatttgttgccataaatactaaaatactaaataccgtaaggatacagattgaaagaacattagtcaaaactcaaaaacataaacttcggtttgcatgccacaagtaaataacattttcctctaacctttaaggctatgacttgctgggctgtaaaatcagaaaaaagggggggagcagacattcccgtcatatcatctgaaacaggaggttacactccacttattcctcactataatcaaacacagatgtctgtattttaagctccaatgtagtcatcaaatgttggcagctcattaaatctagagaaagagtccgatataaccctctatgacagttctggagacagtttcaccaacgtggcaatctacatggaggatgacatggtgccagtcctgttccttatctatattactctctcttacagtgcagctccacctatcatttctttcacttacccactcctctcattttatccttaaccccatcgttcttaccctcagcaatcccccgttctacatcatctacctgtcacgtgaatcggttgctgtagtaagataggtgtggtggcagcagcttgagctcaatctgcggccagggctggatgagctgagttctagcacaggcagccaagctccgatgacccaatctcaggcggcagctggatgagatcaacaacagattgtaggagctcgagatgaaatggtagcaaccgaggttcagcttcccgatctccagcggcagtgtacgagactagcttgagctatagtggcgattctcttgttgccatagtggcactgtttgctagggttacagatcataagaatcgatttttacaagtttggtgacatagaaagaacccaagtgaggtcactgctactctctaatactccctccattcacaattgatcatcatattaggtatgcgcagcaataccaagggagaaataaatcacacaacagcagcgtggatcaaggagactgccgcagtgccggttcggcttccgcgtgtggtgcatggagctagaccaaccagaatcacggagggatttaactaatacggcaataatcactcttcattaaatctatgcatgcatgctaagcagtaaatctcaggagactctctcgcaatttaatccatacacgcatgcagcaataaaaaaaaaaggaaatctgctggctcaagacgttaggcgacgatcaaatatggatatttctgttttggtaatatgacaatcaattgtgaacggagggagtaccacccaaagttacaaatgtttaggaatacaccattgccgtcaactttaaggtcctggacattaactttctgctattcaaggcaacatttaacaagaagccgaattcatgtctaacgtagtaacattactaaaataaaattgttctagcacaatcagacctgcaaatcctctaaacgtgcacagtgatctagttccctatctatcttctccacgagctagctattcagggccaaaacgtacggattcatgctcaagattaatgattctttttactttacattcgtgctgcaggtatgtatgtaatctagtactaatcttgaacacatgtatatcacagtggagactaatgaaacaaatctctgctgcatgacatgaccacaccaaattacacagaccgtgtaattcaacacggtgaacagctcaagtttcagatccacggaaatgtagagctaaaagcacacattaagaaggcaatttgattaactataatcatgtaccacaggaaggaggagaattaaaaggggggaaaggcgttcgctgaccttggcactccggttgcactccgaccgatgctcgatgaggtacctgcggaggcggtaggcagcaccggctttcgtcctgctcccctcctggtggcgcgtcgatcgacggcggtagaggggaggggattgggggggagagaaacccactgttggggagggttggagcggcggtggcggcgggggagaagagccgccggcgctagggttagaggtggcctgggtaggagggcgaatcgggcgcgtgggtggtgcggatcgatcgatcgatcgatcgcacgaggcggcggggaggggatgggaggggatcggaggggggaaggggaggatggatgaacttggcaagtttggactttggtagagaagaaaggttctgtgcagcatgtattttagtacaactagggtttattttagtacaactagctagggtgctcactatcactggattgccagtggctggcagcattgctaatttgttgggtgggcatagtatttaggaaaaataaatctgtatctatgtcgtacatcatccgtttaaaagtatctctagaaagtttattcttttttacggaggaagtagatcattctcagagcatatagggcttatcggattcatggtgcgtgtcatacttatatatatataattaataaaatatacatgtaagtgagaaataaaatataattaattttaaagtgagtgagagatcgaagaaaaattatacatgtattcaataattattttctttaatggcagtgtgacaagtagttgttatttgtatgatttttttttgcatgctatgtaataaaataatccatcgcttttcattttgtgttattgtctctttccctagttggttgtcattatggacaagaaaatgggaagtaggcaatgacgtctggtagccccgaagcaatgccaaagccatcgttccaggtccgtggtgcgaggcattgccattgccaaaatctactcgcgaacactattgtcgtcgtcagatccacccgcgaatgccactgccatcggatgcatctacgagcgatgccactgccatcgttgtggatccatcatgcaagacaccgcggcatactcttcctgtgatgcaagtgtcgctaccattgtcagatccacccttaagtgtcactattgtcggtgctccgccagctgccaggaccacgacttcgaggtcaatttggcctgtggaggagttgatctgagtgccaaggagctcgatttgggcaaataaaaattgatacaactgaaaaaatgatggtagacgacaccacagaggaagggacgaggagcgatggcaaggagagagtgacaacagtagaaaaggaagcgattcgaggaagactggaagaggaaatgggaaaagggatgaacgcttgggcttctgcgattttttttttgctagtgaggcccattataaagtgagagaatcccttatataccactagaatttgaccagttcccttatatgccacttaaaattggcttctcccttatatgccactagtttaagtttttccacctttttatgccactcccatcacaatagtgttagttgacctttagtcaaaggttagtttttttcgtaaatgaccaatatgccctctcaactaaaaaatgtgtaaacttcaaaaaatcataactaatttattttaaatcctttttgagtgaacaaaattttgtcagaaccagtgaaaaatgctctttatattaaaaatattgttagaaaactgcatgtttcatgcttacattgaaaatttatttgtgatggtaatggctaaaattgcatgtgatgcagaaaaaaatcaattttcatatgttgtatccaatagctatattagtactaaaatgcctattattggttgtatactaattcttaagggaaaatgcatctttgtacaatgaagttaacggtcaactgacggtggactgacggcaatggcataaaagggaggagaaacttgaaccggtggcataaaagggagaagccaatttaaagtggcatataagggagccggttaatttagagtggcatataagggattctctcttataaagtccatctaggccttaagcattgtggtaatagaaacagctaaagtttactcacacacatgccctacctataaaagaccacttcatctatatacattgccaatgcccttagggttttagatagtctacaattcgtcgtcttccatatgtagacttgggtctattttctaatatggtgtttttttttcaaactctttctcaatcgttacttcatctgtgactatgtgaggttctcgataaagatctagaatggcttgtctcctgggttgttgaacatcttcacctagactgttagactccaattttattgttcgactcaagctttattctgttcactttcacttcaacaaagattaatcatcaacaacacgtgacttctcttatggactcaatcgatctgtctgcattcagccaagcatttgctccttcaccattgcgtcggtccttcagcaccatgcctctccttattcttctccaatgcatggtcctttgtttaatcaagtcttgccaacccttcaccccattttaccatctttagtcacatgtttccctatatcacaatgaaacttggttaaattccatcttcatcttcagtgccatcattggaccaatctcctacttattccttcaataagtgcattagtcccttaattgtttgtcatcaattagctaaaactcattaggggcctagatgctctttcagttatcactgacacctcgtctttcaggtaggttgcttcttgatgaggaagtaggatcccgatcttccgataggtattgataagtcgattatggaacttgaagttgatgatccaaaggctcagatcatgacaaccgaaccctcgaaatcactacaccactcatccattggttattaatcaagccgaaacatgattgaccttgtcgataaggctatctcctgcaagtgaatcgagaacacaagcaagagagtagaagaagcaatctgaactattattaatatatgatgaagctcacaaattgatgttccacaaactgaactaagcggtggaactacaacaacagaatctaagcaaaacccaactctaaacaatgacgactattaaataaataggattagggacgtactagggttagccctaggatacacaccccctatttaacttaacctatgacacaattataaagcccaaggcctaaatcaaactcggactagatgaggtacatgacttgtgttgcatattcccaacaacttgatatgaattttgatgtgagaccaaaaccatctgaaattaaactctataattttccccacaagtactcatgggccctgagagtcctttgggatcaatagctaagcccatttgaagttaatacaatcagaaggcctgaatccaaatccaaaacatgtaaaactgcatcttttgccttttatggaccaaaagtgacgtggtgatttgggactagacttggagaagatcttggtttggtccccaatcaatttctttgatcatccaagcacttcgtgagcatgttctcctttccttcacccatgcaagtatttatggaaacaagaagatacaaaactcatggtgtagtaatgtttgtttttttatggaaaacaacatgagaggttcctactgcgatcgtttgttaaaacatataataagtaaacctaatatagaacatatgcactttttacttgttaatatgtaacataagtatggttatatttgaaacagtgatgtcctcatcacctctagtcatttctagatgactttggagtagttagacttatatctttactgcaaacacctgattgttcggtcatgagtaggccaaatacaaagttgctaagtttggattcctgtggctagctatagatcaactttaccctaatgaaatatgagtcaagttatcatgtcgttaactagttgctcaaccataaaacttgttaggggtacgccagtagcaatcacaaagtaaaactagtcaatttctttttttttgcggggaaaaaagtgtattactcattcaaaacgtcctcacagactagctgtgaaatgaaattacaacttccttccggccaaagcccagaaattgaatcggccctagccctattagctaaaaggtggctaacaccgttttggctacgatggatcttggtaaccaacacttccctacgctctgataacaggcgtttaatctctggactaaattagctaattcagacagatccgtattcccttccttcagaagattgactagcgaaacacaatctgtttcaatcaagatagggcgcatagtccactgtagggccaaaatcaatccctccatgcaagctcggatttctgcctccagggcattcttgtagctatccagggacttacatgctgcaaaaactatactatcactgttgtcccgtagaatcataacgatacctcccttcccacaatcagcatcaaatgagccatctacattgagtttcatccagcccagcctcggcttctcccagtgcaaatgggtcgatgcagcaggaggaccatctggtcctcttcttctaagcgcacttataacagatctgctaacaacagttttacctttttccagatcagcgtgggggcattccctgatttggaatagagtagcaatataactttccaggaatcttttggagacttccagcggaggaggcggcttattatgtgtgatttcattacgcacataccagtttcgccagagagttaataaaaacatctcatgttcttcggttggtagatattccaaacaatcaaacagccagtaattgccgaattggaaattcaccaaatcaagcgacaagttacctgattgtaccatatccgacaacaaggcactggctcggggacatttgcagagagcgtgcacagaattctccacctctcggttgcagatgatacagatatcagagtttaccaacttccttttccttttgttgtccatggtagctaaacaattggaggccactttccaggcaaagattttatcttctgtgggagcttacacttccaaattaaatcccaggatttgcgggaatgcaaagcagaggaacttgaggatccttcagtatttgccagcctacaggcaagattataagcactccggactgagaaccgcccagacttgtcagggtgccaagctagaaagtcttcttcttgggctgcag

SEQ ID NO: 68763 - DNA, 524 bp, Oryza sativa
agggaagagaagagaagagaggagaggaaggatggatcaagtggtggtctaggccaggtgcacaaatgggcggctgtggaggagaaaggagacgaagtggtgtcgctcaagccttattgaggacagaaccattgcccatggtagaaaacttaactatttgccattttttcgtttggcaattatccaagtacttctcttaagtttacacatactaatttaccattggagagagaagaaatcttaattttataccattttttgtccacgtagcagaataatccgattgccagcatggatgatggatggtgtgaattatcaattttgccctcaagtggaccccacgtgtcagcctcttccctcatcctccatctcttttctctctctgtttactgcctgcgcggtcgccaaatccaccgccccattatcagccttggatgccgccgccaccatgtatatcagtgactccctgcgctgctgcacagccccgccagcccacgcacacaagaaacctcacggaaagcaaa

SEQ ID NO: 68764 - DNA, 1020 bp, Oryza sativa
tctgtttactactttggaattatcgtttttagagtttcgaattagctgattactgcaagtacagttccccgctgtgtttttgtttgagattctgaactgcaaactgatctaggatcgagaaatgttggtgtatttagagatttaaggggggcgactgatgtgtcaccatttagaaaatcaattatgcatttcctaattgtcatggctgcatgctgtcaagttaaatttgagataactgctgaagattacagaaggcctagaattctattaccccattcatagagtagctgtgattctgacaatacaatgcacagcaggtatttagaaaggaaactgttactacatggttgttaacagcaagcagctattattgatctgataaggaatgaagttctacagtatttttgacgcgacgtattagcatcagttttgctcaagattcacttactgttgcgtgcaactaatgtccaaatttcacatcaggtactaaagatcatatctcttcaaactggttaggaagcttacttaatgaagacacaattggattgattttagtggccaaacccaagccaacatacagactgtgcgcatatggctactcgcattcctggtactgtagcagctagcggggtgtactacaatgatcaatacagaatgccatgtaagctgaaaggaattcattgcatggcattgaattgtataccgcaaaaagcgaaggtaaggaagtgcatgaatggatatcaatcaacattcaggttttgtgtaaatgagaaaaatggacaaaccaccgggcagtcaaatggttccttgatccaacaaggccagaatttccggtgtcattcttatggttctcataacagcagtgaaactaaagagtgcagccttgaagatggcactgattcatacaggtaatatttgtactacattacaggataatgagcctactttttccccagatgaccaatgtttattgaatttgtgtatctggacatgcaaattcattatcatcctaattcctat

SEQ ID NO: 68765 - DNA, 13358 bp, Oryza sativa
aagttgatcccaggaaatgtggaaaaataagcatttctagctccaaaagtcgctatattttgggacggaggtagtagtagcttatttgccggattgctgtcatggattattgctccacggctctaaaaatacggcttctcaacaaaaaaaaaacatctaccgcgttgcttagaccaattgttctaagctatctgttaagtttatttctcaaagtatttaacttatccctatcatcaagtagataatctaaggcaataatctgtttcaaatgccacatcaacctaggttagtgcatgcatgaattttgtaacaagctttttgtgtttttagattagctatttgacttatttctattcgcgacttgttctgtttaattttctccaaagcaacacattggtgcacttggatccaccatttgtgaagaaatgcataaatttacatagatgataggtagcgcttagggtaaatcccaaatgcaatacatataaagcaacactcgtggatgtgttatccattccgaagctcatgataatatggtgcctacatcagaaaattagcaacagaacaaattcataaaatttccatccaacaacaaaatgatggcacaaagcccattgctttgatctgcagctcaatttctctgccgagtaaactaacacatctcactgatatgtggtatataagctacagcctcaaactaaactagccagtattagcatgcatgccattattattaatcagtggcggagctgttgggggtgccggagggtgccaacacacccctatctgaacccctcctccctgttgttgtatgattgtacttacaaggtcaggcagttagcaagtctaaaaaaacattagcccattagcaagaaacaatatctacaaaattagttagtgatttcccttttttttcaaagtaaaatagaagatgcctatttacattgaaaggatttagcattaagaactagttccaaacttccaattatattattaaagagctaaaattcaagttttttttgtaaagaactagtttacacatttattgttattgacagtgactatttggcctcctttgctatcgatattggttattcggccttatggcttatccctaccccacaccccccaaccccaaatcctggcttcgccacttataaatcacatgggacatgataaataacatcctctcgaatgcatagccatgctgaattgagcaaggagaagctatatgtatatgggaacaatttcaacaatgcagtatgaaatctgccacgtgcaagacctgaaacatgtgagcatacctttgctcccgtcgatttattgcgggcgactctgaccctggaccgctcgtcgctggccggttctgttgcttgatcgaaggtatcatcggaactgacttcccgggcgtgtatcggttcgtcaacgacggtggtcggctcaccggagcctgatccgaaaggtaacgacctatctaaaatgcacagaatacacgccaccacttagcgcgccgagcaccatgcccactattggttggtgaacacaagtaacaaataatcacatcaaacacatcacccgcataaacaatgcgaaatgcgtgatgtaaaatcataaatcagccggcatattccattaattaggagatcgtgaatgagtattagattattaggaagacgggattgacgattgaatgccgctgccgagtgatggaagtgaaaatggggatggattgaggttaccgatggggaaggggagcgggtgccggtgcgccgcggggtggaggagagctcgatgggtggccccgagagctcgtactcgtcgtcgtcgctgccgctgcccccatccccaccaccacccacgccgccgcctcctcctcctacccccgcgccgtcggtggacgccatgacccgcgcgagccgttgcgccgcggccctcgccgcggtattatgcgcgcggccacgtcgccccacggtggacgccgcccccgcgccacccagcgaccccgtccgcgcgtggcggtgcacgggcgacgccgtcggagatccacccggcggcgacgtctgcgccgatccaccgccaccgcccccgtagtagtggtgcccgtacccgccgccgctgccccggcgagcgtacccgcccgcggggctcgccggccgcgacaagcgatccatgggaacacggcgtcgcgggtgatcgatcgatcgatccccctcctcgattcgtcgcgagagggagagagagagagaggtggaggtggaagcggaggaatgggaggtggtggtggtttgtgtttgcgtccgaaggcggaggcggaggcgggggggacgtaacggtctcgagtttcgagggggggagtgatctcgagtggcgtgggggtggatcttgtgtggcgcgggtcgcctgtggctacaccggttagacgtgtacttctatacacttgggttctttttcttacatatagtggtaagcagtggcggatctagagggtggtccggttgaattatggaccataaaataaaaataatctaacacaggactagtacatgttaataaaaggaaaaaaaaatttaaagtgagaaaaataagagatataaaatctttattaatataaacttttatagtgagaaaattaagagatataaactctttattaatatattatggtacactttaaattatgtggcctattgtatattatcttattatatttatctgtgtttaaaaaagttacgtaagataggtcatccatatctaaaatcctgggtatatcacttgtgatagagtgctgcatattcatccaagggggaaaaaatagtgtggctatctcatatcaactggaggaaaaatttctaactgaaatgtaccatgtaatcattagtgaactcaaaacctaatgatactatatagccatcgaccaagcttgtcgatatactgtagtgaattgggcattatatgttttgttaatatttaaagtagtgaatgaagcctcgactatatattattcactgtattggaacattataacgtattcatgtaactatagtgcatctatgtgatactttaaaggatctagaaatctcttcagaatgtaccatgttacattcttgatgtatgtgttgcttgttatactggtacaatcagtgtcagtcaacctcgacaatttttgacaaaacttagtactgaactacttaaacgataaaataacactataaatttaagcataatcaccttattatgacaccgacattgaatccaccactacaggaagagaacaggaaatagaagagagtgccgagttctgtactaaaaataaatgataatgtattcttatcctacaagttgtatgggtcccaaagcacttgaatagaactagagaggaaagtatgtatgggtaatgcttgaaacttggtgcaaattgttttggtagaatccatgaaccatatattaacgaaagggcatatagtctagtggttacagtgacctgagtagtaccccaaggtcctgagttcaaatctcctatggagcgaatttcagattgggttgtttgcggggctaagttccctatttcaatggccgtatatatccggttggatatagaggccgggtaaaaaaaatacccttctctaaaaaaaatgaacatatattatggtactaacacattatattggaccaaagacaaacttggcactagtatagacatacttgtaatctagcttaaatatacctaacttcccttcctctcctaaagagaactggcctggccatgccataacattattggcttcattaatcaaatcatacaaaaacaatttacaaccatttagaacaaacgtgtttggcatttggcatgtctaagtccagctatttcttccaaacgcaggaataacaaaccatacaaaattataaagcacgagtacacatgaaacttgcataaaatggaattgcatcaacggttgaaactacaagaacaaactttaccattccttatgaaaactgtggcaccttcatttaaatttaacaaagagggagtactttctacaaatccaatacaatgcatttgtttatcctctacaaacaacatgtaaatttacagatgaattatacacttggaataatggcttccaatatgaacctataccagcttaaatacgtcgttctacacaaactatctgcacaagatatgacaacagtacacaaatgtatcctggaacaaaattgagtggtctctgaaaatttacagaaatgcttgcaccttctgaacctcaaactcagctatgttcagcctcagtcacagtgcccagttgagatccatggatgctccgctccactggcgaaccaggcacgaaaggaacgaagcctcggcccccgaacatcgggcgcatgaatctatcatcaaacttgcgccacacgcgatgaacggagcgagtctgaatggtgagaagaagctgaaggttgttctgaggggagggctggcctacatcgaagtcagaccccagcaggcttccaagaagtgggtctatgattgactggcttgagagatcagctgctatgtcaggccttggtgggatgaggagattgaggagaggcttggtaaaaaaaccaaaaacctgaaacaaatattgatggtgtatacattagcaaagtgataataattggactactttctttgtacacgatggaaacggaaatgtatgatatcacttcttttctagattaaacaggatcatatacattgataatccccgtatggctgcattgttcatgggtatttcacttaatctgtaagcgtcatataaagaaatgataaatactgcattagatttgtttacgctcatataatcacatgtcccctattgacttggctgaaccaaatatagcacacacaaacaaaagtgcacaaatctatcaacagattgctagaaatacacctgctgagcagaaaataaccatccaagataataacagagagaaagcattacatccttaccattgtgctgaacagaacaacaatgactgtgctggtgatcatgatagcattgattcgcaattcagtatgaccagatgcggtgaactgcaaagttttacgagaacgttacatatcagactaggttttagtaaattaatgtggtagtggttccaaatcactttcagagaggcaggttaaccatcaaacatcaccttgtgataggcaagtgctattgatactgctcctctcatgagacctgcccaccatatgattacctagagaataaacccatcacagttagctgcttagctccctctgttttcaggagggaaagaaagtgatacaactacataagaataaaaaaggtcaatactaacttgctgcttgaaggagatctttgggcgtgtctcttttttacttagattggataagaaagacaaagggaatacaaatgctgctcttccaaccataaccaagcccaatatagttgcacttaaagcaattggttttttaggactgcatcataaggaaaactgatataaattagttattatgttcagaaaaaaaaaacatgggcaagacatgcaaggtagttgctgttgtgtgagcctgtgtttaacagtgtgcaccatgccaaacaacaattaatagaatcatagaagcttgaagatgttctttgcagacttctccaaactgaaaaggaagggttccgactttctctcatcaacaacatatcacctcacatagaatatacttttgtcagctgacaggaccatcagtctaagaaggagctaagcaaattacagcatccctagtgatggaaaaattgaaccatagaggcaattgttcaaggcattaccaccggggacttgaaccaggaggcagacaaaaaagcaaaactagttcttttgtttgaaccaaaccgaaaaaaagatacttgctcgtggtttccaacatatgaaaggagcaggtgcggtcctttggcagacaggagagaatggatgaaagaacacgatcatttgtttttattctggccatggatcccaccaatgaataacacgctacaccagtggatgcaaaccaaaccatcggataatgaaaatatcagaagaaactttatgaattggtcgtggacaaaaacacacctgctgctagctaatttccatttttcaatgtccagtgcatccatcccaacatagagaaatagaaaaatttcagcaatgaaagataaagtagcaaaagtgtgcctgtaaaatgaatgaagaatatcaggaagccatatacataaatattttcatctaaaagaaaccacaagggttgccagtaaaactgattatcagacagtacatacttggtagtaatcctagagctttctgtcacattatgccaagtgtaatgtgacattactattccagagaagaacacagtgagaatgccactcagatctagcagctgaaatatatatatatgaaagggtcaaaaaaaatatcaatatcatgtactttggaagatgctggtgcaaagtgagattaaagaaattacagactgccaaaagaagtacaagagtaaaacatcaacaaatttacacttagtattacatggatataacatgatactccctccatcgcaaaatataagcatttttggatttcgacacagtctttgatatgctactttgaccaaaaatatctatataaaagtaaaatgttttaaataaagagagttgtatattatgatagcttgtttaatgataaatctagtaacatcaattttacgggattgatcttttttttttgctattaatagtcaaagttaaaaatatttgacttagcactaaaaatgcttatattttgggacggaggaagtaattgataaatgtccgaaataatttgacttaagagagttgcttattttgaagttcttatagtttgtaggcactcaccatcgacagcatatatgaaaggtacgccatgagtatcatgatagcaacttctctgtcagttgagtgtctgcataacatcacaagcttgccacaatgattttcatatctacataaaaaacaaactactctgtggcatgactaaatcacataggagcagacctggcaaaacatagtttcttaataatataggcactaagcaacccagcctgccaaagtgagtaccagtaattagtccaaaaaggcatggtcaaatgaatcatcagaaaggaaggtagtaaatggaaaagaaaaggaaagatcagtggaggttgtcaaaaacaaagagacttacaactactccaagaagggtactggtgaagaataggtagagaaaatttcctatgaacgctagtagaacaaggctatcaaaattagcaatatcaatgtcttcaattgcattaaagagcacaacagatgtagcatcattgacaaccccttcaccaaaaaccagactatagagtaggggtgtttcgtcttggttaagcacctgcaagtaacaaaattgcatatttaatggtgtgctgtttcattttacaagacattaacaacaggtcattaaatggaaaaacctgtaaggtgcaaacagaatctgttgctgagaagatagccccaattgctgcatatatggattaaacaaaaagataaacagcgagcagaatgatgatgtattcaatggtaccaaagtccaaccagtcgcttcaataattttgaagtgtagaaaggccaagaataaagtatctaaccaagatagtccccaagctggagtggaccaacatcaagttttttgaacaatgtcatggcacctgatatgtccattagaaaaaaggaaaatcttagcggccagagcaacatatcaaagtttgaggatgcaaggtttgagactttgaacaaatcatgtttgtaccattgagtaatgaatacaataaggcaaacaaccgtgcatctaacatacatacttttacatccagctccacaactgaaaaaaactatccagctggcttctccgtactgaattatggattttcatgcatcatgtagccacttcatatagaagcgattggctcattactgattcttttactctcttaaaccagtgtttaatttatcttaatctcaaagaaatcagtcacacatacttgaaagttgaaatgatgatatttggtttcaggtgttaaacaccaagattttgtattttggtgtaggtgttcatatagttggttatcttgtgatcattaatatggaaccaaaataagatgatgtaagctgagcaaagaattcagcaacttacctagagagattatcacaaaggatatcaatgtccccacagcaccaaataaaataattgtcataaaattgcggaagaattgttttttctttacttgaaacctgatgattataaacaaagatgcatttcagttaaaagcttcacttatataaaatgtaagtaacttcaggctatcactttgatgttagggtcaaatgttttagcgagaactgaaaatacatgtatttctgcacaaaaatataatgctggagcttaaaatgttattagctaatccaaagaaatacacaggaaattcatattaatcaattcagttactgcaggaatgcatgcaatttcctaggttcgaaacagggcagagtaaggatgctgattctctataaagactatatatatacttgcacagtcaggaaaaataatctaaatgactcacaagcttactcacgttcagtaagaatgtaagaatgattagacatacttggatccaatcatcaccaagtcctctaattgtaaaagggcttcatgtactactgtgatacaatcctttttaagtctgtatttcagggggggaaataattgtttgggacagacgtgatagtttaattcatttttcagtataatttcatgggaatgggtgggcagttgactattttatacatccagctcaataagtgtaccttagcattcacaaatcacataggttttgaggaagtcttagaaacatgggtttgatacatccagaggaatctaagtaatattttatacagaatggcaataataatatcatcatatgcatacttcagaaatacatgaatttctcaagtgagtcctattgcggtgcattttgctctcaagattaaattagccaaaaccaaattaaactaagacaaggcaccttcttttcttgtacagaagaacaacaaaataaattccgctttggttgggagctcactagaagagctataggtacacagaaagctcacccagcattaaagatgatcggtggaagcaaataaatgaagaagaggtcctcactgaacacaagaatgtgcgagttcttcccaccactgacgagcagaatcacacctccagtgatcagcccctgcaagcgccaacccacagaacaaaactcaaaaccactcccctgtaaggcaaaaccacaaacacctggggtgcaaggccagagagccctctcatctcaccatgacaagcgcggtgatggattcattgacccaccggttcccttccagcaggtgcccgatcacaatgcagctgcacagcagcgccacgaagatgttgatcgcgacgatcgagtcgtagtccgacaccaacagcccgccggatttgagaacgagagctcccaaatccagccccatctcgaccgccgccacctcagtggatcctcctcagctcaccctggcagaatggaaacgaacaattctcaatgttaaaaattggatcatttgctcggtgcaagcaagcagatcgatctccatgattgcctgaacactgtagccgtcaacaaattcagagaaaccgcaaagcaacagcaaatcactcccggcttaatcattccacaacccaaatcaacaaaccagtgaccagtaggatgaaagatgatccgagctacatattctcactgaattcctcaattccgactccaaatccaaatccgacccaagaagccaccatgccgccacctctcctctcaagaaaaggatgtgcacaaaataaaagtaaaaacaaaaatcgaaattccgcacgcacctgcagattcaagcgagatggccaccctgatctgaagcaggagagaggatggaaccaacaaaaaaaaatctggattcagagagagagacgtgagaagaagaagtagaggaggaggtggtggactggtggtcgtgtccatctggccatgaggccgtgagaaacggaggggaattaattaacgaaaatcgcgccacctgtcaaacggtcaaacgggccccaccaggcagaggaagggaggagacccatgtggatgacgggtggggccctgaaccgggttggccccgcctgtcagtggctgtggctgggttgccgtcctgtggttttggttttggttttggtttaacctgaggggtgtgaggccgacgtggcacggggtgtgtgtggggcccacccggggatggagaccaataatattttttcttagataatggaatgaatggagaccaatatggggtattgggaagcaatgatggcgaatggatgggtgattagaggaaggataataatagagtccactttctactattattttattttaaagccaacatatataatagattggctataaggttggctgcaattttcttctcctctctctatctcttacttatgcatttaatggatttgtcttggagcttgtgataagctagctcttgcataagagccaacatacttaattttccactacctcttttcttcacctaagtatagtaagcttatagttcactattatacttgctcttagatcgttcggatgatgattcatgagtgtcgccctgtcgaagaggcaagatgaaatgaaaggagagaagggtatcgtgtatcatgtgtggtcgtcgtccactgctattaaagacaagaacagaatataacggtaaagttatacttccttcatcccctaatataaaaaatattccctatttttaaacgtttgaccacttattttattttaaaaaatttatacaatataaaaaataaaagttatacttcaagtactttgaataataaagtaaatcacaaataaaataaataataattctattttttttaataagacgaatagtcaaacagtgcaagtaaaatgtcaaaattacttatattaggggacggagggagtagagtagtacagacataggtggtgttcttttctccggaagatgaagatgaggttttttacgcaaaacgaggtggtattaacgtatgattgattgagttttaattattacaaacttaaaaaatagattaatatgatattttagagtaatttttatatagaaagttttcgcacaaaacacaccgtttagcagtttgaaaaagtgacacgaaagtcttaatattctttcaacttttattggagaaaagaacgggactataggactcccttcattctaaaattcgaacagggctgactgagttcgtttattcatgttccctatttccctctcttgtttgtcgcgtgtaatctctatagaaaaattatttttaaaaatcatattaatcctttaaaaagttttttaagctatacttaattaattatgtgctatgttgctccatttttcgtgattagggggtcaattcccaactccatgagacagacacagtcttagcatgattgaaacaaaggaaaaaccatatgaattatagaggattttatcctatgaaaaataatcctatagagttatttgaaataaaaaatgtttcctatcaatttcttaggaattcatgtggaatgaaccttacaagattaattttagaggaaaataagcatgatatcttacttcatgataatcaaacaacttttcgaaatcccataagaactccctaagtataacattctattcctacatttgttcctattgctgtgttttctcatccccacatttcaaaggagccataaactcttaaataatgttttgagttaatggtttgcttgtttgatctatcttaaatccatttttagggcccctttgaatcgtaggattgaaaaaacggaggaatgggaaaaacataggattctgataggaatgcaagtgtaaaacaaaggattgcaaaacacaagaaaaacacaggaatggccgtttgattggaccgcaggaaaaacgcaggattcaaacgagagagatagactcaagggaagttttccaagaggtcggagtggatgttaaatttcctacatttttcctctagaatcgtaggaaaggaaagtttcctacgtttttccttttatcattcctacaaatcaaaggcatgaatagtgtaggatttcaattcatttgtttttcctccatttatcctccaattcaaagggggccttaatagcattaactttcttttccaaaataagtatataaatccaaaaccatgaaaagaagtatatatttttttcaaattttattccaaaactacgttccaacaagcatgctccatacggctaggctatagagttgatagagagatgtggagggcccacgtgtcagggacacccaacgggattgtgtttttttttttttgagatagtgttgacagcgaaagagtgtggaatgaaattcttggctgtagatgagcctgtaggccccgccacggatgcgaggccaccagcggatgagcgccacgtgtccgctacaggcatgggcagcgcgaccagagaagtggacaggacaaggccgcatccgccatcctccattgattcatctcccttcctttgcttgagattcctcaacctctacatctctctcctccaatcccctcctctctctctatctctcttcccggcctgtgcagagacggaggcaggataggccggcgagcaaaggttcgagttctttcccctcggattccacaaagtaggtgtcttttttgtttaagaaaaatagaatcaccaagttgttgttctcgttgagttttggttgtattttgtcactcgagagcctctgcatgttccaaaagatggtgttttattggtggtgttttgatcatgctagatgtggaggatggacggatcagatattctgttgtttactcgctttgaaatttatgcttgttttagtattatgcatctttgggcaattatcgcatggatggatcatacatgccatttctttcggttcgaatgtcttcctgtttactactttggaattatcgtttttagagtttcgaattagctgattactgcaagtacagttccccgctgtgtttttgtttgtgattctgaactgcaaactgatctaggatcgagaaatgttggtgtatttagagatttaaggggggcgactgatgtgtcaccatttagaaaatcaattatgcatttcctaattgtcatggctgcatgctgtctagttaaatttgagataactgctgaagat

SEQ ID NO: 68766 - DNA, 5597 bp, Oryza sativa
acatcatacttcttaagactaacaggtttggaaccttccaagatttcttcctgcaaaaatgctaaagagaaaactgcatctagatcctggggtttttgcatcaaaaaagcagatctgatatcatcccttaacccttcaacaaatttagtgacaaaataattgagaggtagagcactactgtaagccaacagttggtgcataacactataaaacttctcaacatactcagacatagaagattcttgagacatatgaaactactgccgaataagaacttcctgtctatccttagtgaatctgagacaaacttgttcagcaaattctgaccaactgacgcctaccaacttagatcatacccattgaagccagaacgctacattactagtgaaattaagaccagctacccgcacccaattccgaggatgaacaccatacacctcaaaatattcttcataattactcttccagagttgtcggctgtcaccatcaaactgaggacaaagcataggtggaacactgcctcacaaactagttaatccaaccgaattcaccaaatttgcaggagtgtgatgcaagccatgagactcaggggaaaaatgggtgggaaacagaggaccagatttctgacataaagagtcgagatctggagaagtgtcatgtgaggatttctgaaccacagtttgcagcttctccactttctcctgtaactccaccaccgaatcctgaagaagatcagcatgcttctcgacttccggaagccaagattcaaccaccagcttgagagttccttctgccctgctctgctcttcagtttgttccctcttattctcacttgcctcatgtttcttctctgcttcctccatcttccgtaggagcagatccaacttgccatcttggtccatgatcttagctgcttgcttagtcacgtagtgaggcttctcgtagagtgttgtggtggaagatgcgctcgagatcttgcgaacctagtcgagggagccaaagctcttgtggaatccgttgccgagacaacgattcccacctcttccaggaggtttttactgcaaaatcacaagagcaagagtgagaaagggggagaattttcagtgaggctctgataccagattgttagctacctaacgagatttcaccgaagtatatagaacagatcaagaacataagaaatttcaccaatccgataggattggggctgccgccgccttcgccaccttaatcattgatactgaatattcagcgtttacagtatataactacctcaacacacttctctctctctctctctcatgcaatacaaatctgacctggaatggtgctcatttggcccattccggcccatacatcctgggattagcaacccagtttcgagcaggctggcccgctcctctagacgactcttctcctttgctctgtagttcatctggcattgtcaggttgctgatacttacgtcatttactattatcatactaaactcctgcaccaacacacgggtttaatacactattatacatcacttgccctgcaagtgtgttgtgctagctaattgttcatgaatatatgcgaacaaggtcaagtagtttgttaccaacatttggatctcaagctgccgttttctttatatattcatcactcataaaagtagatgactgagatgtgatgccaatgatcttaaaattttgataaatataatactccctccgttttcaaatatatatgctctgtttttaaatgattatttgtcttatttaaaaatttagtacaaatataaaaaatataaatcacatttagaatactttaaatgataagaacaaatcataacaaaacaaatgaaaattacatacttcccccattttcatattatttggtactcttttgttgaacttagactttgaagccgaccttttgacttatatgggttattagccggtgaaagtttgttgtgaagtcctacctccatgttaataaaaaaatcactccaaccttgacttgacaatataataatgacttatggttttaaaaaagccaaacgaaaatgccgagtgtttgtttaggcggcttaggctttttggcttataaaggtggcttaaaagctttaacaaaagagggccttagtcgttttagacataatcttaaagatcaagaagtcattgaacaaagtttctattttctactatgcccttgttaaactccagcaacaattgctctctgttggttcatgcatcttataacgattgctctctgttggttcatgcatcttacaacgattgctctctgttggtttatgcatcttactccgtatgagagtttgtagggcctgaatttgattcccactaggatgcacgtattatttattgtcctagcaactattcatgttagcatgcagctagcgcatccataggtcatacgaaaattaaaccagccaattttacttttctattcacaggttttgtagccgaaaaaagtttgtgcttatgcgcgcgctttgccgctaggaaattaaataaaaaaaatcgttagtgcttatgcacgcgtttttccactaatttgctgtgcaatttgtatacaaagcgttgatttgagaacaataacaccatttaatacgcaagagcaatatctgttccatatctgacaaaagaaaggttccaacgaagtttcccatccatagctgattgagctaaaacgactaataatatcaacatgaaggaagtaacttttataaataaaaaaaaaatcaaatatcatatctaaaagtaaaaaagcatcatatgtatatttaaaagtggaggtagtacattggtaggttaaatttgtacttccataggaaaacctccacgtttagttcccaaaaagtttttctcaaaaacatcacatcgaatctttaaacacatgcatggaacattaaatgtagattaaaagaaaaactaattgcacagttagagaggaaatcgcgagacgaatcttttgtgtctaattagtccatgattagccataagtgctacagtaatccacatgtgctaatggcggattaattagactcaaaaaattcgtctcgcggtttccaggcgagttataaaattagtttcttcattcgtgtccgaaaaccccttccgacatccggtcaaacatccgatgtaatacccaaaacttttcttttcgcgacctaaacaggcccagcttcctcaaagtcaaaacgatcaccaggtactgggtttctgacacctccgaatcaagaagcctcagcattcactgtcgtcagagcttgactcaccatcactgtcgtcaggcagctcccccgcgcggagaagaatgcacgggcggatgggagaggccagaaccctccgccggcggctagccggatagcactcctgctcatcagaaaccggcaaacggtgtgtgctcgcgccttccgagggagatccagttggcattgcgctccacggcttcatccctgcaccggcataccacggcgttgcacggcctgcgttgtacctgcagcgatccgggttgccaccacgatgtccgtgtgccagcagatagctgacacacccagggacccgaccgcgcttggctctgccatgaccattgcagaacggcggcagcatgatggtatcaatgttgtctgagaaccaaagaggcgacctgtttgttccacagcaatgctggaggtccaactcatttgtcctttgatctccaggttggcgagggtcacagcagcttcctccatcaacaccaaactgtgcattttcgcaggcagatgatcgcccgcctagatgtaaaaaagaaacagatgcacgagcatcagattctgacaactatgagaggattcaaaggctgccagtgaaagtaaaagtatcaggtaggtaaaattctccaccgcacaagctgtggataaacccatgcaacattactatacactgtttttattgagcctgtttgcagcagctgctacagcttctaaagcagctagctagcagtggctacagcaccaaacggctaggacgcattctagattgacagccgaacggctgggctgttcagatcagccctaacagctggaaaaacagactaccaaacagtctcattatcatagacaagtaaacgtctttctgtggcacacagaagtttctgctatctgcagcaacatgtcaccacccagttcatcaatgacttgtcaagattcagtgtgcaagtaatattaaaaatatagggtcaattaaatatatggcactggttttcaagagagtgtgttaacaatgtagacaataagaaaatgtttctcttgtgggttaatgagggatactaaaatttgcctttttactcccagagaagaggaagataactgagttacatatcatgaaagcttccatcggccatataactctaccagaaaaatatatgttatacacatgaaattgttcagtgacttcatgagaaaccaaatcagaagattcttcatgaggtacctttatagatggcataatacctctttttatggtaatatcaatctctttaccagcgccttcaactttatcagcagtcatttctttagcagcaacaactgtgtcaaacattcttgataggtcatgaatagaatttaaaagagacaagacaaataagcagaacatggtgttttctttaccatcttgaagaacacctgatgtatagacctgcaacgaatgcaaatatagaggttaagcagaaatcatttgcaaaatttatatagtacagataaccacgtcattacctcttcagagcactgacagatctagtcacacactcactgatcattcttaagaacatgggtaatcttgctatattaacattcttgaatgaaatgagtttctctcttttttgaggggaaacttgtaagtctttattcactcaacacagattggaaacatgctttttgtgcataaatagtatatgcaaataataaaataacaaactttgataaaaatatcaattgatgtatccaacattttccattagagtataactatatacatggtaattaaatagcaagcacttcaatatgcagataaatgtgaccaaaaggaagacagtttcccaattaacatgaaaataataaggaagaacggtaatcctgacatagaattaactccagagaccaacattacaagattacagtgaagggctacacagggttataacttaaaaggactgcttaatatatttgaaagatagaaattgcaccttcacacaattcaagaatgactctgcatcacaaggctgtgggaaacgtacagcaaacttctcaatctgtggacaaaataagagtaacaaatattttttggcatcggaactttgttcgtgaaggtaatcaaatggatagaaataacacataagaacaactgctacctattaggaagacttgtgatcatattataaacactgaaaaactgagcatgaagaggaaactggacatgttcgaataaggtaaaggtgctggcctgaactcatgacctctaccattacacgatcagagcacacgccatttcccacattgcaatagtgaaatcatgacactcaacaaattggtgagtagaatcaactttgacca

SEQ ID NO: 68767 - DNA, 26558 bp, Oryza sativa
ccgaggaaataaaaatttttgagtatcacatcggacgtttcatcggatgttggaagaggttttcggatacaaatgaaaaaactaattttagaactcgcggggaaaccgcgagacgaatcttttgagcctaattaagccgtcattagtacatgtaggttactgtagcatttatggctaatcacggactaattaggctcaaaagattcgtctcgcgatttccaccataactatgtaattagtttttttttatctatatttaatactccatgtaagtgtctaaagattcgatgtaatatttttggaaaaaaaaattttggaaactaaacaggccctttgtctaggagagacaaaaccttattcctctcctattcactcaaacttatgaacaatgtactctcctaatgtaattttgataaatactctagatctataaacttatttattgtagatggtatatttgataaaatttattctaatataaagctggtgatggtcgaggttttaccctttcatgagttgttcgtcgttttatcagtcgtataaaaaagatttttgaaacttacttttaaattgatctagatatttccccctaaaaaaattgatctatatattatttcattgttttcttcttcttttttccatccttgcatgttaaaccactaagagtaggtgaaagtttgcttaactgttcaatcaatccataatttaagggtttgaccaaatttcgttctaaatgtcaaatatttatgatgagagggagtttttggatcataaatatttggcatttatgttgtcttttaaatatggtgtttactattcgtcttattcaaatatgtaaaagtacaaggcacaccaaaagtatctttagtaataaacaagcggcaaaaaaaaaaggtactacctcaagaattatatggagtatgttcagattcgcagtacttccatccgattctacgttcttatttgacagatgtagtaattataatatggatggttaaatttatgcctaaagtcaaccatcaaagggtgtacatggagcattatgttggttcatcgcgttaaccaaggagtacatatggaaatttgggcaaaccaaaaggtactccctccgtttcagagtccctttgaaacacatgattgtcaaaagacgggaataggaaaaatatagaaatagattgtcatgttcattggattcctacagtagttgaaaacatagcaaagtttcaaaactatcgtttgatagtcacacatgaaaaaggtaggatttcaagacacaggaagaagaaaaaaacatgagctaagacatcatgctaattttcttccaaaaattctctacaatagtccattatgtacgaatttcaaaggaattggcaggaatcaatcctttgtttcaaaggatctcatatgattatttcctacaaggtatacatccttttgaattcctatcttttttcctttgtttcaaacggggtctcatattgtaagttattttgatttttttctaagttaaacttatttaagtttgaccaaatttatagaaaaatatagtagcaattttagtaaaaaaaacaaacatattataaaaatatattcaatgttagatttaatgaaattaatttggttttttagatgttgctaattctttttataaatttagttaactgcgaaaaaaggtcaaaacgacttatgatatgaaacggagccatatcatgttcacttcaaaaaacagcaatataatagagatagaagaaaggtgcttgtcgatggagggtccgtgcagaagcgcaaatatctgtcctctatgatttgctcatgtgtcgatgatgaaattcaggatgtgtcaacatttgtctcatgcatagcatgctctgcatccactgcattcagggttccagcctttcattatcagagatactacttccttatgaacctgtatctgaactttttgcgagatactatactactattaagatgacaaactgatctgatcggaataacatgggcacgacagctacagtatacataccattacagagtctttacgccacttgttcaaggaaaccttttcaaagtcaaaacagaaaagaaaaataaaaggtgaaatccttcttcgatcaccctgtttggaacttaaagggttgaaattttggatgcagcatttcacgtccagacgaatacggcccagcgtttcagaattcagagggttagttttctgcagcatatttaatttacctcagatattcaattgatgaaacaacatgaatcatgcatgtcaacacctgctgaccgctgagaacaaaaacaataacaataatgtattcgcactctaacacataagttattcctccatcttaattatttattttacagtgtggaaaacacatctatctcgtggccggcctcagcctggcactaacatactatttataagttgttggtaaatcctcctcctgacgaagaagaactaatactaatgtagtaataaccgagaagaagcaaaaaagatgcatggaaccttggatgcatggttccgattatttgcgtgaatgcgcaggcattgatcatccgatctgggttgggtccttcctaataactcaatggtacaatcatgccgcatgcatgcgtacgtggatattggcgattaatgatccgggaacggtacatccggggcggagaagacggtggcggtggcggtggcggccggcgacgacatcaccggcacgaacggggcggcgtacgcgcagagagccggcggcaggtcggaggctggtgcacgcgcgagcagtgggatctccggcggaatgaagtggtgcgtcgttggcagtggcggcgcggcggatcgacaacgacgtaggagtgggagtgggacgacggcggtggcggcgcgtgtgcgtggtggtgggaggtgttggtgcagctgtcggcgctggaggaggaggaggaggagtcgtggtgcgagtgcgaggccgcggtgcgggcgctgtcgagtccggtgagcctctgcacgatggacatgaagtcgcgtgggctcgtgcggatcaccttcggcgagtgcgtgtatataatcactggctgctgctgctgctgcttgtgttgctggcgcgacggcggccggtgagctgcggcggcggtggcggcattgttcttgttcttcgtcgtcgtcgtcagaccggaggcggaggaggtggaagagttggaggaggaggaggacgatgcggcggcgggtggctgcttgtggatgaggcgggagcccctgtggactttaaacggcggcgcggtgttggtggcggggaggggcaggcgtggcgaggtggggctcattgttgccggtgagcggccggcggtgagacgatcgacggatggaggcgccgaaggagaggggctatacgactataaacaggtgagtgaattgcgggatatttggttgggtcaaggtgcggtgcagagccataagcggcatgcgtgtagctcggacggacacctttgcttctcttctcctctcttggttgcgtcaccacggttgcgctagctcttgcatctgtgttgccatgtccaccagccacctgcaaaatgctactaatcgttttcggccccgtgggttttgcctaaacttttcattttgtacgtctaaagtatgtcgtataaactttatatgcgtaaacgaatcagtgtcctccaccttgacaaatcatggagcaaaatacaagcgaccagcaactatatacttagaaacggactcgtatagagttttggcccaacataattttatatggtgaaattttaaggttctccacaggtcttccatcctgggccccagggcgtggcctaggggtggaattttgaagtgctccaaatagtacatcgatacatcatatatagatggtgggaagattttaaaagtgacaatgaagtgtcaacagttttgtgttgggcatggcaccaagtttgagaatgcaaactattctaccgaatattgagaatgcgctatcattgaatggcatctccctgagacccaggtactgaatcgattgccttttgatggtgggagggtaaaattgtactcttgcatgtatggagcatgtacaaatgtagcgcccgttccgtcgtggcgcctagcgggaaaattatctcttaaaaaccctaattgtgaaatttgcttccttgcttgttgtctagcgtccgtgccatctcaagatctcaaatccctgatctatcgtcgagttcaattccgaatccaaatccttccaaatcgaatccctccgcaaaagtctattttgcctccccagggtcgatgggctgaatttctctcggcccatctccccctccctcccggcgctctctctctctctcttcccccgctccgcccgcgcgccgcgcgcgcgtgcgcgagagccgcgcccagcgcccctccctccgctccgcccgcgcgccgcgcgcgcatgcgcgagagctgtgccgtccgcgccgcccggccccgctgccctgccgcgcctgcagccgcgcagccgcccggccccgcaagccagcgcgcgtgcccgagccgcgccgctcaaatccgccgcgcctcccgttgcttcccgcgcgcgcgtgccgtggtggccgaccgcctggtcgccgccgtcgtcagcgcctgcccgcgcctgtcgcccgtgtcgccgctccgctccaaaccgtcccgccgtcatcaccgtcgtcatcgcctcggccccgcctctccgcgcgcaagccgccaagggacggaggcagagccctcctccctctgccgcgacgcccccgctcccctcctccttttcccaaagaagcaaggggcgagcccccctttctctccctctttttccccttttcctcccgccggcgtcatcctcctccctccgccctgtcgccgatttggacgcgagcgccgagcgccagctcgcgtcttgaccgcccaaagtcggttcccaaaccgacattgccgccctttaaagcccaggcgccctccctctcttctcctctcgttgtctcatcgcctccacgccattgccgccgcccccgtgctctgttcgccgtcgccgttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgccccgcccgcacggtagtgcctccctccgttcttcctcctcgctccatctcccccccttagttttcggtggtagcacgagtagcctccccgtagctagccggcgccgccccgaccgttgccgccgctcgccgtgtgctcgccgccgtcgccgcccgagctcggaagcgccgctcgtcgccggcctcgctcggcgtagctccgcccaatccgacgccagcatcggattcccgtagccgcgtggatgctctcgccgccgggaattggcccctcgtgacctcgtcgccgttttccccttttcccgccgtcggttgccgccgccgcgattcgccgccgtcaagctccctccggcgaatccgagccattggctcgtctcccctcgtcccgtgcaaccacccggtgtgctcgttttcgcctgtatcgccgcggttcgctccgccgctcgccgctcgccgctgtcgtccgccgtccgttccggccggcgtcgtcgtctacctcccgccggcctgcgtggcagccacgtaggcgccacgtcggcgccagctcggccaagaccgggtcgagccgaccccggtcagccgctcccctcggccccgctcgcgggcgcggtccaccgcgagccgtgaggctgcgcgtgggcccgccgcatccgcgtcctccgcgaaccgcgcgcgtgcaccgcgtccctcccccaaaccctagcgcgcgccgcgtgcgcgttccgcacggtgaaccgtgtcaccgacaagcgggtcccactcaggaccacgcgaggtgagcccggtccaccggctccctctctcctccccgcccgcgcgcgcgctctgggccgccttgttgggccgaccgacccatttagctcggccgagccgccccttttctctcgggccgcgccctagcctcccgagggaagtctaattttccccctccttttcttttcttttctttttcaaaaaaaggatttaagtaaatccttttcctttagaccaaaaatccaataatcttagaaattcaatatcttcccaaccgtaagtccatttgactccattcaacttccaaaattcctcaaatctcgagatctatttaatggcacgcttagaggtcattaatagggctttattttcgccgtttgttgagttgtcccgttttgcgtatagtttcggagcccgaagacccgcagtgcgaggatttcgaggatcaagctctagatctcgagcaaggcaagccacctttgaatatcttgagcctatatttcaacttaattatgttgcttgaaagattattatgcattgataggatcgcacttaatctgcttgtcccgtctgcaaggcagattgacggacctacctaatttgttgcatttgatccttcctttgttaattgttataccatgttcccttgtaaccacccagttgcgcctcggaaatcatgcactctgcacgagtatcgacggccgccttcaaacttaaaatctgaaaaacatcttgggtaaaacttgggttttataaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtgaattcatcggggtggtgtcggggaggacccctgggcttcctggcacagtatggtctgggacctaacctgttgttggtctgggacccctctcgtcggcatatggtaaacctgtgtcggctttggaaatgccttatcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcgaatgtgaggtgattcctagcgtagttttgtttaactgctgcttgtgaaattgctgttgtggaaaggggttcgatgtttgaaaaatctgtagctgatggaatcagctaggcccgggtggccgtttgaatgttgttggcccgggtggccgtttgaaaagctgttggccgggtgccaacctcgtttcaaaatctaaagactgatacattgcacatactccgaccggacgagacgcactgtctcatccgtgtcgtttgagaagcactcacttagttgtttcagaaaagagttcaaataaaatcaattgcaaaaacaccagcctctccttgaagcctgcattaaacacttatttcccctggcttgctgagtactcccgtacttacccttgctctatataaataatcccccccagttgctgaagaagatgaagcggatcccgctgacgaggagttcttccaggagcaagccggctacgatgagttttagggtttcgccctagttcccaagtcgcgcctgtgatgtttggtcctagtcctggcttccgctttccttttgtaatgcagttgtgagctcgggatctatccgcagcccaacatgactgtactcctactctataataaagagacctctgttgctgtgatattctgtcttcctgtgataccatcactgtttcctgggactggtatcgattaacaggttaatttggagcgtcacgggctagttccggtcgggactagttcggggcgtgacaacaaattagagtggaacacctttcatccaccgtaattaccgccgcaaatcgagcgatcctagacctagaagtggcaatgacgacgaacctagcgtggcgaccttggtagaggtgtgtcgatgcgtgaagccagctcaactactgcccgattctagtacaacagaggtagtggccgtgacggcaatggagatctctctgatggtgaaggcagcggaccgttgttggcgccttgaatctcccatcctccgttgcctgcctcaatgtccttccccggtggtgcctcaattacttatcctttggtgctctctccatcctcctgcagccatcctgttggctcaatgatctcccaccttcatcccgggctctagtacaacgtcgtctccatcccttcccgaggtcactcctcgatctcgggtaattctctaatgttagcaatatcactgaaattttccaaaactcagctattgagttgatggttggcttgcttagcaaagatatactcgattcctcctcacttcttttcttttccctcttttctttggtttcttgtcctcaccaaatgattggaatgctatccatgccaaacctgcaacttcatccatggcagaccttgatcttcaaccaaaacaactttcatgtcggccatggcatctagacttagcgtgtgcgcgagcgccgacttaacttgttggactgtgatggcctagcatcgatgacaaagatgcagaaaggcagcgccaccaattttggtggatggagttgtgccctgtactcggtactcttcgacccgtaatcaaatttgttccgatcctaccccctatcaaatcaacagttatatatgaatgatacctcctaatatctcgtacctgaagtaatacgtacagtcaatgcttaagttaataactgtcacatcctgattttcgtttcaggatttataaattatctaataaattattaatagaatttatattaaatgttctttaatttacaagtgaagttaaatgtgggaaataaaatttcctaaatataaagcatggttggatttaatttttattaaattctccatgattaattatactctctgaaattttctcggatttttcggagctcaattcctaaatgatacaaagaacagtttagtaattagtaatcaattaatgatctaattataattatgttaagtgcttttcttgtttaaaaatccttaatttataaattgttgtctaaaagggaattattagaaatgatcttaaaagcctagaagagaagatctaatattaatttgttaaaatctcaatataaaagtgggctagataaaattttgttaaatacttctcttgtttctatagtttctagatttttctgggatttatttgagccaaggatttattcgcgccgccgcagccgtgccctagccgcgcgcaagccaccgcccttccaaattccgtcgctcctttccatctccggccgaatcgatagaggggaaatgatcctcgtgatccactctatcttttcccttttggaatcgtcggctaatttcgtttggaaatccttggattcgagttcgattcggatcgatctctctcctccgaaccctaatctttccttctcgtcgccggtcgccgtgggccttcgccaccaccttccaacccctatataaggacccccaagcccgccgctacccgttgccaccctcgccttagtctctcgcagccggtagagctctagcgccgtgccgcctcgcgccgccgtcgtcgccgccgctccaaccgtgcgccgccgtcgctccagtcgtggtcgtcgctcggggaggtcaccgccgtggtcgccgttgtgtcgctgtcctcgtccgccctccgccgtcgctgtcgaccgccggaacaccgccgtcgtcgtcaagccgatcgtcgccgccgctcttcctcgatgccgtcgccgtccgttgatcttccgccgttgttttggtcaccggtgagttcgccgcgtcgccctctacgtgctggtgccctccgttcgtgccgtcgcgccgtcgttcgccggcgagcttgcacgctcgagccgccgccggtggtaacgtcaccgctgacgtcatcgtcgtcgtccatccatgagccgcggtggatccgatcgatcttggccgtccgttttggataggatcgatctcggccgttcgtttccgtgagccgccgccgtgcacccggttcaccgtgaaccctagccgctgacgcaataatcctcttttccttttcaaaaataattcattattgcgtcataattcaataaaaatccatataagtgttttaatccgatttaatctttaaaaattcataactaattcatcttagctcggatttagttggttcaagtctctaaatttttctaaaattgagatctacatgttaaaaatatccacatatactgttcatgcttgtttatgtgctgttttggtgttttgctcctttctgtttagattccgacgtttccggagagttcgttttcgcaggagaagaatttgaagagttccaaggccagcaaggcaagtcacacagatcccaaacaaccctttgagcatgttgatcccgtttaaagctattgtttctattcaactattgcatttattttcgaatatcattgggtggaattaacctattgtttgttatagcccttttgttcttgattactttattccttgataccttgggttattataacttgactagttgggctatatatattggttcagctagatattagatatggctgcttagccatgcttagaaacattagcacactattgggataacttatgactcactattatttaatgatggcttaatgatagctcacgatggccaatcgtgattggttaattaattacttgccaactaaaacttgataatggtgggttgtgagcacatggttttgagagtcgtgctcatgacaattaaggaccggttcacgattttcggttgtgaaacattaaccgtgccaaccacaagccagcgtgggcaacggctttaccttttgtatagcatggttcattatggagcaccagactgagaagtggcggagataagcccacgggggtcgctggggagtccatgccttgtttataagggggtgactatgatccaggaacggtgcactgtggtggattgtgttgtgcgaggggtaatgtcacagctcctttccgaggtaccgtggtggtattgaggcgcatggtgacatgttgtggggctgtgtcttgtgggtacagtggtacacctctggccagagtaaaactattcgaatagccgtgcccgcggtcataggcgggtctaacaatgtctttcgtgattagtctcacacttctcaccataataaatgatgatataattggtaataatttgtttagctcctggtttggagatagatctgtgcagccgggtatggttgttcaggatggttgggcctgtgcagcatgggtgtgctgttcaatattgattaatattgatgattaattactctattgttttataattctcaaatgtttgctaaatgctgcttttgcaaatgagccctatattataccatcctttggtatccatgtgcacttgcatatttgctgtgtggcttgctaagtatgtcatatgctcaccttgcaataatcaatcaaacctcagttgaagacaagttgcgaaggagaagacgtttggcttataccccagttgagctgcctgtgggagtggagccggagcttcgctagaccgtaattccgctgctgttttcttttcttttttaagtatgtaacgttattattatgatggatttgtatattaaattgtcagtttgtgtacctcggctgattcctggacgaggattttatgcacaaataagttcggaaattactagtgaatttctgggcgtgacaataactaacccacatttttagtacctctttacatgtatcttctcttatggatcgttagattctaagtaatctacggctatcatgcctctcaagcaccttacaaaactggcacattattttgattaattcatccattttgaccaagaagatgtagaagaagattcatcatcacattagcttccgtcgtaactagatcatgaacgctaaaaattagatcatgaacgctaggcatgtcggtaacttcagacaaataactggttcttttttctgcctgcgaaatgcaaataaaaactcattgattcagagaaaagttgtttaactcactgctcctatctgatttttttttaccacaaaagaagcagtcggtcatacatataaattttcatataaacgaagcaattaaaagattactctttgacactacagggttgttcagattgatgtcattttaaatcataccttttttttttggtaaagttgctaaagatgtgtatacacgtagggtaaaagaaacactatcctgaggttttcttcagttcagaactgtgtgagtaacaacaattgtcggttcagaacttctcggggacacttactgaagtgtagtggtagtgtacagacacattaacattcatcttcaaactacaggatgagtccatagttccacactagtatataagcatttcgttacattgttgttctgaactctgaagagaggtatgttcggaaatactggggaacactttggccgagtttagttccaaacttttttttttaaactttcaacttttccatcatattaaaactttcctacatacacaaacttctaatttttccgtcacatcgttccaattttaaccaaactttcaattttggtgtgaactaaacaacccctttactgtacagatacattctatacatctttggtcaatatagtatgggccaatagtttcatactgctacatggacatttcattccatagcagttctgaagatatttcttttatgttcagaactacccgggagcatttgatgtactgaagatattcctttatgtacagagctacatatacagtccattacattatcgccgtatttagtttcgaaatatttcttcaaacttacaactttttcatcacatcaaaactttcctacatacataaactttcaacttttctgtcacatcgttccaatttcaactaaacttctaactttgacgtgaactaaacacagcctatatagcctatatagctctttctgaatatagtagtacgacacgctttcaaaataaaagaatatagtggtacgactttgagtaaagagctttatacattatatatcccatgctgtgatcttcactcatatagtagtactgtgttatccatgtcaatattgtcacttagacatatggccgtgtttagttcacccacaactaccttaaacttccaactttcccatcacatcacatcacatctaaaaattttctacacacataaacttccaacttttttttccaaatttccaactttcccatcacatcacatccaaaactttcctacacacataaacttccaactttttttttccaaacttccaactttccccaaacttccaacttttttcaggaactaaacacagcctatatagttaggccccgtttagttccccaaaagtttttcccaaaaacatcatatcgaatttttgacacatgtatggagtattaaatatagattaaaagaaaaactaattgcacagttaggggggaaaccacgagacaaattttttgaacgtaattagtccatgattagccataagtgctacagtaacctacatgcgctaatgacggattaattaggctcaaaatattcctttcgcggtttccaggcgagttatgaaattagttttttcattcgtgtccgaaaatccctttcgacatccggtcaaacatctgatgtgacacccaaaaaatttcatttcgtgaatgtggagattatggataccccatatctgcatgacagttatactttagtcggatatatggtaccaaatatagatagaatatctttatgaggactcggggtaggttctcaacttgtatgtcaagaaaatacccgggatcctagtcggctacgattgtattttatctgtaatcccatattccgttaggatatggactataccttgtattacggatcccttcccctatataaggagggtccgtgtgcttcttggggcaagattcttttttctcccaacatacaatcaataacacactcggtggaatcatccccggacagaagtagggtattacttctttaataagaaggcctgaacctgtataaaattccttgtctccaaacctatccattttcctagcttgatagccacccccttttattattgccgaaatcttgtttcgacagttggcgcgccaggtaggggaggcgtcaagttctcgccgactaagtacgatgggtttcgtttctggcatcaacgacttcgccttccctcccgggcaggcgttctgattcggcagcctcgacttcatcaccaacgacttcggcaagatctctttccttgactcggattcaaaccagtcggggagaaaccaggtccccgtgccgttcggtattccgaactcggccgaggcctactccaagatcatctctcctgagtcggtttcaagccactcggatgagatccaatctattcctccacgatcagatcaagacgacgggtcctatccctcaatctagatgaaacttcctgatgacttggccgccgtcttcacagccaaaacatctcccactcggagatctaggtgagctccggcatcggccccgatccagtctagatccagggaggttggcattatactccaacctcttgggacagtcttgacggaagagttggatggctacctcagctcccccggcgtcagttctcgaccaaccgagatcctcgacaatgatgacttcggctaccactacgaccacggcgacttcggcaacttcaacgacagctatgaggataactacacgcccctcttcttcggcgtattcatggctaacaacgaaacggaagaacagcgccgagcctgagaagcggaccaagatcgcgcacggcaagaagctgaacgtcgccgactggaggaagagcgacagcaacaggagcgagaacgattacagcgtgagcaacaagatcgcgaacggattgcaaaggaagctgaagatcgacggcaccgcgccttggaatctgggcgccgagcgagagagctcattgggcaacaagacgtcgacgggagagcggtctttcgcaccccccagcagaacgcggttgcagcaatcactctcctcgacaccctcctcaaggaagacgcactcaaccaagccgatcatgttgtcaacatcttgaaccagacgaagaccatgatcgctacgtcagttccagccaactccgcaagcacccgcaccccgactggtagccgagtccctcatcatcagccaagcctcagtgtcaccggcacaggatctagtcgcaggagcaggggtcacgacgaacgatctgttcactcgcttcccgaacgtcacagggagcgccgagttgaacggcctcgttctccacctcgccagcgtcccgtcgaccttcgtgacacgatcaaccagcgccgtgcagcacgaggtcaccggcattcaccaaatcgctacgacgacgacgtggatggagtagctgccttcactaatgacctgcgtcgagtggattggccagtcggcttcaaaccaactggaatcgagaagtatgatggcaccaccaatccggagtcttggctcaccgtctacggactcgcaatccgcgcagcaggtggagacagcaaggccatggcaaactatctacctgtggccctagcggacttcgcccgatcctggctccacggactaccccgtggcacgatcggatcatgggcggaacttcatgatcacttcatcgccaacttctagggcacctttgaacgccccggcacacagtttgacctctacaacgtcgttcagaagtctggagaatcccttcgagattacatccgacgcttctccgaacaacgcaacaagatctccgacatcaccgacgacgtcatcattgccgccttcactaaaggcattcgccacgaggacctagtcggcaagttcggacgtaaacctcccaggacggttaagcagatgttcgaaaaagccaacgagtataccaaagccgaagatgctatcaccgcgtccaaacagtcgggcaccacttggaagccaaagaacgacacgccgactgcaggggggagtggaagtaacaaccacaaggatcgcaagcgtaagcccgaagaacttgtggcgaccacctctccatcttcccgacaacgtccccgcgtcaacaccttcgacaagataatgaactctcaatgtccgcatcatcccaattccaaccacatggccaaagattgcttcgtctacaaacagttcgcagagcaatacgtcaagaacgcacgcaaacctgcagacggagatcagggcacatcaaagaagaaagatgatgaagacgatgccccgactggttttcaagatcatcgcaaagaacttaatcacatcttcggcggacccctggcttatgagtccaagagaaagcagaagctaacagaatgggagatcaatgcggttcagcctaacacgccccaatatcttcggtggtcaaaaacagcaattaagttcgaccgctcggatcatcccgaccgagtggtccacccggggcggtaccccctggtactagacccagtggttcgcaatgtcaagctccgacggactctcatcgatggtggcagcgcactcaacatccttttcgctaagaccctggacgatatgcagattcctcgcacggaattaaagccgagtaatgcacccttccacggtgttatcccaggattgtcagctacaccactcggccagatcactcttccagttaccttcggcacccgggaaaattttcgcacagaaaatgtttgtttcgaagttgccgatttcgagacagcatatcatgctatacttgtgtcacgcccggaaattcactaataatttccgaactaatttgtgcataaaattctcatccaggaatcagccgaggtacacaaactgacaatttaatatacacatccatcataataataacgttacatacttacaaaagaaaagaaaaacagcagcggaataacggtctagcgatggcttcagctccacttccacaggcagctcaactagggtataagccaaacgtcttctccttctggatcctttttcttcaactgaggttgattgattattgcaagaatgagcatatgacatactcaacaagccacacagcaaatatgcaaatgcacaaggataccaaaggatggcacattatagtctcatttgcgaaagcagcatttagcaaagagttaagagtagtaaaacagtagagtaattaattagaaattttaatcaacactgaacagcacacccatgccgtacaggcccaaccatcttgaacaaccatacccagctgtacagatctaactccaaaccaggagctaaacaaattattaccagttatagcatcaataattattgtgagaggtgtgagactaatcacgaaaaacattgctcaacccgcccataaccgcgggcacggctattcgaatagttttactctagccagaggtgtaccactgtacccacaagacacagcctcaacatcatgtctaccatgtgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctctgcaatgaaccatgctatacaaaaggtaaagccgttgcccacgctggcttgtggttgacacggttaatgtttcacaacagtagctcgcgaaccggtccttaattgccatgagcacgaccatcaaagccatgtgctcacaacccaccatcatcatgttttagttggcaaattaattaattaaccaatcatgattaaccatcatgagctatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaatgggatcaatatgctcaaagggttgtttgggatctgtgtgacttgccttgcaataatcggtcttcaattaatcttctgaacactcccgacgcactcacgaaccttcgaaacgacggaaacgacaagctaacacgcaaaacgaggaaaaagactaataaaaaccaaataaacaatacatataaagtaaacaaacatgtaaatcataattttagatgaattatgagacttgaacggcctcattctgacttcatatgaatttattacgaattttacaagatttaatctaattaaagcccatttaaaaagaattaaataaatttaattctatttatggataattttaatatgtagatctttattttatataacttttgcaacttgaaccacattaaactgagttacaatgaattagttatgaattttcaaagattaaatcggattaaatcctttatatagattttaattgaattatgacgcaataatgaattatttttgaaaaggaaaagaggattattgcgtcagcgggtcgggttcatggtggaccgggtgcacggcggcggctcacggaaacgaacggccgagatctatcggtccacggccggaccacgggagacgacgacgatgacgtcagcggtgacgtcatcaccggcgacgactcgggcacgcatgcccgccggcgaacgacggcgatggtgttccagcggtcgacagcgacggcggaggggcggacgagatcggcgacggcttggcgatcccgatggcggctttcccgagcgacgacgacgaccggagcgacggcggcgcacggctggacgaacgatggcgacggcggcgcaaaagctcacggggatagggcgctacagatggcggcgggcgaaggcgagagtggctgcgggtagaggggagctcgggggtccttttataggggcaaggaggcggtggcgaaggcccacggcgaccggcgacgcgaaggaaaggttagggttcggagggagagacgaatccgattcgagatcgaatccacgagtttccaaaccgaattaggcgatgattccaaaggagaaaaggtagaggagatcgagaagatcatttcccctctattgatttcaccggatcgagaaaggggcgagcgaaattggaaaggcagcggcggcgcacggctagggttcggccgggcgacggctggaggaggaagacagccctgccacctgtcagcgggcggacgcgcgcgcgggcggctgctgccggactgggccgactgggccgagggagagagagagaggttttgggccggctttcggcccaaagccaaaagagactttaaaaacctttttaaattattcatgaaatgcaattccatttattaaaaatactttcttggctcaaataaatcccagaaaaatctaggaactaaagattcaagagaagtatctaacaaaattttatctagcccaattttatattgagatttagcaaattaaaattagatcttctcttttaggcttttaagatcatttctaataattccttttaaacaacaatttataatttaaggatttttaaacaagaaaagctcttaacaattataattagatcattaatgatcaaataattactaaactgttctttgtatcatttaggaattgagctccgaaaaatccgagaaaatttcagagagtatacttaatcatggagaatttaataaaagttaaatccatccatgctttaaatttaggaaaatttatttcccacatttaacttcacttgtaaattaatgaacatttaatataaattctagtaataatttattaaataatttataaatcctgaaacaaaaatcaggatgtgacaacttggacgaccggctttagccaaatttatggccgtcccacactacacctacatgatgatgaagatgcctggtcctcgaggggtcatatcactacggagcgacatcaagtaggccgtcacatgtgacaaagaaagctgcgagatggcccaaacccatgagacaactcttgctcgcgaagagatccgactagctgcaaccacggcaagcgagggagaagtgcctgcaaccaagctgacgaagaccgaagaaagtgatgccaagacgaaaaagattcccctagatccctccaatcctgataagactgctgtaataggcgctgagttagattgtaaataggaaagcgcgctcatcacatttcttcagaataataaagatatttttgcgtggaaaccattcgatatgcctggtatccccagagaggtgattgagcactctttacatgttaaggaagacgccaaacccatcaagcaacgactccgccgttttgcacaagacaggaaggatgcgatcaaggaggaattaaccaagctattagcagcaggcttcataaaggaagtctttcatctcgactggctggctaacccagtcctggttcggaaaaagacggggcaatggcgcatgtgtgtcgattatactgacctcaacaaatcttgtcccaaagacccttttgggttacctcgcattgaccaggtggttgactcaacggccggctgcgagttactcagcttcttggactgttacttgggatatcatcagatccgactaaaagaatctgactgcttgaagacctcgtttattacaccctttggggcctactgctacatcaccatgccctttggattgaagaacgcaggagcaacctatcaacgcatgattcaaaggtgtttttcaactcagatcggtcgcaatgttgaagcctatgttgatgatgtagtcgtcaagaccaagcagaaggatgacctgattgcggatttagaagaaactttcacaagcattcgtgctttcaagatgaaactaaacccggaaaagtgcatcttcggagtaccatcagggaagttgctcggatttatggtatctcagagaggcatacaggccaacccggagaaaatcaatgccatcctcaacatgaaaccgccaagctcccaaaaagatgtccaaaagttgactggttgcatggcggcgctcagccggttcgtctcacgactcggcgagcgggggatgcctttcttcaagctgctgaagaagactgacaatttccagtggggacccgaagcacagaaagccttcgaagacttcaaggaactcctcaccactccaccagttttggcctcgccacatccacaagagccactactgttatatgtgtcggcaacctcccaggttgtgagtacggtcctggttgtcgagcgtgaagaggaaggccatattcaaaaagtccaacgaccaatctattttgtcagcgaggttttagccgactccaagacaaggtatcctcaggttcaaaagttattatatggtgttttaattaccgtcaggaaattatctcactattttcaaagtcactcggtcacggtggtcacatcgtttccactcggggatatacttcataatcgcgaagcaaacagacggattgcgaagtgggccttagaattgatgtctttggacatatctttcaaaccacgaactttgatcaagtcacaagctttagctgatttccttgccgagtggaccaagtgccaagaagacatgccagaggaaaagatggaatattggactatgcattttgatgggtcgaagaggcttacaggcactggagctggggtcgtcttaatttccccgactggagaaagattgagctacgtattgtggatacatttttctgcgtcccataacgtggcggaatacgaggcgctactccatggattaaggattgcaatctctttaagcattcgccgattaatcgtccgtggagactctcagttggttgttaatcaagtcatgcaagagtggtcttgtctagatgataatatgactgcttatcgacaagaggtacgcaagttagaagacaaattcgatggactcgagctcacccatgtcctccgacataacaatgaggcagccgacagactggccaattttggttcaaaacgggaagcagctccttcagatgtattcgtcgaacatctttacgaaccgaccgtgcccagaaaagagacaactgaagccatggatactcaaggcgtaagcatgattgaaaccgactggagagaacctctcatagaattttttaccaaacgagaactccttcaagacaaaaatgaagccgagcagatttccaggcgcagcagactttacattattcacgaagctgaactatacaagaaaagtccatcaagaatactgcagcgctgtgtatctttggaggaagggagacaattgttgaaggatatacattctggcatttgtggtaatcatgctgctgcacggaccatcgtcggcaaggcttaccgacaaggttttttctggcctacagctgtgtccgatgcggacgagattgtgcggacatgcgaaggttatcaattttttgccagacaaactcatttgccagcccaagagttgcaaaccatcccgttgtcctggccgtttgctgtctgggggcttgacatggtcggcccatttaaaagggcagtcggcggttacacgcatctctttgtggctatcgacaaattctccaagtggattgaggcaaaaccggtcatcacgatcacagcagataaagctagagattttttcatcaacactgtgcatcggtttggggtacctaattggatcatcactgataatggcactcaattcaccggcggagcatttaaagacttttgtgaagacttcggcattaaaatttgttatgcctccgtggcacaccccatgagtaacggacaagttgagcgagctaacggcatgatactgcaagggatcaaagcacgagttttcgaccgactacgcccctatgctggcaagtgggtagatcagctgccgtccgtactttggtctttacgtactactcctagtcgggctaccggccagtcgtcgttctttttggtttatggcgcagaagcaatattgccgagtgaagtggaatttgaatcactacgatttcggaacttcaacgaggagggctatgaagagggccgagtagacgacatcaaccgactagaagaagcccgagaagcagctttaattcaatcgactcgatatttgcaagggttgcgtcgttatcataatcagaatgtccgatcgcgagcctttttagtcggtgacctggttctgaggaaaattcaaacaacacaggatcagcataaattatctcctttatgggaaggaccgttcataattgctgaagtcactcggcctggttcttatcgactcaagcgcgaagatggtactatcattaacaattcttggaatattgaacaccttcgtcgattttacgcttaggcatttcgtttgtatctttcctctttgactgctaacttcaagtttttcctcgaagtttttagtcagggggctactataataataatggagtgtgatttttatcaattcagtttgcttacttgatgtatcattgccctgtttgatttcttggcttagtcaatgaggactgaaagttttttaacaacttttgtgggttttaggctcaacaaggtttgacaaaaacttttaagaaatcaggagctaagctaagatatcaagcacagcataaattcatcagtattgtacaaattgtgcctccatcatcgttaatcatcaaagttatcggtacattaatcggtatcagtcttttcatcatcagaattttcaggaccagtcggtcgaagatcgttgtcctgaaatctctcaactacatcagcagcaattttgtcagccgcttttttcgcatcactgatgaggtcaagagcagcttcttcgctcgtcccgtctgcaaagccatcaatggcgtcaatatcaactctcggataaagggatttagtcatcgccaacgccatacttgctcctatacttccagcttctttgatgttcttgaaatatatatccgagcaactctcagcttgtcgaaaatttcagaaacatcaagtgcactcgggccgttgttattgaggaacatcgcttgaacaattggggcagcagtgttagcaacctcatcccgggctccttcaagttttttgatcttgccaaccaggacgtcaaattgagcttgagatttgatcttgcggtctgcatcgacagattcacattaataagtcagcatatggaggataatggattttgaggtattgattgttgataccttcaacttcctttgaagccaggtctctttgtcttgccagctctgccttgttattttccagaatttagatctgcttctctagttgagatatcttggcagcttgcactacattaacttcggttaatcaggattacagagataacagcacaaatcagttgggcagagtttgcgcaaaccttttgatgagccactcagttcaaaattggattcctggagctcagcaattcgattcctcagatcatgctcatttttcctggcaagctcttttgtctcgtgcagcagactcctggtggcttcgagggtcccgagatgagggactagcttctctaaggtcgccgttttagcttcgttcctaagatgaatcctctgcaagacagtttaattagcgcatgaattaaatggcaaacaagatggttgagatcaggtaccagagggcttacatttacaatgcgggttgcctgaccaagtgccttcttcagtaggcgtaactcttcgtcctctttttgcttatttatcatgatcccttgaggctgcatgttgtcatcccaccacttgaccagaatcggagggcgtgaatcctcagctgcttgtatgcggggaatttcttcatcatcaccgatcattggtcctaatgtatccactgacagaggttagacaattggtcagagttatttgggtcgacatggtttcagacaaagtgttttacccgtaatgatttctggacgaggacgagtgggttcggatgcctttaaaggagatccagatctctggtcattgctggcgtcttgtccgcgaaggctgtctgcttgagctccaacttctggaatctcttggcttggccctgcgtccgactggtttctagtcgggggctcctgattaaccctggcttcggcttcgaccgactgattcccagtcggtggttaatcaccagattctacattatcggttgccggctgattgtcactcggacggtcctcggcagatggcctggtttctttggaagaacttgcgtccacgctagtcgggtcagagtctttcccagacggatctatgtcagatggtttcctgcaagtttgattatcagtattattgccgcaatggatgcgcatcaatgcaagagagatcgttgtatgagttgtacctggaagacttcctgatctttggcgcggggcgactggatgttttcttccttggagtagcctgttttggtagtttcttggttgtctctcggtctccaggcctcctggtagtatcatcggcttcgtcatcactcagaaccagcttcctctttcgagagtctgactggccgactggatcaaaagcacttggttgagtttcagaccgaattcttggtcctccgctcccttgcccagtttggtggcggggagatcggcgttgagcgattgggggatccgatttcatcaaagcaaattcctgggtgcaatatctttcattgttaattgattcaataggaagacaagatcatatcttgaggaaggttgaaatgtttgagtgcataccggtggaggagggttgaatgcgttgaatggcacgacgggtagcagatgtgaatagctgacaacaatagcgtttgagaagatcttgtacattctttctttcatgaccttaaagtcaagagaatctggatcttcccgatttggatcatgcttgccatcgaactcaaaagctgtgcgggatctttctttgattggagctaaccgacacttgataaagtgccgggtgatctgctttccttgaagaccctgttcttttagctttatcatcctctccatcagttctactgcctgagcagcttcatctcctataggcaatgagtcccatgtgtcctggtaaaccggaggaagacaacagtactcggggagtgcgggctcaggattctgaacatagaaccagttcacatgccagcctttgtttgaggttttgaagggcatggagaaatatttttggctcaaggttcctctgagttggaagccagctcccccaacaacgcacggcttgcttttgtttggctggggcttgaggaagaagatgcagcggaacaaggcgaaatgaggcctaatgcctag

SEQ ID NO: 68768 - DNA, 13109 bp, Oryza sativa
ctaagggacattggttgcgtatagcatactcctgatccatgaaggtactagtgctcccactatcaaccagcccaacagctcttttcccattgatgaggattatcactgaaaatgtatcacgtctggtagtcccctacatggcattttgtgagacatatattagctcctcagtctccaaatcctctggagttttctctgggatttcttcctctccctttcctcagttatgtcttctttctattctccctccttctctccagattcttcttcttcttccagcaacagagcatgtaaagccttctttaccttgcattgatgcccagagaaccaagcttctttacaaaaccaacacttcttctccccatttcctctaggtggtgctttggtcatattagctctgctttgatttcccccagtatggatcagaggtttgtttttgttccaattcagagcaaccttcctagcattagcagccttttcatagtttttagcataccaataagattctagcagcccctggggtttgtaaccacacacatcatgttttatatccccccttaattctcctatgaaacagctgttcaggtatagttcttgcaaacaaggatgatcccttctcactaggtccacatattcttcaaacttgtcaatgtactgctcaaccgattggttatattgtttcacattctggaagagctctactgcctcatgtacatcagcagctgaaaacctggtgcaccatagcgcaccattggggccaagaaatcatctgccagggaattcctatacccctgtacaacttaagagctctcccctgcaagtgtgccaatgctaaattcacccattgatccatcggggttccagttatctcataaaacttttcacactgtttgagccaatcaataggatcttctcctccaaacaatggaatttctagccttggtcccttaatcacagcctctgcataatgattaccttcagcccccattctaccatatatactcccctgtcgatcaataaaatgcacccctggacgtccttgaaatcccccttgagttccaaccccatgctggttagcaactgttggaccacttcccccaaagttcatattctgcctttggtgaattccatgaggtggctgctgcgtatgaagtccaccctgtccatgacccatggtatttcccccagaagtagcccatagattaaccagttcattattgggtgcattagtgttagtttccaaagcaaaacgtacctcaggagctgatggctcccctgtgggaggattacttggtctagcaccacgagttgcttgaccagttgcattctgaattggcagcgtagcagctgcttcctcagttcctccttcaccttcttcaacattcttctgcttgcacaactccctcagcaatcctttgatctccctcatttcagtcttgagcgtctttaaatcagctacatccctcttcaaactcgctacatccaccctgaattcattcatctcctccatatctaccatagactcgttggatcgagtctccgtaaccatccagaaatctgtaaggtcggctcggaataaatttttcctccccttttgcctcacagaacggtctaccgccgctaggaacaaagtcaagctacggagattttacaggagcacacctatacaggatggctcgccaacccttgctcaaaccctgctcctactctcgccgccggattggatcaaactagcttaaggaattttacggtgaatctcgccgccgccttccaccaaccctcaccagatcgatccaagagccaagaaatcgactaagctctggtacctttgtcaagagctgggagtagaaatggaaatttcagcgaaaaattcagatcagaatcgcaaatttcagtggatgccgcaagacgaaattagggttctagatctatctactcctaatgacaaagaatatgctttttgatatccttttcctttctccagcgaacacttaaatagtcttacaaaagggtaaggaccacattcatcgtggcctcagtttcagacagatgtttacgtaactaagttcaggaaaacgacaacgattacattaacagtggcccccgacaaagatggacggccagatgatgttgataccgctttgctctgatccgccaccatcggatttgcatactcgatatatctctctcctgtttcactgaacttctctgaatcttcttatctctgaattttcttcagactttcttctcacttcccatttctgatctagagtcctgaaaccctcggagaccaaggaggccatctccaaccctccgcggtcgcctccagaattcgaaaggagagagatttgcggcggcgttttgtcagtcgggattctcaacatttggagaaggtggtcaaggagttttttacctagggatatgggtgacaatctagttttagaattggtggtccttaaaactctgtgcttttgaaggagatggccaaggagttgttcatgagtggcaatttagtcgttagattgatggttctcaatactccatgtcatttttttttcctttcgagtgtggttttgtttgttcggctgtgtgcatcttagttatgcaaaggccggaagtgttatcaggataattgtatcaccttgatgtaattggctgagttcaataaaagcttccattatctaaaaaaatcactcgtgtgatttgttttttaggtttgcactcgaattactgcccattcgatcatgctaggattcgtgctgtcttttgttatcgagcctgtggccggagcatactcggacccattttctgtgcggcccgaggccgagtcgtcgaggcagctacgccggcttctgcggctatcggcgagacggctacatcgttggagcatcgacggcggctcctgcggccgctacgtggtgaggggtatgttatatcactaattcactatatcctgcggctgttcgatctcgggaagcagccgatcgatgtatcgaccacggtgattcatatggtgacacactatttcactgtagttttatatatgtccctgttatgtgtttgattttactgatttatgtagaccgggaggattttgacttttttttccacatctggatttgttgtaggggaatggagcatgtagcatttgaagctggatagaaccaatttttattgtactgaaattggacttacaagttctgttttcttccaaggtgagttcttgtcactgaacataccctcttatataagccaaacgcatgatctgttttgtcttctactaataaatagtaagttttgtaagcaaatttctgtaagtaggccgggttttgtcatctactaacaaaaaatacttagttttctcagcctctacaattacttacaattaattgtaaatatttgtacaatataaactaattgagttttgtcatatttcaaatgcatagtctgttaacaaatttcagaggaaactagtagtctatgaatacatagtactagttttgtacgttttgttagtacctaacaaatttcaggcaatacagatgagtaattttttagttttgtttgaaaaattcctacattatttttagttttattagtacctagtataaaacttcagtcaatagagattagtaatttttttttagttttgttagtacctagtataaaacttcaatcaatagagattagtaattttttttagttttgtttgtaaaactcctactttttttttagttttgttagtacctactccctccgtcccataatataagggattttgagtttttgcttgtaacgtttgaccacttgtcttattcaaaattttttgaaattattatttattttatttgtgacttactttattatctacaatactttaagcacaacttttcgttttttatatttgcaaaaaaaaaaattaaataagacgagtggttaaacgttacaatcaaaaactcaaaatcctttatattgtgggacggagggagtagcaaatttcagtcaatggagattagttatgttagctaatagtgcttacttcagagctaccacctataactagttttgttagttttgtaagcaaaggggtcggccgatggtcgatggagtagcgaaggggccgccggcagcaacggcaccgggaggggacttcttcttctcatcgagatcacgaggaccttgatggacatggggatggaggggacggaagccggcggtagcagtggatgggcaaggagatcgattggcgtgggaggccccctcccgatccagtggcacgacgacgagcaggccgccgcttgctgctgcaatcccctcgcccgcctgccaccgtcgttgctccagtgcccgccgccaccactccactgtcgccacggctaaaggggaagagatagagagaggggttaaagagggatgctgacatgtgggtcccactattttttgtaaatgataaataggtcccacgtattttttttaattctaatgccacctaagtgccacgtaggatgaaaaccaagttaacaccgctatgtaggcgccacatcagcaaaactgcgctccaaaaccaccgaggaagtcaaattacaccggttttgataattgagggatcgagatatccggtattgtggtttagggatacgaatcagattcggacactagttaagggagtcaaagtgaacttattgccctgcaaatctaggtccagtttgttcctgcaaagtggacaaatgcaatctgggctcagaaaaacagacctgcaaatgctatgggcttaacaaaacgggcctgtggatagatccgacccaagaaggataagttacagacttacagttccgcacgcactgtggatagatctgacccaataaggagggtctcgttcgggagagggagatcgttccacgtttctctatcgcacggcaagaaatttgagtgcaactaaaaaaaatcaccctattgatacctaaacagacccttaaagtattatacaaccctcctactacacgaagtagtccaaaagggtcacataattctataaaaagtggagacacaaagtttagggggaggctctcttttctaatcaatcctccaatcaactgtactaatgaatacccctctctctctctctttatacagtgcattccaatatatggaaggttcggtgatgggtccgataagagtatttgggccaggcctttatgggccaagcccaaagtttcttaacactcccccttgggcactcaccgcgtgatgtccatgcctctttaaaactccataaaaaccagtaagaaaaattaaagaaagagtacatagcatatgcacgtatgtcgtatagattgcctcattaaaaagagggctgctagcccacgggatactgttgcaatgggatattttaagtgactctccatttttctttcctctgcccacgtgtgctcccctagtacctggtaccttaggtaccggttggtacctggtacctgatacctttagtacccaaggtatcaatatctgatgcccggtacccaaggtaccggatggtacctaggtatcagaccttggtaccaaggtatcaagcctgatacttatggggtatcagagggtcctatcaaaaagaggagacgtgggggagagagcgccgcaacggcggaggatggtgtcaaggaggcacggcaaggtgagggacgtgtgctcccctagtacctggtaccttaggtaccggttggtacctggtacctggtacctttggtaccgactagatatcgaccgatacctgatgcccagtacctaaggtaccgggtgatacctaggtatcaaaccttggtgccaaggtatcaagcctgatacttgtggggtatcagagggtactgtcaaaaaagagcaggagatgtgggggagggagggccgcaacggcggacgatggcgtcgaggaggcacggcgagatgagggacgaggcccgagccaaagagtgcgagaagtctcgaggaggaggttgacagccatacctgttgcaggtcgacgcgggctgccggtgtccatcccggaggcgcaaaagtggcaagccgcagcggggacgacggtgacgcagaggccgagggcgaggacgaggggagctcccgcttctgccctccccggggcgacgactccccggcgcacacccgaccgacgagggcggcgagccagagtggcgcagcaaggggaggcgagctcgagggcgaccccgccgagggttggccgacctcgccgacgtagtgccatcgtcgtcctcctcggccgccggaaacgacgacgacgaccccttcctcccggccggcttcgtctctgctcggccttcttcagagagagagagaggagagggagagggagggctgcagtgccgtgtgatttgggggaggagagtgaggcaggaggagaggattcggatgattttggggagaggagtgaggtaggaggaggggatcccgtctccacgggatgccgtggtgtaggttttctgcattaaaaaccttgataagaaactgcaggaaaacttatccaaggaaaaaagagtacaatctacccaaattcttgtatcgattttcttaatcggttttgggtacttgatttttcagttcaagcttttgttaatagactggcagaattctccccctgaattttgcatctcttttaagtgtgaaccatcaaaaatcgttgctcatatcttttcaaaagatagttcgagtgatgcttcaatggtcaaatcttgcatgatttttccataacttatagagttcgtatagtctattagtgctagtgcgacgcacatatcattatcttcttgataatgattttggggtttggacaaagctcgaaccaggttacttgctagaaatggtgaactatatccaaggaacctatgtattttcacattctgatatactatggttcacttcttcatgtgttgtaggtttacgggcctaagcaacataggtttctatctattttatctcaaactcgttcggaaagagtgagctttatttctttatgcgatgatattcggatcatcaacttggtttgggacttttaatgcttgtatgtgagtgcccaatccaaaatttctttagccattcattgtcaactataggtcagctttgtgggttgatcttttagttgattttcaactccgggttgactgccaatgatttgttgtatgaagagaatattgcccatagcaggtctcattaccaattcctattggttgtatgtgccacttatgtgagtatccatggatatatggggatatgcaattttcttatgcttctattctttgatatgggcatgactctttcattttatcggcattggtgtgcactccaactgctggttttcttccttgataggaagatgtggtatgcttgttctgaggttccataccatttgccagctctgaactggctccccttcaaataccggggttacttttagtgactatgagcttgagagttcctttttgcactactacaaaaaccttcatagggaccggctcataggtgctggttcatttaaaaccgacaccaatagagcttttcccacctcctagcggtggaaaaatacagaaccgacacctttaaacatgctagaaccggcacctataatatattataggtgccggttcatgaaagaaccgagacctatagtatattataggaaccggttgtttttaaaaaccggcacgtatagctttgagtcgagccgacgagccgagcccatccacgcaccacacccaccatgtccttatttactcgtatccttctcgatctctcgtgttatctctccctcccctttctctttcgcgtctctctccctcccccccccctctttctcgcggcggctgcccggcggaggaggcgggctcccgcggtcggcgcggctgcctggcggaggcggcgagctcccctccgccagatctagcgtgaggagagccagtgggggatgtagtgggtggcagcggctcctctcctcctccgatctccccctcagctcctcctccgccgccctcccctccagccccctcctccttcactccttccacctccgcgacaggcggcgtccccctccccctccgcacccccctcgacaagcggcgtccccacgggcggcgtgtggagaggcggcggatccgctcggatctggcctcccatggccggcgcggcccgtgcccggcggcggcgcgcggagaggcacccggtggcgcgcggtgagggactacagccaggaattggtgagagtgagttcatgcatttcatctgtgattgtgatatggatttgatttgtgatatgcattgttgttcatctgtgatatgtatttgtgagatggattgttgttcatctgtgagatttgattttggcttggcttggagccggcttcctttttttttaatcggggagagcacaaaggtgccggttctatgaccgacaccaatgacctagtgtcattggtgccgaccaattggtgccggctgggaaaccggtacctattgacggttcccaaccggcacctatagcgttttgtgtactagtgttgtctcgttttcaccagacgtctccagttactttagggatttaaggagccggagttcttgtcccattatttttctcgaggcctctagacaatatgaggtatacctttgcattcttcggtatttcaccctcctccggtgcattatattcgggtaatgcaacttagtcatgctctccaaaatcacaaaagtgataggcagttatccaattacaaagtgtgcttttcatactttgcatttgctagtgcttgattaaatgtgcatccatcctttctttgataggcagttatccaattacaaagtgtgcttttcatactttgcatttgctaatgcttgattaaatgtgcatccatcctttctttgaccatttttcctgacatttatcatttaagggttatttctctccccctaaatgactggaaataatccttcttattgtcaaggaatttaggctatgttcatacttctattaaaaatttccaattttttcggagggagcccttatggttgtgggatatgcacatgtgtcgagtcaatactagtattcttttaagtggacaacacatttcaaatagtccgaatattgataattcgctgcctttggaactacaagtccattcaagtggcgggattttcaataatggtgcaggggacatttttagtcctattcttgtggacgtccggtacttagtgcttttcttaacgcgctgacgccaacgtgcatgatcttgcaggatcgatttggcaagggcgtagtgtcaattagacacaattgcagctttttcataagcacagtatgtatcagatgatccattaaagggttaaatatgtatgcgaattcatgcggtatgcgcgaatttgttccggtataccttaaggtacgtcggaattcatgtggtggtcggcgtttgacacgcatctgatgttcaacggcatgcgcgaccagagtgaccatggggtatgcagccggtgcaactatggcgcatggtaggagttgcatggcgtgtgctaatgcttcatgattcgtccagtccccagtacagcggggttgctagttggtgcatagtacggcatttagaggagttgcatggcgtgtgctaatgcttcgtgattcgtccagtccccagtatagcgggattgctagttggtgcatagtacggcatttagagcacggcgctagtagcggccttagtgcgtgtcatgatgctatatgatgcgcaagcctggcgcgaggcgctcaagcagtgcgcgcaacaaatatctcatcgttgcgatacgacagatgacgtgggcttgtttgttgatcaatccggcctaggtggggttggccgaggcccaataacttaaggttgcccggaccccaacagttctttggcacacccactcggagaaaggcccaatctccctaaaagactagtccaataggggaagggtggtttcctcctcccaagctaagcaaggtgggattattcaaaggctcatacggtcgccacccgacttttgcgtctttgccagcgggtaatagtggaggatgtcctcatcgttcccacccccttaacaagggcccaactctgataccaaatgattaatccggcccaggtggggttggccgaggcccaataacttaaggttgcccggaccccaacagttctttggcacacccactcggggaaaggcccaatctccctaaaagactagtccaatagaggaagggtggctcttccttttaaggtggcttcctcctcccaagctaagcaaggtgggattattcagaggctcacacggtcgccacctgacttttgcgtctttgccagcgggtaatagtggaggatgtcctcatcatttgtgctatgttcatttgcaagattctaaattctaagaaaaactgactatgaaatagtctactttagcctacatttcttagtgaggacattgttctcgcatgcttaggtgatgagtatgcttctctaatcttctagttcctataagggaacttttgtatgagagtttgcgattctcaagagaattgaggtgtaatcgcttttctacgggaaaaacgatatccttcacaatcattgcgtgcggttgtgaaggtagttcacgtctttccatagactgaacttgtctcatgtctctcaagattacattttgtggtgcttttgttccacaatgttcctttcaccttaggctatgcatattgtctatgtggataaagtaaaacattactatatcaagacagggagtaaactttaccgtagagcgaaatgcaacaaaatattggaaataaagtctagccatgcaaggcaaatcacaaaataaatgttatgctctcatagagcttacaaaaccattattcaaattgttcataatgtaacttagcttacgaaataaagtaggggcatcaaatactcaaatggaatcaaccagagtattgagctctacaaagatctgctcctgtgtgacggcctcttcatttgttgtacttgctgcagctgcaagggcgtcaagtggagtagtggtggagggagtagccgtactgtgagcctcaaccatgtgtgcctctgcggacgccttggcattcctgctggcctagtatgcgtcgacgacgtgctaaggctcctcgcaaatatagctccagtggcccccaaatcccacacttgtagcatgtctggtcctgctggccatatggcttgtcattgcgagctggcttggcttccttcttgcccttgcctccctgtgctccctgggcagctggagctttttcctttgacttctcggctgccttcttcccatcacgcttgcccctcctcctctaggtgggcttgcggaccttgcaacttctagcattgacttcaagaccaacactcttgccaggtggctggaagacaaaattcttatggagaacctcatcatgagacccagacacctgcatgatgtcgatcatctcatcatactccttgtatgacgcttgcctgtagttacgagcgctctacacggcgctagggtggaaggtggagagcgtattctcaatcttttccacatccatgacaaccttgccacagagggagaggctaatacagatccgtgcagtgtggagttgtactcggagacgctcttgaagtcggcgaaccttaggcgagcccagtcctactctgcttggggcaggatggtgtacttcaatttctcgaaccgcttctttagtgcagtccaaagagtgagtgggctccgcaatcccatatactcattcttgagcgtggcgcagaggtggtgtcgcaggaagtgcagcgccttatcattctcataaggtgtaggcgcacggtcctgcggggtgcccatcccgatcgtctggcggagcttcttggctccaaggacgatctggacaaaatattcataagttactactagtaacatgattgcaaatatgaatgcaaatatttcatgattttccaatatttatattcttagggaatgcaacttgttcaataggaaatgcgaattattcaatagggaatgaaaattatacgtaggagatgcaagtttttcaataaagaaatactagcgttcatataaattcatacaaatattcatataaagaggacaaaaggatgcatatattcatataagtactcaaaaatgaaatttcaaactatcaaataacagtaaataatgcctcatgaaaatcaaattcaaaaattcatgagacataaaaagaaaatgcttaaatatgaaatataggtgaaatatgcaagtacaggggccctttactaagtttccatgtggtggagggataaaaatggaaatttctgaaattctagggtctaggcgcaaggaatctccatgctgagagatatgcgaacagttttaagaaaatccgggggcctttttgcaaaatcaccaattactttcttttttcttttttttttctttccttcttttcttcttcctctttccttattttcccgttgaatccggcgtggttgctggcggtggcgcgtggcagcgccatgcgaggcgcggccggcggcggctcgcggcagcgcttggcgttgctgccggagcgtggccggcgcgatgagggagcggcggccgtgcggtcggcgcggcgacggtgcggcggctgtgttggcggcgtgacgagggtgcggcgttggcgtggcggagcgcggcactgctggggccgtgcggcgccgtggtcaaagccgtgcgtccggcggcggctcgcggtgagcactgcggcgggcggcggcaccgtgcgaggcgcagccggcggcggtgcgcggcagcacacgaggcggtcgcggttctcggcggtgccgtgcagcggcgtggccggcgaccgtggttcgatgccgtgcagtggcgtgggcggcggcgtgacgccgtgcctcaggtccgtctccgatccatgcttgtattagcaagttcgtctctgccatgatggaggatgccgagaaaactccagtcggctagatgccggcgactccaagtcggcgatggcggttttcgtcgggagttaaaaaacggaacgtggaagacaggggtggaggcaggcctat

SEQ ID NO: 68769 - DNA, 22842 bp, Oryza sativa
tcaatccctttgtgggagggattaaccgaacaagacctaagtggttttaccatcaaaaaaccattttggaacagttattcatattaaacttctaataggtttgccagttagatcaccagtcatcattatttttacttcgattgttcatcttactcaagcaacttcgtcatcgtttccagggatgtacaccagaaatggattgaaggcggaaactatgaactttgcatcgaagacgtgagggatgaaatctgggacatggtaaagccggcagatcctctcaggatcgcactaacagatcttctatcttgcaagcaaggcgggactattgccagcatgcttatagatgtgcgcggcttctgggcccacgacaacagagagaacctcctccaggaagaggaagagcaagtggaagaggcctgagttctccagctgccgtgcaaccaacctggtaaactctcaaccgcaaggcactggcaattgctggtatctcgcaaccgcaaggcacgggcaattgcttgtaccactgtatgtgtgccattgtagcttacatagtgtattagaatcaagttcaacctgttcgctgggagacttgttgtaacctgtaagtgttccatttgtgtaaccggagtgaaatctgacatattttgagttgaacatggttttgtcgtgtcgaccagatgtattaccgcagggcttggttggatgcagaaaggaaagcctcagcctgtggaatttgtacgtctatgcgacaccacgcatgtaattcggtttgcaactgcaagtctatatacgcaaaaatacattgtatgccctttgatgcagtggttatttgtgcccttctccgtgccaatcactagtttgctttcatttggacgtgctctactttctgcatttggaagattgcacagatttcattgactgctccctctacgttttctagcagtgtttaaggttgagatgaaattcgtttgatgccttacacaactttaggacccctttgaatcgtaggaatgaaaaaacaaaggaatagaaaaaacataggattctggcaggaatacaattgtaaaacagaggattgcaaaacacagggaaaacacaggaatggccgtttgattgggccacaggaaaaacacatgaatcaaatgagagagatttgagagatagacttagagaaaatgttccaagaggttagaactcttgctaactttcctctaaaatatatataggattactcattccatgggaattttaaaagcttggatatgattcaatcctttgtttcaaaggacttcataggattttttctataggattgaaatcctctaaaattcctacatttttcctacaaatcaaaggggccttacttgtttggaaaagacgatgcaaaattgcaaatgccctatatttatagatggtgggagtaaatattttgaaaaactttcaacaacatatgcttatttttgttgggtccccttatttactggttggttaaatacagtggtgatgccggttcggcccttttggacactactagaggttgtgttcggcagcccctcttccaacccatctctctcgttttccacacacacgttttttaaactgctaaacggtgcgttttttttaaaaaaattctatacgaaagttgcttaaaaaaatcaaattaatctatttttgaaaaattttttagcaaataattaattaatcacccgctaatcgctactccgttttccgtgcgggcacttagtgttgggaacccctggttggaacacaccctctgtctggaaaaaaaactaatttcatataaaaacgtgacacatctaataaaataaatattgacataaccaatttatctgaacatagagttgttgtcgtatcttagtataaagttggtctattaggatggagtacacactaataactcttaatttgacttgattttttttcttaatttgaccttttaatttcaaaaaacaactttgaaacgggccaaaatgtgccgccaaacagcgcaaaccccatccattttgaaacgaaagctgacaagtgaagccagcggagtggagtggacaaatctccgaaccacaaattccaattcaaaaactttttccccgagtagcctcgccgtcgccgtcgccggagatggaggcggcgcgggagtcaatggcggcgctcgtcgacgccggcctctacgactgcgcccagacgctcgtccgtaaccccccatcctcccttccctcccctccccctccccctccctcccgccccagttcccctctccgaatcactagggtttcgcttttgcccccacgaatcagtcgctgcacctgcgcgcgcgtggatcgggctcgcttgggtctcgtctctcgtcttgggacctgtggttggttcatcgcctgtgccgcgcgaggttgggcgggtggttgggtgattgtgcgatcgggctggctgggcgcgagatatttttttttttgtctttgttatctgtttcataatgtatcgagattgatttcgggtggagataatgctagtttgttacttgcaggggtgctttcttgtgtcttcatcacctgcgagcagcgaggctggtatgtccatgaaggtggaaagcttggtaagctccattgagtagctcgggaaatggtgctaatttggtcttaaccattgatagtccttgttctgtccagagttggatcgttgaagcatttacgctacttaatctatgggaagtctgtttatgttgttgctttgttgctaggagcttaactgaggattcttcatctagaagaactttacattgtcgatttctgttgtctagaaggtccaatattgatcttcttggagcttaaggtgtcagtgtattgcaggtactgcatggtgatgctttgcatggagagaaagaatttcgcagggcactggtaatattgccgataaatctatgttgatagaaaaacgataatgcattttgggatttcattgtattcggaaatgtaacacatgattcagaccccagttctgaaatcttagtctcttatttcctgtttcaccatggtagagtgcctacaaacaagctatgcaatacagcaaaaacattcctaggcaagcaacaagtaatactagaagctcagtaactgccactggccggtctccttctccaaattcttcaagtcttgcaccactcaatgaaaatgaggtgaaaacagctcggcaggccattagatattccgttcgttgttatttatttgtcatatctagcaagcaactcattctttttctactgttgcaggtgaaatttaaaattgcactttgctattctgctctacgtgagcatcgtgaagcacttcaagaggtttccatttttcattcacctttgtttagttctctattatattcctgaatgttactccatcctgggaagtggaaaggcaggatcatctgaatatatgtaggatgactcggactcacttgtggtagcttcttctgtatgatggaagacatatgatgcaaaacatggcctctatgttgcctgcagatggaagggattccttctaaagcgaggactctaaaaatgaatctgatgttagggaagctatatcggatatccagaaataatcgtgcagctgctgtatgttataaagagtgcctgaggtatgcaatgccaaattattttgcttcctagctcctcaattctgcaacagtgcaaacgatcacataactaccattttcttttgcatatcacgtttccccctaaacattgatacagaaaccaacattttttttcaccattaaaaatattgcccctcacttggccatttcatgaagatttagtttgacaaatttctttctacatctatatgctcttatgacaggcaatgcccttatgtttttgaggctattacagctttggctgaaatggggctttcttcaaaggagttctctttgatattctcacaagtaagtgttttgctccataggcagcttgtattttcaaactgaatatagtgcagttttagtgaggtcagataaatactagttatgctagatcctaagactcttgagtgcttgattgcctgccattttttctggttgcctattatgcttgccatgtatataggctgtctaatcccattgatgccatgccttggccagtattgctacacaactacataggtcattgtttgttttgctttacatcaaaggaccatttctcagcatcatataaacaatgatattttattgatggaagatgcatactgcaacagagaaaaagaagtaaattacatgctgttaatagttctatataatatatccctttattttattgatgatctctttatttcatatacaatatttaccttcgcacaattcaatgttattacagaaccatcatcccaccaattttttatcctttctatatttcctttggcgccgtgagcactgcaaaaaggaaataatgagcgcacatcagtttatcatgcaattgaagatgtggtattctctgtaggcaccaaatcgaggaggcaaggctccaggtgactctttagatgcacagcgttggtggaacgtaagtgaactacttgcacccttgtgtagatagaacatgcgaaccccaaaaatatttgacatttcttatgtttgatacaagtaaacttctatgctggattttcttagtatattttatttacattgattattgaacctcaaaaccacttttactttcgaaacttattaaattggaagagtgggaatgaagtcctttccttttcagctctatgttaccattgtatgaactgagcccacttgtggaacagttctatcatgcacagcttttaactcatggagttcttttccctgaccacaaataatttgtcaccactgcgtcaacaaatgcacacctgcacttctattgttttcttgtagtggggatactgtgatcaatactagaacattaggaagcaccatgatattgtacctactgatcacatgcagttgtatttttttttatgttgtggatttatcagaagaacccattttgttccgctcacagctacagtgctgctttagatttgggctcaattatgtataagagtttccttgcaaactctacttaactcatgcagcatacagttgatcatacttattgttcttgttattggttgactcaaacaattattgacttaaatcattgttttcttaacagcgctatgttgaggcccaatgttgcattgcttcacatgattataaaggtgataaaatagcattaatccaaattcatttgacagttctaaacgtaagatgcacttattttatttttgtcattgtcaaaaaatcgtgttgcatgattacagaggatttccactactaaacaaatgatatgtagtgttaatgtgttatatcaccctgtattgtcatctatgtcttaattttctgttggcccttgttcctttggtgttggtccttgtgccactgggtaaagcttgatagtcaacatttcttaacttcgatttgtttgcttgtatcctctcatctgttaagcataaacttgaagaagtaatactgatatgccaaattcatttatagtggtcgcaaaatataatcatgttatttttttgtttaggtggccttgacatatatctagacttaatgcagcgattcccgaacaatgtgcacatcttgctggaaattgctaaggtttgtttttcttcaagcattctgtttatgttttatgtgctctctgtaacatgtggattcttgatgcattgagcaccatggctatgtcatacttcttattgtttatgtacttcatgtttggttctgctgtgctcctctgtcctgtctataaaatttccttttgttatgtgttgaaattttggagttcctcttaaaattttcatttggtggatttaattcccctccattatgaattgatcctgaatttggagcttattatttgaaggttgaagccatcataggtaggaatgatgaagctatcatgaactttgaaaaggtaaaattaacaagtatagacttggaaccccttaaaacgtaagtatgtggtaaaattatttgcttccttgcaggctcggttaattgatccaaacatcatgacatatatggatgagtatgcaattctccttaagtcaaaatctgactacacaaagcttaacaagttggtacatgatatgctgcatattgaccctgcaagaccagaaacatgtcttgctcttgcagcattgtgggaaagaaaagatgaaagaaaagctttgacatatgctgaaaaggtttgtatcgttacataatcttttattgaaagctaatcttgatcctaatgttccttgattttccttcaacagagtctccgagttgatgatagacatataactggatatatcatgaaggtaataatgcaaaagattgtccgaacgactggattttgcactgttgtagacatgcagtggcattttcttgctttgcaaagtattatagagaaatctctgcaatgaattgcgtgggattaaaaccaaaatgttattttatcaaagttaaaaccaaaatgttgtgatggtttttcttggtatttactctgggaagttgtatacttgtaactttgctacctttgtttttgtttatccacacgtcaggcttattgtttgcttattgcttttcaagggaaatcttcatcttttgttgaatcgacctgatttggcagtcacagacttcaggggagctcaagaacttagggccgatcttcgctcttatcaaggtattttggtgatgctcctgattttgaagatcaaatcataccatcagtctaatacatatactatatcaggattggtacgtgcttatctagcgctctctaaatgcaaagatgcattattcactgcacgtgaagcaatgaaggttatgcatcagtctgcaaaagctctcaaattagttggtgatgtgcatgctatcagttccagtgggagagagaaggtaatatttattttccttggtcatttatacctcaattatattttggtaatggtcagttagtcacttggtcacaattatagtttgcatacttcccctcaataatagtaccctttgacaaattcattgcacaatttccaggctaggaagttctatgaatccgccattcgtcttgaacctggatttctgggagctgcattggctttggctgatctgcatgtcgctgaaggacgaaataaggatgcagtattgctgcttgaaagatatctaagacagtggacagatgattctctacacatcaagttggctcaagtttttgcagcaacgaatatgctttctgatgcactttcccactaccaatctgctctaaggtgcgacttttctcttggagttgaactgtcaaatagcatcattgttgcaatagcgtgtttcctcttttgttattgacctgaaacccaaagagtacttgagacactcaacacacaagtagtcaatatataatgcattgatatactggatataactaaagtatgtgggtaagattgtaatgctggttcctggactatgtagcagttaagttttgtgctgaatccgataactgggttggacggggtgaactgaattatctgtatgatacaaatttttttggagacactactgtttcagctggtggaattcgtttttttataacctttggctactacttatccatgtgccaacataactatttcatgttctagttgaaaaagtttccacccgtgatgcaggataaacccacataatgaggccgcaaagaaaggattggaacgcttagagaagcaaatgaaggttcgtgttccatatgtaaccatctatcatggagcctacccagctctcacatccagaacaagaaaaaaaatgactctgattttccatatgcagggagtagacccggacgcgcctgaagaggacgaagagaacgaagctgacgatgtcgacggtgatcaagacgacgctgaactactgtagaaaaaacctgatcaactcacatcaacccaaggcaccacctcttaccaagcgtcaactgcgaaagaggaccaaatctgcagccgctgccacagcaggagagcccctcaattgccatatatcaactagcaacttggaaggcacggcaactggaagacgagtgacgacgacgggtgcctctcccttaccgcgagtaagttttcttgctaacgcgaaacctcgtcgtagagttgcaatgctcaccgtaggtttatttttctaatgctggggaaatgtgaactgaacttgttggtttcaagtcaaactttattactacctctgtcctaacatatagcaacttagtacccaacagtccaaattcctggtatctaggatgtctcatttgatattagggtgctatattttgagacggggtagtagttaatttgctctccatgtattattgttttttacattattgtgttatatatcatggcgacaaaaaaggggctgcaagtcgtacaacctgtgcagtgatcagatacgtacggtatgtataagtacggcgattctaccacgcacagtggtacatacgtatacgtacactagccagcagctggagctggctggcttctctactacactggcatgcagcttggtgtggcaggctacacccagagcgcgccggcgtcgcggaggagcgggacaaggccgccggcgacgtggagcgacatgacccggtcggtggagccgacgagcctgccgccgatgaacactgtcggcaccacgacgccgcggccgcggccaccgccgttggcggcggtgccggcgagcaacatcccggcgagcgcgttctccatgtcggcgccggcgggctcctcgtcgagctccaccacgcgggcgtcgacgccgagctcccggagcaggcgcgtcacggcgtgggacatgccgcacgagctcttgctgaacaccaccaccgccttctgcgacgccagccttgtcaccctgtccatctctatatatgcaaatgtctatgtgcctagtgtcttcttccccgtctccggcgactacgacctggccgcggaatgcgccgggatctttggctggatggatgtcaccggcggtgatcgcccgatcgatcgaggttgtgtcacttgttagtgatgctgatctgctggttgtgcttgcatttgagaggttagggaaggcatgcttatatagtgttcttatgcatgttggcgaaatggtatatcgcgcgtgcaaatgctgggtgaagatggagttaaagaatcttcagaggaataattaaaggcgatcgatcgatttatgcatttctgcgggttttttttttcttctctctctctcttttggttttgggataatgcttggcaccatttctgggttgtgaaaaagatgagctgatagataggttggtaaggaatatggaacattttggcggcgacggaaacgatttgcggcgtttttttttgcacaaaaggtggctgcattttgaaaaggcctgatacacctgataatttttgttatgaacgatgatcgtgctgtgcaaggttactttttcgattatgatttctttcttttatccggtaaggatgatcagcaatccactagactgtcgatacgtaacaatgtaactcggtactatgtatgatgtttgggagtgaattaacacacgatcagagataaccaatgtgaatactggctgtcagattaacttaatccatggtctacacatgccgacatgcgtatacgtaaagagacctgcaagttatgatgatcttaggagtcaaagaagatcagcaattaaattagtttatcctatgttctgataaacttgtttcatttgagacaatacagagcagccaaactgacaaaatcttgctttgctacgtacaacaaaagctacttctgcaggtatatcactgaagctacaacaaaggctaaagagcatccttggacatttgtgaggctattaaactctggatccgggatagggactgatccaatcagacatctgatgcaaagggacaaagaaatactaggaaactaatacattttgtacttcatgtcagctatacttgacaattcagtaatttcagtcagtactgtggtacctggattatcaaattgtcacagaacttactcttatcttttactttcacattcagaccacatcattccttagagttatcgtcagctcaagaacaatgttctcaagtctgaaccacagctagtgataattacagacaatttcagtttctgccgtattaacccagaatcaacctctcgaagggtcagatcagcaatcaggggagccagattccacacagaatccctcaagaacaacaatggccattaaccacttgatcagtgctgctctatccaataacttaaagcgaatctccaaaagcagcagaggcttctcttctccccactagttttctcaccagatatggacagcaagcgatgccgcgatccgagatcgcttttgccatcggtaaatctttcaaaacagaccaggatgatggaatttcatatggataaggagcatctggtctgatatagggtagggattccaggtagagtgtggtctcaggagatcccatgccacactgtatgtggcagattgtgggaaacatggaaccttgggcagttgcagcaatgatatttataatgaaaggaatggaatggattctgcaagtggaagatcaaccatgcatattgtatttgacagattagggaatttcttctgtgaggataatctttatcttccaaactgtgacaaaaagcattcagtgttgtacaacagtacggtataaagaaccttgatgtggacaacataattcttagagaagtttactggaattgaagcatggaacctgcgaattatagagcaatggcgatggcaaaacgagtattgttcagggaaaaaaaatcagagatcattgggtaaatgatgagttaatcaattgttttaaatttttgtaggagacaagttatgatttcatacaacatcacacaatgaaacatagcttctgtggtctatgaaaagttaaaagactaaatcatttgttatagtaagaacataccctatgtggcttgaggagatgagggcatcaagaagatgtgaaacttatgacaattgtaaaaaaaaaaagaacaaatcaaatagatcaactttaaaccatgccgagcatggaattgttctccctattctttagggaaattactgccagtcagagccaggcaattagactttatactcctttttttagggagtatatgggaagtgtaaaaactagaaacaaaacaagcaagaaaattacaaacctttcaagatgttcttttttttttcatttccatatttatctttctgattgctgctaggagttatcagaatctatctgctacaatgcaacaaggttggatgactatgggcttcagctcaggtgatgagctgaagtgccttcttggggtgcctgtctatgatattccaaatgccgtgtgctgcatctaaaatgtctctacagtcttccagatgattccagttgatagcttttacacgtataccaattgaagatatttgaaactttacggtgaggagggcaaagacgagaatcaactggaattagaggagatccaaacaaagatggatgccatctgcggtttgttgtcacagtatcacaaaaaagtcaattcacatttaggcagaatagatgtttgtttcgttcataaaaagaatgggtgtttgttgattgcacctgtcaaggtgcttagaagtatttgaccacttaatgcctatattattgtgaaactaaggatgaatcaggcaggatacagcttaagaaccaaagaaataaattggaattcctgtcatcctatgctgtctgaatattttaaataaaagattaggcactcaggcaaactgatatccttattatttccaaatggtgcaaaaagctgaagtttcaatggataatttattatcaactttccaactgttaaagcaaaatcatacatattctatgcatgctatgtcgcagcaaaacctgatcgcataaccatcctaattcttctttgggtattctcttgcaccaaatatagtcgatccaactctaacatttgtgcttcccatttcaatctgtagaaacgcagaaacagtagaaaatgttagacattgagttactaaatctattaacatgatggttgcaacctgttcttaccgcttgctcaaaatcagcagacatgcccatagacagttcacactgctcctctggaattccaagctccttgcacacctctttccggcaattagccagtgcctatttgttcaacaaattgcacatatattaggccttacccctatggaaaatatagtccagctaagtgtgtctcagaaaataaccttgaaattctctggagttgaggagtaatcaagcatccctattgtcatcaaaccagaaaacacgagattcgggcagcctaatttgacatgctttgcaagctctacacatcctgatggatctactccaaatttcgctgcagaatggcaattcaatttcagagctatggataaaatattcaatgcttgtgcacaagaatatagtgcttccatatgcaagattgatcattccacgtacttatccatgactacagacaatccgatgcgtagcaatgctggacagtataacaataaggaacagagatgcaaacaatcatatgaattctattgtaagtttataaccaacccaacgcatgtagatctgttgctaccagaaattaagttaaaaagtagtactgtaaaggaaattagagtacccacattcttctccactggtgttgacctggactaagactttaaggggttttcttcccaagtcagctaccacacgatcaaggcgattggcaatctgaaaaagcaaacattgcatttatcttgttacagttgcaagattgcgaaactgatctgacaaccaattattcttccctaacttatgagtgatgcaactgaagtcatgctatacaaaatatgaaataatatcaagttctactacaacattgatatgcaatcattaaggcatactatttttttgttatgttactttcattgaacctgtaagtgatacctaattatccgaaaataagtatgttgagttgatgattgatcagataaatatggtgtatcttatagcgttagtatttcaaagcaaaaagtaatcacacgaagaaatattaatttgatgtttaccttctgatcatcaacactctcgaccatgtcaagatttggtacaccagctgtaggtcaaaacacaagaagataaaacttagttgaattttaaacctggaaaaaaaacttcaaatacctaatattcaaacaaaattgatagcttcattgataaagaatgagtctaacgttccatgaaaccagaacaagaatgtaattcagtgctttacatttaggaacatacagaaggcccacataatagtcaattgcacagttaactattcaacaaactgagtaattgagagtagataactctggctgctagaataaaagaacaagaaagcatatattgaacggccgacaaaattggcagtaagaaactaaagccatgttttagagatagccatggctaaccagtgaaagagagggaaaaaaaaagttcaagcacatcgtcttaattacaagtaccaacctaggagggctctggccttgttgctttgaaggttcccgatgaaatgccactcaatatcctctggaagctgcaaaacagacaatacttgctcagttgccaaagtttgaatatgtttgaggtcatttaattcaagaaaaacatccaagaagaactccaagtgaatataaaagaggaagaaaaggaataatgcttcactaagtggagtgcttgttacatatgaacacagaacacggtgagaggaataatcagtgaattccttgacatttatctttattttcatgaatcatgattcactacaggttcaaaatcaaacaatacttatgtatacattaccatgagaagagaaaccatgaatgagaatatctcaaaataatctacagataaggtttagtgatgtacatgattcacatgatgtgaggccaatccaaacaaaattatcaccacacaaaaccaacacatcctctcttcaaagtacaactgattgtaagccaaactctttggaactaatcatagtgcaacggcagagcgcctacagcttccaatcagttgacaacacggggatccctctgctctttacccagaatcgaactgtttgctatggaattgctgtgaaaaacctatgaaactcagtgttccaaatggagctataatgttcgaggatcaagattctactacaaagccgctttccagttcatttactaacaagctaacatgatcgatgattctattctaatcgacgaagcagtaaagcttacacacaaaattaacgcgctgcgaaggattgattacgaaattaactacttgctgatttttattacgggaaaatgcatgacgatgctaaattgctcactaccgtatatctatgagacctcaggagtgagttggatcaacaattttctctcaatcgcaatcgataaattcacaatcacacagccagcgagaaaagataaaagggcgagagctccgcgaggaaagctaagtagggcgagggaaacctgggaggccttgtcgatgagctcctggacgtagttctccccgaagcagcggtggccggcgtcgtacacgccgcggatgacgcccaccggcttcgtcttgctcaccgccaccacgcgcacggactccggcgcccgccccgaccgcgccgccgcctgctgcgcgcgggacagcaccgaccggagcgccgccgccgcgccctccgccgcggcaaccgacgccatcgcccccgacccctctccctcctcctccgccgtggccgccgtctccgccgccgccgctggtgttcggtggatagtccgccgcctccgcttcggatggagagatcctttcaccttaattcacatgagttttgagtcactgacatgtgggcctggtatggacctacatgtcagtgactctaggtggtgtttggatccagggactctaactttagtccctctatttagacactaatttagagtattaaatatagactacttacaaaactaattacataaatgaaagctaattcgcgtgacaaattttttaagtctaattaatccataattagagaatgtttactgtagcatcacataggctaatcatgtattaattaggctcaatagatacgtatcgcgaattagtccaagattatgtatgggttttattaatagtctacgtttaatatttataattaatttccaaacatccgatgtgatagagacttagaagttttagtcccgtcctagtttttcttttcgcttcttctcgaacttctcgagtttatcttttcttttttttagaaaacaagagagaatcgtgtggagggagaaaaatatacagaggtgcgggaacactctggaccgtgcgatatgaagtgaacggataagattgatcccccaccatgcgaaaaacaaatgtaaaaagaaaaaaaaaatccccttcggcgccaagctgagctgacacctccaagtccaaccaactcgtctccgacccaacggcaacgttttttttttttaaaaaatagactttttatgctttaattttattaatagacattttcaaaaaatattttcgaaaactgaacttttgcgtggcagcattgtcctgccacgccaacaatggtgacatgataaaagttatttggccacgctagacgaacagacgtggctaaaagtttcagattttaaaatacttttggaaatggtatattaataaaattaaaatataaaaactctaaacaaaatttcacggcaatgggaatcattttgaaacaaatcaaactgaaaatccactcctcaatcttaaatttttccttagtataataggctaattaggtccaactacataggaacttcttcgagctaaagccaaacggtttggcttggtcccgtgggaacaatgtcgacttgcaccactcctcttccctagggccgctctggcgagcaaaggaagcggcaacgatggaggggatccggtgatgggacgacaacaaaagcggaggaggaacacgtcctatgccttagtgcatccatcgattatggcaaacttagggtgcgttcgttccatggacaatgagtgagatagcacatcgttttccgcgcgcacgcttcccaaactattaaatggtgtgttttttgcaaaaaatttctataggaaagttgctttaaaaaatcatattaatccattcttacaatttgaaatagttaatactcaattaatcacatgctaatggcttacctcgttttgcgtatcttcccaatcttctcaatcccctattcctcaaactcacccttagagaacatggggataatggaacgtgctatgaattgaagctcgggttattggataaaggaggaaggtcgatggcgagttacgagtggagatatcggctgacttgaggtgtgacaacatgttcccagcatggggaatccattttcgacgttgtggaaagtggatgagaactatgtgatggctagtgcagctaaagtgcagttgggagtagaggcatgccttaatggtggactccacaatggtggagatgaagggaaaagggagggaaaccctagcttcggcgacacgaggaatcgacaagagattgtatgtagcgatagaaggatgagatgtcttgaccctccggattggctaatgccgatcaagaaccaaactagaaaagctatccactgcgtgacggagaaaaatatagatttatacctaattaaaaaatacatgtaaacatagagatttagtgatgctaacaagagcttgtgtgttgcaatggaaaacaaatgattttgtagcttattaagttaatcctatcttactataaaattacagcccactagtataaagctcgacatacaaatataccacctcaatggtggagatagggcccggccagcgcgggcaagtgcccaggctccaccactatgcagcagtttatcagcacttagttacaatgtttagtcaccagctaatcagcatacaatttataggtaatgccctcttgcacgtgaatcttcttgttgattaccatgcttaactaaatgcctgttactttcagataattaattcaatttcacaccatcacaattatgatctaaagataaaattatataactttctggtatcagtcttatttttttttcaataagatagtacaaactccatactctagcctatatagccatcatctcattgatatattctcataggatttcctctcctaaattagaactcgatgaccgtcaattttacatacgtatatgataaaaggtatacatatttgaattgatttatgtatatttgtttttcgctgttagacttgcccaagctcaaaagtattcctggatccgccactgtgccactcatcatccactagcaataattacactgaaaaacttatgtaagcatgcaacatcatctataattcattgaattctataaattaacatacaatcatctttctttatattgttttttataatgtttctaacatcctccggacaacataaacttcttttattttttaagtagatagtagatagaagtagaactgtagaagtagatagatagatagtataaaagagaagagaagagaagagaagagatagagataggctgtgtttaattctcttcaaactttcaacttttccgttacatccaacgtttgaacatatacatgaaacattaaatgtgaataaaaaaatcaattgcacagtttgtatataaattgcgagacgaatcttttgagcctaattatgccatgatttgataatgttgtgctacagtaaacatttactaatgacatattaattagacttaatagatttatctcgcagtttataggtgaaatatgtaatttgttttattattagtctatatttaatactttaaatgtatgtccgtatacgttaatttttttttcgccaaaacaactcaacacggtcatagagatatagaaaaggtcgtgttggatttaggcatgatttggttcggacttgttgattgggaggaggcttgttagattccacccttctttttttcttgggggtaagaagaggaccttcactgttggttccctccatggtgtctcccacgaaaaagaagagatgtttaggcaaagggatggacggtggcgccggcgatggcggctggtccaccctgagctacgacgccgacgtgctccacatccaccaggtttgcgcccattggcgcgcctccacggcccccttggctgccgcccggccatggatcgtggccggccacgagacgtcgcgcattgtcagcgccatcggcgaggactactccttctggctcccccatggcggcggccagaggatcatcccctgcttcggcgacgcgccgccggcggggctcccgtactgctgcggcacgccgcgcgggtggctcgccctggcggacgcgccgcgctccccgacgcggctcgtcctctgggagcccgtctccagggcggagatcgcgatgcccccgctgccccgcgcggggttcgccccgcagatcttcctctccggcgaccccctcgccgccgcggcctcgccggggtggatggcgatcgccagccagcccttcagcgtcgcgggcaagtggcagacgctcttcttctggcgccccggcgacgccgcctggacgccgcagcgcgagccgccgatggacaggatcgacagcgcggcgttccacggcggcttcttctacctcaccgtcaggtactggtacctctacgcgtacgacctccgccacgacgccggcgcgccatggccaccgccgcgcgtccgctccaccttcgtctacctcgacgccgaccgcgcgtgcgagctgtccaggcaaggccgcagcctgcgcgccgcgcacgtggtcgccgccgccgacggcgtcgacctgctgctcgccgtgctctactgggaatgccaccgccggagtgtacagatggtcgccaaggtgttcaggatggagtgggcggcggcggcggcggacctcgagctctcgccggtgacggacctcggcgagcacgcgctcttgctgggccgcggcgacgcgctcgcgctctccgctgcggagttccccgcgatcaggaggaactgtgtctacttcgtcgagcacgacaatgccccgcatcggcattgggctatcgccatggatttaggggcaaatgcttcggagctgattccgcatccacaatttcaggaagatgagccaagcgaagaagatggcaaatgcgccgccgatcgctccttgttgccgtattcctggttttgcctcaaacaacccttcttcaagcataagtgacatggccttcgccatcaataattgacatcattgactttactgtatacttcctctgtttcacaatataagactttttagcattactcacattcatataagactttttagcattactcacattcatatagatgttaataaatctagacatatgtgtgtgactagattcattaacatctatatgaatgtgggcaatgttagaaagtcttacattatgaaacggagggagtaaatttgatctattatggcaagtacaaaggtagagaccgatatggtctctacgttaattagaggctatcacgttacaatagttaagacaatacggtctctaatcattaatgtaccaaaatactttcttactagtcatctttcctttattagactcaatgcaataaaaaatttcctaataaatgctaagagtcgactctatgctgttgtcatgtgtagcaaccatctttctcttttcttttctctctctcttccacatcaccaaatatgcttgcatgacaataaagagagaccgctaataaagaccattgtacatgcccttagtttcatcaaggattctagtgattaggaaactatggaagggagatttttcccttctatgggaatttgttcccaagtagagttgtagagggaccaagcttaagagtgttttgccagtttgccggtttggtggtttgggagaatgcgaaagaatcagcatcttactcctgacaattcaatttgcatctgtaagtacaaaccaaagcttgtgacataatttaatttgaaaccggattaattcaagtgacatgacctttaccatcaataattgacatcatcgactttactgtgtaaaatttgatctgatagtttcatcacggattctggtgattaggaatctaaggaagggagatttttcccttccatatgggaatttgttcccaagtagagttgtagagggactgagagtgtgtccctagctagcttaagagttaagagtgctttgccggtttgccagtttgggagaatgcggaagcatcagcatctactcctgccaatttcaatttccatgggtaagtagaaaccaaagcttgtgatataatttattgtgaaatcggattaattcaagcgagtgccctttcctttgatgtggttattttctcttttagtttctctactgtgtggtgagcctacaacatctcatgtttcattggtccggtgatggtgtcgtatactaactgaaacaaatttatatttgctagtattgtcatcctctgtgttaaagaaaagaaataaaggcatttttattcaatttttgtgttactatcctgattcctgacacaagattgcatcgttgcgtagagctatcccagcaatatatcctttgtaaacacagtgagcaaagtgaattctttagtcttcaaatgaagtttgatttcccttggtcttctttttttgttgaaagaaaagagtatatatttgaaattttgtactttcagtgccttgtagaagaaatttgcagaacttgtccttgcttatgtttcagtcgttctaggagtccaagttttcccaagatcagttacattacaggggtttgagagcacagaagccctttgcttagtctggacatcagtttcaagtctttgggcactgtgataggatatggtgaagagatgatacattatgttggctgggagaaattccatagcaacaaatgagatagggatattgttcaatgagctgtatgattatatttcatctcaattgattttccattctaatgagtgaactaagagccgaagacttttctcgatttttcatcaatgcatccaaagaggaatcaaggtcctcataaggttaagtttttttgtcaacaagcagggtggctcaggaagcaatggattctctccctcagaatctcagatgttaaagcggtgtgagtaaggcgggtaagttcgctgacttgtttcgttatgtctgattgcttaatgctgttctaagttgaccgctctgcctattttatgtgaccatgtagatgtgagaataatcttcagtagtggtgaggcccttgtgcaggaaaagggcaatctcaatatatttgctgaataagttcatgaacacatgtcccatatgttcatggtggtcatggtcattgactcagtgcacaagaagttacatgaaaccttcctctaaagttcattgatgacagcggttctccttagcttttgttttgcagggttttgaaaccatgttcaggtcagcaattcccaagaggatctgcttcggtggtatgaagaaaaaaaatgccaagggccatcctattatatctcatgcaactgagaggtgtgctgctggtgtcttgcaacctgctgggcacttcaaattaggtcctaatgaattcaaagttctatacgaaaatttgacattttaaccctttcacaaaacttattctataaatgaaccatgacaaaaattataaccaaaagtaggcttctacctcaacgccatggactttggcgttgaggctcaacatcttagcgccatatttcacggtgtcaatgtcaatgggcttgacattgacatggtgggccgaagtgccaaggcctacggcgctgaggtaaaggtctatttctgattttagtttttaccaaggtctagttatagaataactttagtgaaaggatcaaaatgtcaaaattgtggtgaagtctagggttagtgtactatgtaatataggagaaaaccgaaaaaacccactaaaagttgatggagcagtgaaatcatggtatcatgcactgaacccgccaataggtcggttcaatccaggcttaaatttttcttggatcgaagaggcttgctgggtccaagtccaactacataggaacttcttcgagctcaagccaagtggtttggcttggccacatggaaatagtgtcgacctgcaccactcctctttcctagggctgctttggccgagcagaggaagtggcaatgatggaggggatccgaagatgtgacgacaacaaaaaacggaggaggaatgcgtcctatggctcagtgcatctatcgattatggtggccagcttagggaatatggggataatggaacgtgccatgaattgaagctcaggttattggagaaaggaggaaggtcgatgtcaagctacggtggagatatcggcggatttgaggtgtcacaacgtcttcccagcacggggaatccatttgcaacattgtgaaaagcggatgagaactgtgtgatggctaatgccaataaagtgcagtggaggtgtagagacatgccttatggtggactccacagtggtgcagatgaagggaaaaatggagggaaaccctagcttcagcgacgcgaggaatcggcaagagattgcatgtggcggcataa

SEQ ID NO: 68770 - DNA, 14563 bp, Oryza sativa
cgccccgcgcggtgagacggcggctggacaacgacctgcgtggccggagggcagcgggacggcggcgtgcagaggccattcgcatggaagaggatgagggagaagaaaaggggaactttagtttgggttggcaggggcattttggtattttctaaaaattctgacaacacaatacacggtttgagcaacgtatctaatggaaacttaacgggaggggcatggaagggatcaaagcgaaatttcaggggtacacagaggatcgtgtaaaattcgagggtatagaagggattaggtgagttttcatgtgtacacaagggatttactcaactgcaaaaccagataccgggcgtggctcaacttacaaaaccgttcgcttgaggtccttcggtggttttgaccccggtgagtgtggccgtcagtgtggccggcgagcgcagcgggccaatgggctaataaagatgcatgttttgctaattacatgggaacaagctttacctatctgcttgcttgtgccatattatttgatatctgtcctttgtcaaccttgggtaataaatcgactagcttgtgttactttgatgacctagctagaactatatgcttagccatgcttaattaccactaactcagttgatgggataattgtagtattatacctttttagtatcacgacgagttgcgtgctcgagacatccgaccatgtttcattggtcataattatccaactaaaatgtgactgaatggtgggctatgggtgcatggttttgctagtcgcacccatggcaaataagaaccggttcgcgggatgcactggaagacatacaacgcttgccacaagcgggaatgggtaacttccagacttgaagtatagattttctctggctgacgcatccaggcgagggtgggcgtgatggagcgggatgggccctgcgacggcctttgtcgcttccggattcacctaggaatgagagtggactgcccgctgcccgtggggagtgggggtgaaacctgaggtgtggtgtgcttggtcagagggggttatatgaagggtcttgtcacaatcactcgacatggtgatgtgtttggccaggtgcgatgacatgctggtggattgtgtcttgtgggtacagtggtgcatctatggccagagtaaaactatttgaatagccgtgcctgcggttatgggcgatcgaccagaatcaccatgattagtctcacccctaacaaatcgactcaatacactgtaattcaggtaggttggttgggcctgttcagcgtggtgtagcattgttcagtggagatataatgttaccttaattaatcaactgttttactgttttactcaataaaatgttttacaaccgcctttatgcaaatagccacaagccattcttgaatcccttgcacgtctgcatcgtttgtgtggcttgctgagtacggtggttgtactcagccttgctattattcccccttttccaaaagtgtagtgcttctgagctgaagacgaagttagaggaccaaggctcagacccagttgagttttgcctgtggagtggagctgaagccccgctatgatcgccttttccgatgctgctgctttcttttcgatgtgaggactaagtgcctcttctgtaagtatttacgctttatttacatttggaactgtgtattacttatcgttttgtgtatcatggctggtcttggacaggggtttaatacacagaatagtctgaaaatttggggctgttgatggtccttaaatcataatatctgaccgtcaataccgggatataatgaaataaaacatagtatccaacttagttgtaggtattattactaatcatttccactagtgttggtgaaatatgtgtatgcaggtaatttgaggagaaaatatatccgtcgtgtgacaaaatgcacctctgcgcattcaggacgcatttacacggtttagaggcccaataagtcaataaaaaccatttagaattgggccaaaacatagcccaggttattgggggcccattaagcaacctaccggccaaaggagaggccgggaggacactttttgggttcggccgaaccaaccagtttggccgaacctgttctgcggctgttcgccatctgcttccatgtggacagcttggattccttcccagaggtggttgcagggtgttttggacaattcccatgcccctaaccgtcctttggagcctatataaggaggagcttactcacattcgaacacacacaactttgagttgaattacgagaggctctattgtatcttttgtacattagaataaggtagagagtgaggggaagctctggaggagtgcccggaagtttggtgctaatccgacttctacctcgacgagtgtagcttcctaggaggaattctggaggagtaccggagctgtcggtacactctgcgccgggttcggagaacttcttcttttaagtaagcatttgtgttcctttattttgttatttaattatttagtctgagtaagatatatttccatatttgcgggttcattgtttagtattcgtactaagtgctctagaactaggactctggatagagaaagaggttcctacgcaagtattagagtagtaattaataacttaggcgtggtgtctaggttagggactacctttgtttgttgtgtatcccacggatttgtcagaggtaggcgataggtggtgacagcctgaattccgtcccggtaatcctccacgttcggatacatcatagagctatagccagaaccacgctggcagaccagcaggggtcggtgcctgaagcaatagataggaaattatctttgcttatcttagataattaaaacacatagaaagtcctctctagcctgcctacctttagtttttgtccttggatagtcttagccttagatagatttcacacgttccctgagttcgatatccttttggggtcaccccattagttgttaatttatccaagtctaggtcatccttgtatctttttttttatttcttcttcttttattcctttccatgatggagcaacccacaattcaaaacctttctgctcctcgggttgatctttttgagccatcctgttcttcacaaccaatcctatccgatggctacgaaatcagtcctggctttatagcaaggttcgagagaaaaccttctctggtagtatcggtgaaaacccatacctccatcttcgggactttgagctagtgtgttcttgcctatccatgtcgtaggcatgacacatgaaacttttaagtggaaattgtttcctttttctcttagagatgaagcgaagcaatggtacaatctgtctgtcaagaaattccacggtgaatgggaggagcttaagcgaagcaatttctgccttactttctttccactaacccgtgtaattaatcttcgattagacatcctctctttccgatagaatgagaaggaatctctcggtgctgcctgggccaggttctcactgttaactcagtctggcccagacttgtctttacccgaccatgtgttgttacaacattttcggtactgattagacaaggagtctgctgaaaatctcgatatttccgccggaggatcattcgcacacaagacaactactgaaggaagagaactcttagatatgatcttagagaacgattctttcggctgaagcgaagcaatcccagaggtcgagattatccatgaggaacctctgcacgtcgagtcggaatccgactctactgctgaatcctcatcccagtcgcaggagccggaggaaaaagaaattcatcctccggaaaatccattcaattcgaggaggatctttttgatgattgttggaacacctcgaattattcctacgacaagagaccaccgaccaaggtcaattctaatgatcctctcgataaagctatgcttaaagagacggtgaagaagttgaccaccatcatgagtaacaaatggttgaggggaggagagctctcatgagaagcaattcagatccgatgcccctcctcaaccgttacgtgtctcattggagggaaattggtccgtgctctctatcccatgacatatagcgagtgggttagtcctgtccaagtagtgcctaagaagggaggcatgacggtcattgaaaacttgaacaatgagttaatcccacaacgaaccgtcatgggatggaggatgtgtgttgactataggaaactcaacaaggctacgaagaaggatcactttccactacctttcattgataaaaatgcttgagcggttggcgaaccattccttcttttgtttccttgatgggtattctggttatcaccaaatcccatccatcccgacgatgaaagtaagaccacgttcacgtgcctatacgaaacgtatgcatatcgaagaatgtcgttcgggttgtgcaatgcacccgcgtcatttcaaagatgcatgatgtctattttctctgacatgatcgaggatatcatggaagtcttcatggacgatttttcagtctatggtaaaacttttgatcaatgtctggagaacttagacatggtcttacaaagatgtcaagaaaaggacttggtacttaattgggaaaagtgtcacttcatggttcgtgaaggaatagtcataggacatcaaatctccgaaaggggagttgaggtggacagagcaaaaatcaaagtaattcaacagcttccacttcctgtcaatttcaagggagtccgtggcttcttgggtcatggggggttctacaggcgcttcataaaagatttctccaaaatcgctagacccctaactactttgctagctaaggatgttccatttgactttgatgatgagtgtatgtagtcctttaaaattcttaaggaatcactcatctcagtaccaaccccttgattggtcgttgccgtttgaaatcatgtacgatgcaagtgattttgctgtgggagctgttcttgggcaaactaaggataggaaacgccatgctatcgcatatgctagtaaaacgttgactggagctcagcttaattatgccacaactgaaaaagagctcctagccatagtgtttgccatgataaattcagatcttatttagtgggagctaaggtaattgtttacactgatcatgctgcactaaaatacctgctcactaaaaaagatgcaaaatcttggctaattaggtggattcttttactccaagaatttgacattgaaattaaggataaaaaaggagtagagaattctgttgcagatcatttgtcgcgtatgcaaatcactaacatgcaggagctaccgataaatgactatctgcgagatgacatgctgctgaaagtaacatactctgacccgcggtatgcaaccattgtgagcttcatggtcgcggggcatgtgccaccgggagaaaataagaagaggttgatctacgagagccacaggcacttgtgggttagatagcgatattgccagagattatgtaagatatatgataactcgatgaattacataaacaagattagagtgtcataaaaatggaagcactaatcccgagaacacaagctgccataacaagttttacctcttgttgaagatcgaaaccgatgcagctcaacccgaaagcaagaactcgtcgaaacaaaacaaaagtagaaagggtggcgatgcgccgagattgtattgaacatgtgttagtttgtttacatggggctcagggtctatttatacccgagaattacaatatatgtccatatcggacacgactattatttctaacaaactataagataccataagtctttgcggcagacttttgcccaaacatatctctaaggaaattacataaaatatcctaattaatagatacagttgccttctcaggactctatccatgcgtggcaatcatcatgaagcacgtcaacctaacccgacaacatatgccatgtcatattgtcggactcggctcaatcggctaaccctgtccgactcgaactctaccgatcttagtcatagccgattgggactttagccgatcttcactctatttccgggacaatctctatctcgatttccatctcgattcctcctttacatccgatccttgaattaccaaatttggtcgttaacaaaggtatatgtactctctctcagattaaataatctttggcacgatggcttacccttacccctgattcccacgagacactgcttctccttgccttgggctgttgaaagacagaacagcaattagagcaccaatcacccgatctttattcaacttttgttccggaagttttcaaatgattttgaaaatgaaaaccaagttcctcaagtgattcactcagtctctctaagtgtatcagcatgatttcatcaccaaatgttgccttgttgattcctactctaaggttttgatatgtggagctcagtagggatcaaacatggcatacttgcattcacatttatcactaagtcaaaaacttagactaaagcagataactaaacatactcaagatcaagatcgtgcataatgtgtgtgtggtatatagtggaaacggtatatgaggaaaaataaaaataacaaaatgcttctcctttgtgctttactttcttctcccagaaatccttcttttattaattaggagagggcatggctacattttttttcaacatcatgtcatgcttgatggagcataactttattatttatttttttttataaccatgcatttccctcctctcttttttttcaaaaggatttttctttttaggagaagaaagcacatggaagcatggagaatttattttggtggaaatatggaatggaacaaaatattgcttagctcccagtgtaggagtttagcatgtgcatatatgtgggtgtatgatcttgatcatagagcatgagaagtatctacacaagtcacaagagtttgacaaagttcaatggaatggcaagcaaccaaaatgtatatggtgtaatcatgatagcacatttttggctctggtaggaatttatatcaaatgaggaactttcaatttatcattttaaaaaacaaaacatccggagttcaagtcaaactagtatcaggatcatagctactcatatttactatctcatatctcgcaacaacctagacttagatcagcaagtgtagcccatttacctcaggttcccagataattgttggctacttatattcaatctttgagagagtacttaccaagaacccatatatcagagatataaaacagagcaactattcatcatttcaacaaagagaactagcttgtcttacctagcatgactcaaacctatcctatctttttggtattttctattttgcaaatttttattttgttttcaagttttataagatgcaattggaaagcaaatatgcaattggaaaggaaaatatgcaatgtgatacaagttacctcagtggggggagcgatgtctccccccaagcttggctttcgctcagggtccttgataaggattgaacccctgaaagcgaaagtacgcctgaaggtcatcatgctgttgctgcatcatgttgttgatgttggtgaactgagcatcagcagattgttgccattcttgcgtttgagctatgtgttccgtgaggttgtattggatctcccccgtctgcacatcaagggtgtccattctcctagtgatttcacccaagtcctaacgagaggaactcgagcgccattcacttggagatggaggcacaccacttgatctggaaggttgattgtctccccagtggatgtcatgaggcgcatgccaccggtcctcactggcgcttgcccaagttgagagtccatgctatagcgtagagcttgggtccatccgggtgcatccccagttggtgcccaacctgcctcataaatctacatgggtatcgaggatgatgaacttccttgttcgttccttgtcatgttgcgcgtctccatgtatgttccacctgcacgagattcttctatggtttgcaggagaatggttagttcatggcagttgtacaaatgataccctgcatttggcaacgggatttcatttgtacaaccggggaaaaagtatatcaaagatccatatgctacatgtttcaaaatatgcccttgcactagataggcctcatcaatacgcggacgagtggctgagataaaaacaatttggtcgctaacaacccctagcccttttgctatccgagtaatcatagaagtgcactcaacaggagtagagaactttatactttctaaccattgccttatcatacatttcgcaggagaaattttgatctttctaaccatggcaaacatgataattaattcatctcccctaatgggtctcagatcacttctaggaaacaaagtcatagcaatccatttgtgcatgagcctaagtgtaggattatggatatcatttgttctaggtttcttgcaaattggagcaccaaaaatatcttcccaaaacctatttttctcgaacccagaaattcctttctggagatcgattttacaggaatcgtgaaaaccaagaagtgtactcaagcctttccatgtgagcgtgaactccttacggaaaaagcgaaaaaaaatatcatcttctatttctttcaaagtgcatagaaattgcaaagtaagcaaacgagaaccgggttcatctaccacagcaaatctctaccaaccaatagctttccaaatagaacgaaattcaacatccatacctatctttttcagcaactccggtgagtattctcgcgtgtgagcatactcccggtcgcttcgcatgtagtaggcttgtctctcccgatcactgacaaggtcgaggtcagtgtcactcaggagttgtcgcggagcgtcggcgtcttccatcgaaacatccgctgatgaacgagtgctagactcgccatgatgacttgatggagagcctgaccccttgaacagacgagacagtcgcctcctcatactgcacaatggagcaagaacaggctaactcggcgggggttagaaatgacaagagtttcacccatcggttagtttcaccaaagcagcttgtatatatgcaactaaatgatttgaacttgaggaaaactatcaaagcatgaatgaacttgagagcaaactttggagagggaatgaaaatgtgttgaaatggatggaattccctctctcggccggctggcttctatagggtacccacaacggtcagaaatgacatgtgggacccactagccgttaccctgccaaaaatggaaggaaaccgttgcctggccggttcggccgaacccctggtaggcccaaccgaccccactttcgttgaaaattttattttggtttcctccgaaaaattcatttgaagaatttcctccaaattcaaaaaccctaaatgcaattttgaaattcaaatatgtggtgatgcaaaaattcaaatgttgaaaacaaatatgcggatacataccaatttacctgttggcgaaggtcgcgtcatttaaagtccaatgtgcaagaccatacctcctttcgatttagctcacggattttccacccatctccggaggtgatggagcgggcgtctttggcttttccctccacaccttatttgattttggtgcggtagacggcttcttctgagccggttgctctaacttcttggccggtataggtgattttaccggcatcctccaataacggttcctgttcattgttgtttccttttccaggaagttctgcatgaactttaccaggctatccgtcttgggtggctccaattcgaccacttgaatattctgcgggttcggtccgtacttgattctgaccatggagcattgttccgtccttggttgaaactcaaactcttcctccttcccgttgatatggaaacggatactccccgttcccacgtcaatgttggctcctgcggtgctaaggaatggacgccccaagatgagcggcgtcttcttccccgtgtccatgtccagcaccacaaaatcaaccgggatgaagaaatcctgtattttgtctggcaaatcctccgttatccctgccgggtaacggacggactgacgagtcagccagttggaggcatatcggtgttggtgccaacaccgtgaagttgagcttgtcaaagatgtctttgggcatgacgctgacgctggctccaaggtcgcacaaggcctggtcgatttgttgtgccccgatcgagcaggtgatcgtgggacaccccggatctttcttcttctccgggagcttgtggagtatgatgttgctgcaatgttccgtcagcttggccacctccgttgttgggagtggtctcttgttgttgagtatgtccttgagataacgggcatatgttggcacttgcatagcgtccaacaacggcacgttgatgtggatcttttggataacttcaacaaaacgagcgaactgctcgtccactgacggtttcctactccgctgagggaatggcagcaatcgtgtgtcgcagtactcctacggcacggtcttctctggctgaatctccttgttagccgagtcagtagatgacttttcttttgacatcccattagttcctgcagggttaggatactacggatcacgagtggacttacctcccctcgttgtgatcgccttaacattttcaatggaggagtcgggttgccccggaatcctcctagattcatttgcagggactaaagatgccaactgagctaactgggtttctatcatcttattaaagctcagctggttttgaaatgcggaagcaaagccatctagattcacatttatgttttctaagatcttatcattggcagcaagctttttgcttagcgcatcagtggttttagcttgcgcaaaatcaagattctaggttggttagaggagttatcgttattatttcctccttgatcatacgggcgtggttggttccactcctgacctccttgtggacgataccagttgttcttgcccatgtacatcacctcctcacaggtttccgggcattcattcccagaatgacccgtgccgccgcagacctcacacgtgacgtgagattccaaggccttaacggtgccttgtggccgtttctcgtggtcgtccaagcgtttcatgaggagatccagcttggcagcaagtaactccgtctccttgacggtgtgcatgcctcgctaacgagtctggagtcgttcctcgctccaacccatattggagaccatcttctctatgagttgaacggctccttgaaccgttttagagaagaacgctcctctagttgccgtgtccaagtgatcgcgggacatcggggtgagcccattgtaaaagttgtgcaggatcagccagtcgtccatcccatgatgaggacaggcggccacgtactcctgtagtcgttcccatgctttaggaatggactcatcccttgtctgctggaaactagaaattcgtccacgaagggcattggttctgcccatcgggaagaactttgagaggaatgccgtagagcatttatcccaattgttgatagcagtacggttggcatagaaccactacttcgctctcccgaggagggagaacggaaacagccacagcctgacggcgtcgggactgacacccttgatggtgtatgtgctacatatctccaggaattgctgcagatgagcgttggcatcctcattaggcttgccacagaacgggctgttgatcctgaggctttacaagacaagggctgttgatcctgatcctaggcgtcagagggtgaactatttgaagaatctgcccaagtgtggaaaggatagaatgatgagtcctgacacaatgcctgctgactctcaggatgacagattcaggaccttggtacaggttgattggtataattctgtgatcatgggaagatctcatccagtggtagagatgaagtggctagactggcagtacatgttctcgaagaacaacttagttttcaatgaggtgcgcaaggtgtgtgagtgcaagcacgtggcagatctgttggccttgcagtattcctagaatgaggaagtgattggtcagctctactccaccgctttctttggcaccaccaagaagggccatgattttgtgaagtggaccattcaggtgcagcagtatagggtctctatggcacagtttgctacagctttggggttagatgatgatgacctgaatcgtccacatatctttgtagaggatgctttgtcaccgaccagcactactttcttctatgagaaggatgctcccaaggattgtttggggactactcgtgggttgcgtccatactatagagtgttgtattctatcttcaggtggcctttgctccccaaagtgggagatgctacagcccttccaggtaggcatgcgctcctcctcagtcgtatgcgctacaacaagccagatttcagcatcatgaagcttatctggagtgagatctatgagacagtgtgtgagccaaagaggggctgcatctatgctccttatatcatgaagatgattaaggcaaagactgggatttgttatttcaaggacaaccaacacaagcctttccgtcctcatgctcccactacttcagctactccttctaccagggcaactcgtgcttctacctcagctgctccttcttcctctgctgcaccacagtgttctgagtcttcttctcccataaagaaggctctccgggctatcttttgtatgtgtgctaagaccgctaagaaggtgaagaagatagagaggcgtcagaaggaagattggattgcagtaggcaaggatgtctctgatatttttgatgatgaggagtttgttgatccttttgctgcttatgagactgctcgagacattgctagtggtgagggtccctctggcatttctcattccttcaatgaggagtcctcccactccgaggagagcagtgatgatgaggagtctgatgcacctactgagaatgtacctacagatccagatgaggcagtggacgccgccgggcaagacatcgactctcctcactccggcgacaccgagatcattccttctgatggcgatgatgatgaggcttgatcctcttcttcccttgtgattttgtctctttttggtgcctttatgccaaagggggagaaaattgcaatcgaagggggtcaaaattttgttttcgctgcttgctgcctgctctgtctatttatccggaagtttcggatcctcttatccggaagttccgaacttggcagctccctcgctatatattcctgttagcttgtccagaagttccgggtattttatccggaggttccagacctggcagtcctttggcctctactcgtttggacttatggacatgtagtaattctctaattgtatggatgtaatgactgttagatgctcttagctgctctttatatatgctgcacttcatttatgctatgaatgtcttatttgttgattgtgatgtgacgttgattttatccttttgaatgctcaccatgtcggatcttttgcatattatatctattcttactgcttatttgcatcccacgaatgagtagagatgaaggaaactctcttcgttttctcccttatatatatgcatatgagcatcactcatatcttctatatgcatacattaagggggagtttcattcacctctaaccattcaaaacaaaatttatttcaatcttttgtaagctttaaccatgttgtcatcaatcaccaaaaagggggagattgaaagtgcattaatccccctagtgggttttggtgattaatgacaaatgtggttaagggactaatgagtttattgagctactttcaggtgcattagtccaaggcgtggaagatggatgcttggagacccccccccccaaaagtatagaatcaaagcggaccggaactcgagaagtgcattggatagtttatttaattgcaattgagttttaggaaaaaccgtactattaagaggggttccaggtggtgctctgagatatgtcaagtgctcttagtgtgaaccaagtgtcaaagtttccctatgagttatttttgcaaatactccatctgtccaaaaatgcaagtccagaacttcctatcttccaggtccggaagttccggtctgatgaaagaaattttcctaagtgttatccggaagttcctgtcttccaggtccggaacttcctgtctagtttccagttcaaaattgtgagtaacggctagatgacgtcacctagccgttatacatatacagctcgtttccagctcgttctttggccattccactttcacttttcaaacctagaactgttgctagcctctcccaagtgtttcttgccttctccactcaatctaaagcgtaatttttgtgagaaagacagattaaaagggagagaagaagatttggacaggtgtcaagactaggatcttgggtgagcacttggaatatcacatgggctgtcatctcggtgcttgtgactcttgaagatgatctcctatacggttaggtgtcgcccgcaagcacccatcgcatattgtggatgtcccgggtaagtttgtgaaggatctcctctc

SEQ ID NO: 68771 - DNA, 6905 bp, Oryza sativa
tggaaactctctattatgggaatacgttttattttttattccaccaaaaatatttcacctagtgtacttataatgtttcactatgtatagacaaaatgttgcagcaaactaaaatattctttcactatttgctgaaacattatttttatataaggtgaaaccgcgcccgatttaaacgattgaaacatttttgatctactcagtgaaacaattccgatatacttggcggaacatcgtgaaacatttaaaaaaaatccaataataaggtaaattttttttcgtcggaatatatctgtggtcttgttttaaagatttaacaacaaattaatggtgtaatcagatcatgatttgcataataaataatttaagagaaaaaatagtttaaagtggttttgcacgcatgcatcatactaacgtcaacatgacgtgggcgcccgatcctaagttgcgtccaattcatatatgtagctcatctgtattgcaagttgcataatatctgcacctcatcagtttcgtggtacgcttggcatggctgaaatatagaaataaagacaacaaaacaaagtaaagagatcccaaagtacatattaagaaggcatactgttgttaattccacatttaaaaaatttgagcctcttcacctacgtaatagaatggagatatctggactaacttcactttcagtagagcatataccatataataaataaaagctaacagcgttaggaaataacttaaacgtaatgagacggtaagtggtcaaaatatgttacgtgattctatgatcctgaactaagtttgatgtttatctaacaaaatggtcctctcttccttcgtacgattcattagaaacttcagatccaaacttgaagatcagatgtccctgtacaacagaaaaacataactcataagcttgatggatattaggttaaaaaaggaacagatggaatctcaggaatagaccaaataatttactatgccaaatagataacttcagacaaacatcacaaacatgaaacatatatttgttggtgaattggaatatcacttttcctggcatggaagcaccatgtatttagcaggtgctaagattatggagtcttaaatttccttcgaaatttgttaacgttactagtaatactcgagggttcagatgttggaactctaaaaaagatattgtttgaaaatagagtaagtataagcagaacaacatttgtagcctatatgtcagtgaaaacttccaaactggctagtttgggacaggagacaccaaccgccaaaacatagctgtacaattcttaaatatcaactgttaagtatcaattgccattacaactgaaggtagtaaatccaagagtaaattccctgtgtacccctgaaaactcactcaatccctttcatacccaatccctttcatacccctaaaatttacccgatccttctgtacccctgaaatttcaatttcaatttgattccttgtatgcccccactgttacattttccatcatttcattgtgaaatttcaatttcaatttgatttcttgtatgccccccctgttatattttccatcatttcattgttacgtttggttgcaaatgtcatttttacccctgatgctttaggtttaaatataagcttcaaaaacaattgaaaattttatttgagtgcacagtatgtgtattttataaaactaatgagactaaataattagtgcagaaaattttgacataaattttgaaaataaaataaatgtaataaattaaattttttatttgaaattttaataggacaatggatttttttatcgggagcattcataaaaaaaaatgttgtgaacatgggtagtcctatctttatatgaatgctcctcatttttatgacttcttttaaaaaaataaatacgtattttttatttcattatctaaaaatatcttttgggataaataatacatcgcacaacaaactcataactataatagtctcatgcgagaagcttttatatttttaataatgtaattcatgaatttctttgttcatccaagggtaaaatggtcatttttatagaaaatacacggtcaactaacagtcaactgacgggaggggtcaaattttgggggtacacaaggaagtaagcaaaatacaagggtatagaagggattaattaggtaaaattttaagggtatataagggattttctctaaatccaaactagtagtatgaaaaatagaactaggaactagttcaagaatcttgattgtggaaaaaacattttgggatatgcttgacaacaggataccaataaactggaagctattgactttgttcaagagtaacctgcaccatttgcagcatgcaggacgacgcactacaggaaccgttatggatcaggttgcttatcaaattcggtttatatttgcttatttcttgttgaggattattgggatgggagctttattaagagtagcaaaccagcctcttttacaaggatggcttctattcaataaaggacatccggctttgagtactggctctgggaggcgagggatttgacctcgccctctggttgatcatgactacctttgcgcaacatttgtccacccccagcgcacaaggtgaattccatattttcagataaatcttaattcttctagttttgaatgattccattagctttgcataaagaaatgactaaaaaccttccgtaaatgaacgggggagaacaagagtgcatcatatacgcagccaacctccacattgaaacgaaactctaaaggttaactcagtaaaatcctctaaacagttaggcatcaaggaataaaggaactcctaaaaaaggggaacataggaagggagaaaaggttgcatcatgtatgcaagcgcaaataaatgtaggcagcatccacactgaaacaaaactctttaaggtttgaaagctgaaaacttggtaaaatcctctaaaacatttaggcataaaggaagaaaggaacccgtaacaaaggggaaaataggtgtactccatatggaactgaaccatgtttacacctctacttgaacatgactgatggtgagtggcaacaatttctgggcatgtcaaagatattagattccatatattgccacttgttgtgttgtgtttaattcaccagcctcctttctaacatacagttagctgtctgggtgaaatttcaaagttcctgaaataatcctaggaatcaggaactaggaataaattgcttgtactcagttacaaatgtaccaatgggaaaaccagagctgttggctagcatcagcggttcttgagcagcaagatataaacagtgatgaccagataacagaattcatgaaataacattatgtagaatgaagtgcaataatattaaaattgcagggtcacacccctgcagagcatacatgtgtgcagagtcaaaacaaaaattaagacagggagagagacccaaaacactaaatggataaaaaaaagttattgctaccatgcaacacaattattgacgcagccttaggggccaacattccaacaaggtgtgtacaccaatatataagatgtgaaggaccttggtaagtggtaatgtggtactgaacccaagcaattgctgcataaatcacataatatggttccacattattcagtacaacatatgagctagatttaaacttccttatttgatatcaccattggaagtttggaaccaaccatactatgtaagactcaatgttgaaaataaggactagtgaacagcaaacctactactgtgcatgtgacacctatagaccaggagctgggttttacccattacggccatgtgtgccctcaaatgtttcttatttctataataccgaccaaaaagcaatggaagattcagaaaaaataataaaattttgaacaataggcatccatgtttccaaaatttcaaattattgcgaaggaaaaggtatagatgagacactttaagttagactcaatgttcaagagtcagaattgtgagcatacagcaagcctacttcacctatcacactattgatcaattcaaaactaaataaatctatcagaggcatacatttaccaccttcgtttcagcataacgatagcgcatttgtcaatccacaaaatcgaattaaatctacaatgaagagcgcaatgtctcaagccaaacttgaagtaatgagattaagaaaagaaaaagaatacccttttcacctgtagtcgaaggatggaattggagggctgggcgtctcgaaggactccaacacgtccgacttgcggtcaccaccagcagcagcaggcttctcctccttcctcccgaaaattcccctaacccatgcgatagggctcgattcatgggccgagacctcctcaggcggcggcaccaccgggaacgggtaggcgtggtcctcctggggaagggtggccatggtgcgggtgagcaagatgccggcgccctcgacgagcgcgaggagggaggcgccgacgagggcggacgtcgcggtggcgcgcgggccctggcgcagggagaggacggcgccggtggcggcgccggcgaggatggagttccaggggtcctccttctggcgggcgtggaccatggcgcagtcgaaggcggagaagaggccgccccaggcggcgaagttgccgccggtgcgcgggacgctcatgcggacggcctgggagccgccggagaggcggtggccgttgggggagttgtacgcgcccctgaggaagtggaaggcggtgccccccaccgcccccatcgcgaacgcgccgcccacgtcgtccaggatgcggtccgggcacggctccctctccgacgtcgtcatcctccccactcccgctcgatcggtctacggcggcgacggcggcggcggtcggcggcggcggaggcgaaacctaggagaggaggggagagttggcttggatgagaagttgatgggcaaagctaaagcttatggtttatcggttcattgatcacagcgtgcggggctttcgcttctcctcgcgcctgtgatgggccagggcccaccaaagagtaggggttcgaaatattttactctttccatgaacgcttttcctgggggccagcttgacgtgggacccactccatgctaacgtgggcagggcagccacgtataggatgctaatccaacgaaggttagcaagttggatgggccgcgcaatttgcgcggctagcacctaaacaaaatcatatatttttttaagtatgattttacttaaaatttattaagtatctcattgtcttaagagtttaaaagaccaaaccttattatccccgtgtttctaattttatactccctccgttttttaatagatgacgccgttgactttttctcatatgtttgaccattcgtcttattcaaaaaaattacgtaattataatttattttgttatgagttgttttatcactcatagtactttaagtgtgatttatatcttatacatttgcataaaatatttgaataagatgaatggtcaaacatgtgagaaaaagttaacatcgtcatctattaaaaaacggagggagtgttttttaaaagtcacaccagttactatcccttatgtcatctccttctttatttgcttgctcgatctaccactatttctattcattcgccttgtaacctttaaaaattggatattatagtttttagagtttattgtcacgttgggtttcgtttttataatttctagacgtcccgtcaaacgttgccattatactcctctatagcccgtccattgtctcttctctttattgtcattgagattttaaaaatcgaacataattatcgtgttcatttttactttctagaagtcccgccaaaccgttagtggcttaatttgccattgtacttctctacggctcgcctgctgcctcccttctttattgtcattgagattttaaaatcgaacatgattatcgttcttttttttactttttagaagttccaaacctttaaaaattgaaccttgtagtttttagagtttgttgtcttgttgggtttcattttttataatttttagaagtctcgtcaaacgattctactatgttcctttatggcccgtccgccgcctactctttattgtcattgtgattctaaaaatcgaacataaatatcatcggaattcattttttattttctaaaagtcccgtcaaccgttggtggctctgcaactatacgcctatacaccctgcccgctgcttctcttttttattgtcattgagattttaatcgaatatgattatcaatggttttttttactttctagatgtcccggcaatcacctcatttgcttcacggtctgcctgtcgtccatccttttaatcgtcattaggattctatttggtgttttattaatagtttttatatgtcgtatcaaccgccaccactctactcatttataggcttgttacttaatttatctcatcatatgtttatggtcttttttttccatagtcttttttttatcacaaattttaattatttataaattgtattcctaaatgaaatcttatttttctttttctaatttcagtttttttttcaaattttaattaatatcctattgttcttttaatatttttattttttattttcaatttcagttgtttcaaaattgtattcctactcgaactcacttttaatttttataattttggatattattttattttttattctgaattttaattaatctcatattgggttcttatatgaattcttctttaaatattgcttatttttaattccgaatttcagctaaatttatattgtattcctacttgaactctccttttatttttttttgctaattttggattttatttttatttttattccctattttaattaatgtcgtattaggttcttata

SEQ ID NO: 68772 - DNA, 52881 bp, Oryza sativa
ctccttgctcagtatatatttcttgccactcagaacatttacgttggtgactaaaggcatggtcacccactctataattagtgaagcaattaatagaataaggcacggtttgattagcaattcatgtatgaaacaacacagtttcatgacatcaacttcagaatactgggaaaataaacgaaactcaaccttcacctttgagtacatgtttgatgcagtaacaaattaatatagttttacaacaaaaccattagacccaataggtcaaattctgatgcaatagacttgctgaacagaactaagatttgttgtttgcataagtaaataaaatgtctgtagagaaccatgtttgtatttctacaagtgtcttggagcatagcaatatgatgaagtttattttgaaacattatcaatattttcaggatggtgtagcggccttgaaaaatatattgcggtgtacctgaaaaaaatatgccaaactcaatactattagaaaagactatggattggttacattttttcccttcaaataacataatgctgcaagcaatttactgggttaatctgttttgcctcggtttcccttctttttattagtatttttttatctcacaaagtgtacatgaatctttaaattctactacatttcaatataaatattccgaagcaacccgcgcaggatatcatctagttttaagtggtggaagcataagtaaaggtctggtcaaggatgaaactgaatacttgttccactgctgatgcattccaatatcatgtgcgtctcaattcttaacagaaagctattctacactatacagtttactctagacagctcagcaggagtcatcagtcttgaacttttttgatatcaagtgccacctagtcaacttaaatgaccttggaatccaactattcgcatccttcccagtaaccatgacgtgactcaaggggtatacatcatcgtggccacgttgttaactctttttaatgaaagaagcatgttgttacttgtattctagatttgccaaaggccgataaaccaggcctctcaatttctaaaatatagagcagatgcaaaaactataactcttgacaattggcacgctaagtcaaattaagccataaggggaagaaaaaggcacaaaatgcacaaattaagttatgtgactgaattactaaaacaagtacagcaaaaaaccttatggagcttcagggactaatctgcgcagctggtttttttgctttctgaatagtttcaccttccttgtatctcttgactcttcctgctaagcaagaaaatattaccacaataatatcagtaaataaaaatgtgttacatatattatccattacagattatatatacatgaacgcaatatattcaggtttggcacattagcatgatggatatgatcaagaacaagggtcagtttttcccccacagtaaccagaatgaggcacaaactgacattgtcgccacttctcacttctaatacaagagcaaagagcagtaactagaatataaccatataatacttgctgtaagacagtttttaatatggaagcagtaacatgctatcatacaaatgaagttacacacagaaatgaatcttaataggtcttgcataactagaaatggaccttacatgacaaaattacatatatacacaccaaaaaaaagggacaaaaaaaacaagaggaaccaaattatccacgtttcctttctttgcagacctgagtaattcacaacatacatacagatgatgaaatgcttcagttatactggcaatcccacttcttggttctttttgcaacaaccaaacagcgagaagagccaggtccagaagcttccccgatctgttttcttctggtttgttcctcttgcagcattcaaatcattcatatacttgaccacagcctggcatgcagaagaaacattgttaatcatttaaagaaagcgaaggactaagtaagcaaatatggcagaacggcagtataatgtgtacctgagcccctaactttacaacttctcttggtggaaattcaagtggagtctcatcagcatgaaatacacgtagcctcgaaagacacctgaacgaatctggcagtacccgtatctggttactgcttatgtccagctcctctagcatctcaagatttcctattgatttcggcagtgctcttaagtctgcaaaattcctgctgagattcaacttcacaagacttgtcgcaaagcaaatgttctcagggattacttcaacctcattaaaactgacatccagctctctcaatctggaaagtgaacccactgttgtaggcaatcctttgattctgttatagtgcaatgtcagtatttccagcttctccaacttcccaatggcctctggaagggcttttaactgattgaaatccaacctaagctccacaagagatgtgcaagatccaatagtatagggtagctcctcaagctcatttgtctcaacaattaatcttctcaagtttgccaattttcctaaacaatctggaagagccttcaacatatttgagctcaggtcaaggtttgctaggctcgtgagatttccaaatgatgaaggaagagacttaagctggttggcatgcaggtcaagatcaattaggttggagagttccccaaacgcgtcgggcagattgatcagctgatttgagtgtaggtcaagctttgtcaaatatctaaggctgccaattgttgatgggagtgccatgatcctattctcggaaagatcaagctcggtaacatcttgcaatttgccgagtgaaacagggagccactcgatctggtcgaccagtttcccccggaggctgagttctgtgatccctttctttgctgatgactctatcaggcttgccacttggataaggctcaatttttccatgtcagtacctgcagggatattgacaagtggaacttaggataacacaagtactgacatctcaaaaatgctgatcacatttatggtaccgttacaaatttgatgatcactacttgcctaagcatgattaaggcctacattagatagcacctccaaagtcaacaaagcaaaatgactaattgctcatgattcatatcgtattcagacaaataattatgctattgcctaactggtaacaaatgaattaacaatatcagatcaccaggcacaagagacaaatgatacaccaggtccagcagtgaccaacaagggaatggtcctccaactaccgcaagaaaattaaaaattaaagctgggaccaacaaacgactaatgcattatgtcaagaaaaaagaaatcacaaaatagcacgaaattcctttgaagaaatggatgtgatgtgacaattggctgcagaggtggttgttcacatcaaacgctaactcatagcgaaaggtgaaaaatcagttgcggtacactggtaccttgtagacatcaatcgtgtaatttgctaaaccaacaagcagaaatacagaatcatcacaaactacgagaccgctcctctatgtttccaattatagtactagtgaaacaagaataggcaatttataaacagtgtgcaattaaatggcaactagttgaagaaaatcaaagcaacactaacaaatcagtacgccattacgtcagttgacaattatttctagtgattctttctatataaaaggtagcaaccacatcgtaatggaaatattacgcccatatgcatgacatgagcatccaattcgtgcaaggtagtgaaatttaaccggaaaaaaaaacagatactgcaaaattatgtcgggtccatagaacacggcagcatcgaaaccatcacacatggatatatagtagtacaaagatttttaggatttcgtgattccgacaaaataatactgtacttgaaagcaaattacctgcagagacatcacggcgtagcgaggagatgggcttggactccaagcccagggcagcgagacccttgcttccgcgctccatctccgcgacggcggccgcggccgcaaccgccgcctccttcttcctcagctccatctccaggtccacgctgtccgcaccaacaccaacgtatccatcgccggtggttccccctcccgcttcggcggcgtcggaggaggaggagaccacccgcgacgccctctggatcaaatcgtcgaacaccttgaagcgcctctcgagctcgacgacgtacgcggcctccttccgctgctgcagcgcgcggagccgcacggcgttgcgcctggcctcccgcagcacggcgaggagctccccgtcggcccgccccggcgccgccgccgacgaggacgctgaggccgaggcctcctcccgcgccacctcatcgaggcgcgccgcctcctccgcgtcggccgaggccagcacggcctccgccgcctccacctcctcgacggcggggcgcggcgggagctcccggtacagcctcgtgagctcctccaccgcctccgccgccgacgccatggcgcgtcgcgtgccctcgatcgaggagagagaaaacgacgagagatgagagagagagagagagagaggagtgggttggtaataaatgagatgagatgcggtgcaactgcaagtgggagtggagttgaggagtccgccttataaaaacagcaaaccagagggtccctcccggttgcgaagaaaaagtcttctcggtataaggagggtggggttgagattgggaaggaagtagagggggtaaagcgcaaaatgggctaggcggctgggtggggcccacgggatgagctggcaacgcatcgggatgtgtcaggtaggatctggaacgaccaccttttcccaagattacccaccatgtggtcaccgctgtgtccgactgtacagtactctctccatccacaaaattatccatattacttttgtcaccaagaccaagaaaaaattaaatcacattgaatgttacaaaatcaaggagtaaatgcaagcatacaaccaatgagtatttagatgactccttgagttctaataaaacatttaatttatcttttcatttaaatcttaaatgtataaagactataaatagaaacaacttatttggaaaaacttaaatgtgaaatatgtataacttttgtggacgagggagtatattgcaggagtaattcccaagtcccaacccaaattactgtaattaattgatgtaggaatagtttaattattgacctactagtacgggtagaggtatcagagcaagtttaatagtatagccaactactagctctaattcatctataactaatctaatagctcattcataatagttatatactatgctattaatacctggtctcacctgtcatacacacactgtgtcttagagtccgtgctacaactggctataaatctgtagctcgctgctcttctctctcttcatttatctcttagggcctctttgaattgcagagtagaaaaaacgaaggaataggaaaaacacaggattctgacaggaattgaagtgtaaaacaaagaattgcaaaacacaggaaaaacataggaatggtcgtttgattggagcgtaagaaaacgcaggaatctctaatcggatgagagagatagactcaaaggaaattttccaagaggttagagctcttgctaaatttcctccaaaatccacatgcaatgtgccattccataggaatttcataggatttggaaagcttcaatcctttgaatcaaagggccaaatatgaaaatttcccataggatttgaatcctatgaaattcctacataaatcctttgattcaaagaaccccttaaaatatatttacagctggcttatagcttgctattgtacctgccctcacgagtttacccaaggctgcgtgctctacaggggagtactcctattccgctagagtagattgtattactcctagagtgccttcgtttactagagtggattaaattagtgacgtaggttagattagtggacgaggaaactctgttggagtttgtcccatgttcttttctgtctatcaacttgtgctacgtcagcaatgctaaacatgggcttatatatagtacatcacaccacggggacagggtcggcatatataggacaagctaagctgtttgggttcgttggtgcgaccaaccccttcacataaacgacgaccacaggccggttttgccagatgggaggtaacgggataattcactacccaaatacaagcccgtttgtgatttatttcctacttagtattattaatcactaagataaaaataatctttattgtaatagatggaaaagtaatccacttcatttgctccacttatatagttctagcagtgacgaacacagctcctgggcagatcggatggctgcccgggctccgtcactgtcgtcttcattatcgttagccgttgatacgtaaagaaaaaaaaaatcgatcactactagtcatccgaactttacgacgatgctatctccatcactgatgagttgcagtttttatctagggttggtgtgtaaaggaacggtaagagtggaatctatgaccatggggaatgtaaccaaccgatcaaagtcgatggttggttagttgcgtggaattccggccatgcaagcgagagtagctacgctggctgcaggaaattaaagaggaagaggcagcatcagccatcatgcatttgacagcatcgacgatgcagtgtcaaagttggcaatgtagggggagcgagcatcccttttactactatctcaaatgtcattatcaatgtgcggaatccgacgataacgaataatgccggccggaaatgaatggagtacacgcacagtgcagagttactttcgagtcgatcataaaagtagtagtaattaaattataaaaactataaacatatagcatgtttgtactttaaatgtgatgattgttagtgaatgatgatgtggcatctttgtatgttaagcttaaggagtcagtggagaataactttatactaagcttgtcagtggatgatgatatgtcatctttacatattaagcttaagaagttagtgtagataactttataataggatacactatacttggtaggagtacgatagaaaaaaatgattatgggcgatgatttgtaaaaaagggatagagattaatggagatgcgggggatcgaaccccgtgcctctcgcatgcaaagcgagcgctctaccatttgagctacatccccgattttgtttacttctctgtatcacaatttataacaggttcatgtctattaacttatcttgccgttaatacgcaaacaagcggcggaggcccattggattggatcgttagtggacacaacctaaaataatcgtcttcggattagtcaagccgagcagcaaccagcaaataattcaacttatcctaccctagcttgcactaccatatgtactagtttaatcgatcggacagtcgtgcatatatatatgagtattcgatatgagcaacagcataatacagatgcgagttatccacccactagcaagaatcaacctaacgtacgtgcagtacgctttcctcccactagtctataatagtgtactctacttcctcggtctaaaaaatatagtacaacaaatttatataaaggccccgtttaaatcccctgtcaaaaatttttactctgccacatcgaatgtttactacagtaaatatttattaataacggattaattaggtttaataaatttgcctcacagtttacaggcggattctgtaatttattttgttattagtctacgtttaatacttcaaatatgtgtctatatatctgatatgacacgccgaaactttacatccctagatctaaacacaatcaaagttatgtatatccatatttgtattaataggatgtgtcgcatctagacatagttggtttttttacggacgggagtacatgcaagttactatctatcacgtactaccatggagttcgtacgacccaaaaacacgcaaaagtatacaacaattacttccaattttctcgagagaacatctagatggatgcgacatgcatgagacgtgagggatggattatggatagcccctgcctggccccctgtcttgattgatgagcatacatcgtcagcatgcatgattggagaagatgctagaacgtgatcccctgggaggtacatcttccgtcttcaaaataagtctacttctaagtttaaatttgaatataatatatgttcagatttaaattcagaatttcaaaaatgatttttctatacggagggagtacagtatagtgtaaatttgagcgatttaacggcatgctgcgatggcagcctcagcctccagtggctgcgctagccgacggacaattaatttgcccttctagaatcaacccttgtcaaatgggggcaatccgtcccttaattaatagctgcttaattaatttggtgattaaaaactgccgtttttgctgcttaaaattcatcttcttctagaatagaatactgccggcgccgccacatagagtactactagtacgtgctagccaggggaggctgttttgaaacttcgtccaagtcaccaaatggatcaaacttcttttaatggctttttccagcacagcaaacaactgctactatgcacagctcaaggtactcctcctatgcacagctaaaggtactctgtaccactagatctcagcatatctgtaatgtcgttgcagattggaacagcaacccaggtggtagagcaagcaaagtcgttggtatcgaacgaacacacgcacgtgccagcaatttttcccagcttctattgtcagcagccaagtgcacgccttgttaccggtcttgggcctccagtccagtccagtccagcagtaatagcggcccatctatctttcgacattccttccttgcatcccagatgcagcacatagcagagaattaaagttagcaatctggattccaaagttgcaaagtatttgggctgccgatctggaaattcagatggaaaatcaaagcacaaccacaacgccggcctttgcattccaagtccaacttgcacacagacacctgacaagtgacaaccgccaacatttcacaggtgtgcttgtgcaatatactgtatatgccacctggcataatgtcaaccactagaaggcaaaagacgacctgacggctgctccaatgtcaagcactgcagctgccaaaaaaaaaaaaaaaaaaacaactataccttcgtgagcttaacctccgcacaagtccttctcaagagaaccggccatgggccgacgattgtcgtccaatcaaggcacacgagcggcttgccaacttctttaggtctttcccaacttccatgtgacttcattcaataatggtccacagcagcgcaaagtcaaggcctcatccttgccttcaccttgtgtgagcatatataatatatcagactcaggaaaagaagtccctgccttcaccttgtgtgagcaatatatcagagtcaggaaaagaatgaaaaatatgtatcgtcttatgacttgtgagttgctcaacatagagaaaatattgtcctctcagttcctgatttttgggacaccttgcaccacctgcctgcagcaagttgaataaatctcagtccaaaacaagcggaatggccttaaagtgagggcaaggtttggaaagagctgcagtattataagtgtaggagttatgtaaaagggatcaaaatgttcattcaagaatacctctgaacaaactgaacaagctaaggtagagttaaaagaaggttgccaaagcagaaatattgcatagttggatgcaccaaactgatgtgcatcgagtcatcgaccaaactaggatcttcaatgttatgcataatcttcttaggcagaatagaagctaagaataaacagcattgataagcaaagcagtttatttgattaaccatttcagtatgctggacaaaacaggtcactggatcaacatttctagtttccagaaaatatcggtctatgacattagttagcctgtatttcttgttaaggaccagtaggttttacagaaaagctccacagcagccagcttatttgataatcctttacaagactaatgagatataactattaatccaatcgaaataccatcagatatcttcaccaccttacaaactcaaaaatttaaacaaaatcctcaattaactattgataattttatatttgaataaggaaagagaaaccatgacaaggttagatcttttttggcaatcttttgtacatagaatcagaccactcaactgtatcaaaatggtactgcaagtgatcaatgcaatcaatgggtgtctttcattgatatagtttgtgaattgtttgtaaagatttcacaaaatatatacaagcaagctatcaatttttttccctatcacatgcaaaggaccatctatcactttaaaggctatacacgatagcaacattcgagaaagcacacgaggctccttttttgcaacatagttgaattacaaaagttaagtgcgtatatggtttcttctattattgcaggacagaactcatataaaataaccttatgtggggaggagcatcacttgcttcgagcatttggtaccacctattttgcattgccatcttgtaagaaacctcagcatccaccaagagtttcaggccgcaccaatggcttgtgctccagatcccagcaataacaagaatagctcgtcgattcttcatcagcaagtgaagaaaattagcaggattcctttttcatggggagcacatgcatggggtataggaagagaagatccaagaagggctattcatgctctcaaggttgggacagcactcacactggtctcactcctgtacatacttgaaccgttgttcaagggagtgggaaagaatgcaatgtgggctgtgatgaccgttgttgttgtgcttgaatttactgcaggtaacgtgcataatccattagcatcaggataataataataatatgtgttcttcccagatgtagcttttcttgttccaaataagtgattaccgaaattcatgttcctcacaagtgactgctgaacaacaggtgcaactatatgcaaagggctgaatagagggttaggaacaatcttggcaggatctctagcatttataattgaacttgtagcagtacgatctggaaaagtattccgggctctgtttgttggatcatcagtctttctgataggtacgcaccttgtaaagttctttcttttttttttactgcaagatcatagcttattgtgttggctttgtttccttgacaggatttgctgcaacatatttgagattcttcccatccattaagaagaactatgattatggggtcgtgattttcctgctaactttcaatctataacagtatcaagcttccgtcaagaggatgtggtgcctttagcacgagatcgcttaagtactattgcgataggttgtgcaatatgcctattcatgagtctttttgtattgccaaactggtctggagaagacctccacagttctacagtacgcaaatttgaaggattagcaagatcaattgaaggtgggtaaatagtagataggagcacttatatgttgcatcttaaataataagagcataggtgcataacaagtatcaagaaccttaccaaagaatgattgcagcttgtgttactgagtatttccaagatcaagacaaggatgataaaattcttgataagcaggcatcaagagcttccattcacattggttatagagcagtccttgactcaaaatcaagtgatgaaaccctagtaaggaactatccttttgatgatacatttttttccttttctcttgcaatctctctctataaagtgatgatgtgcagattacatactgatttcaatattggtaccaaatcgaccaggcacactatgcaagctgggagccaagacattcaatgcaatgttacagttatccatggcaaaagtatgtgaagattggatctgttcttaggcactttgcatatactgtcgcagcacttgatggatgtctagaatctgagattcaggtaactgcatcagcccaatttctcgtgcatcatcctgttgtatatccttagcaactgacatataaacatgaatatgatgtataatttcaatcaagaaaattctccttgaatgaactgttctgacatggttgtctctattgatgttgaagactccaccatccgtcaggtcactattccgaaacccatgtactagagttgcacgagaagtggtcaaggttttacaagagcttgcagtaagcataagagatcatcatcgttgtgcccctgatgtgctgtctgatcatcttcatgaagcactacaggatctaaactcggctataagatcacagccacggctctttctcggctccaaacatgcatgtgcaaatagtcatgtgctgatggaattaaattctagcaagcatacagccacaagaactactctaccatcattcaagactgatggcacatccctattagaaaggaggaatacaaaagcagaccaaccatcagaacggaatgagcggggcacattaaggccaacactaagtaagatagccatgacaagccttgagttctcagaagcacttccattcgctgcgtttgcttcattgttggtagaaatggtagttcggctggagatggttattgaagaagtgaaggaactggagagagcagcaaattttagagaattcactggacatgactatctgaccattgatcttacttccaatgacaagatgagaaacccaaatggcgtaccattagacagccacacaatttccactgcagctgagtaagtactgaataatagatcaaatcagtagatgatcactctgaagcagatatgtatttctttttggactaagaaaatatggcctgtgaggctgtgattcccaataaatgttgttagaatgacaactcataaaaaaacaatattaaacctacaggatgtttatcggagttggatgatgtaaaaaaaatttcagcagaaagtactcatgcttttccccagaatccagtaggtcatgcctttgttttctgaataaacccttctctgatgcatgacatgttctactacgcacttgaatgatcatgagattcatgaaacaatttccttcctaacatctggagcacagtctaaggtataacggccaagtcttcctgttcgatagaggttgagtaatttcatagcaacaagtttacgcacatcctcacttagatcagcagaaaccctgaaagcctcctgcaaggctataaactggcattctatcaaactctttaattcattctcattttctaaataccccttaaaagatgatatactatcaaaaagcacttggcgaacagccttcacaacaaaatcctgcaaaaatacaaaacagtagttactattctatccatgtgatgcctaaaatgtgacctcaaaaggatctaaatgagatatgatcattgcctttcagtaataataaaaatctgcatgatgatgggtacaagactgaattgtgctctatggaatatcttgacgcgcttacttgggtatgatctgaagcatattgccttttattatggtgactgctggatgacattgcatggctgaaagaaggcatatctcctgcttgattcatgttctcccacttcttgtatgtctcccttgagttcaaaattgcaagcagaaattgggcaatctcaaactcctgcatcatggaatccttgattgctcctgtaatgaagtttgcatacatcagtaacaacttatagtcacaagtcaagccatggattaccattgtagctggtacctgtcaaagctagtagaggaccagactcgtcattaaaaaatacaggagacaaaacaccaggagtgtctaatacatatatatttggatgactagcaacctgaaaaataagaagtttgaatcttgttaagatttggaatggcacttggcaattagatagccatacaaggtgatgataacagcttctaaaagatggtgttcacaacaaaatacaggcaccagagctatttccgcactcagcattgctgtctctttatgaagaaaatataggtgctatgcgatttagagttgcccaggtaattaatttgttacaatgtccataaggaatacaaagacccctctatccatttcctctaaaaaactaaggtgttatgacagtcatgcagcatggtcttatttccctcattctgctgggtcgaacagaagcaatgcattatatcgaatcaaattaccttgtaaccacttatgtccttggtttctcctggatggctgctcacaatggcatgcttgagctttcccttctcttaaagacagagcaacgaatattacacagttgtgtgaatcacagttagtgcaactacagtatcaacagtaataagctgcctcacctgctgccccaatcctcccaattcgatgcatggcattgacgattgctgacttcccaacattaggaataccgaccaagaggacggttccagtgcaatcgctctcaccaagtttaatctccctgatctttgcccgcacagcattcaacagctatttcacagttaaattagcacccaatcaaatcagccgctaatgtaatcaacaggtaagaacactagaaacagcattacctacctccttgatgccctccctgctgtgcgaattaagagcgacgcaggagcagctcgtttgcttcatgtacgccatccacttctggagaacaccaacaccaatacgaacaacgctcgcgtgtgtgtatcagatcagaactgatcacttacccatctcggggcagtcaaaatctgctctagttacagatgagggttgggattagggttacctcggtttgagaggggtccgcgaggtcggccttgttgagcacgacgaggcggcggcggtcgggctccggggagcggcggcggagtggcgcgaacgccgaggcggcgggtacctgcggggttagactcagcaagcaagcgcatggggggaaaacgatgcttgactctgtctggagcagcggaagacaatagagaggaggtggagagcagtgggcgccatacccgggcgtcgcggacctcgaggacgaggtcgacgagggggaggcggctgcggatggcgcggtcggcggcggccatgtggcggccgtaccaggcgccggagagcccccgaacggcatcgctcaggcggcgcgagaaggcctccgtcgccgccgccattgctgacgtgagccaaaggcatagagacaaggaataagtccactttgactcccttaaaagtggcccaaatctaatccatggcccttaaccgcaaaaccggatatctcgaccctcaaactattgaaaccggtgcaatttgactcccttggtggttttagatggcggtttcgctgacgtagcaatattgacctaggatgtgggttgacgtggcgctcaggtggcatttgaattaaaaacgcatacgtgggacccgtttgtcattcacacatattaaaaattgtggggcccactgacatgtgggcccacatgtcatctcctccctctcttcttcctcccctcttgacctggaatgatggtagagagcagtcacgcgaatccatccgtcagctcacgatcgaacgcctttgcgtggagctgcacgtccggctgcttcgctcctttgttatctgggcctaggcccaacaagcacaccatcgtcagcccgttgctcccctttttggcgccgtcttttcctttttggcgcgaatcccatctgcttttcccgcgagtgaacgtgaggcgtcggcaagagggtgaggcgatcggcttctccgtggagcacgagggtgaggcgatcagctgcagtaaaaacagagaaaacaagatcatgctcgcaggtttgcacagtcttcatgtgtgtgtgtttagattgcaacaatcttcttctaatttgtttgccatcctctcctatgttagcctgtgtggaaatagtttaacgaaacatcaacttgcgattcatcaaaaaatagaagcaggatatatgagatggaagaaaagaggtgtgtaacccatgcttgtttctttctcccaattaggggtgaaaacggtaacggtaattaccggccgaccggcgttcgtttttgactttctaccggccgagccatatggaaatggtaatcgaccgaaacaaaaatggaaatggtaaaaaatatggaaatgaaaacggaaatggttttgctgttataccgatcgtttccgtatttaccgtattctcgcggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatatataacatacttatgtaaagttaaatatatgtttttatagtttaatgtttccgtatttgttaccggtttccgatctgtaccgacatgtttccgtccatattgttccgtttccgattttccgatatttccgatatcgttttcgtttccgactttaccgtttccgatttcgtttccgagaaaaatatggttacggaaatggttgaggctgttttccgatcgtttccgaccgttttcatccctactcccaatgcgtacagatatattttagttgcttatcataccaccatcaaattaaatattttgtttgctgtagggatgggttttcccctagtttgttacctcaagttggcatggaattcagcagtacagatgaggcttggatgttttggaatagctatggaggtcagaaagggtttgaggtgagaaaacggtacacaaacaaaagaaaatcagatgggaaggttaggtcctgcagatatgtttgtgcaaatgaaggccatagaaaggaagataaaagggatcatctaacaaagtgtcctacagctgaaactagaaccgattgtcaagttcgcatgggtgttgtactagatctagagaaggggaattataaagtggctgatcttgttttggaacacaatcacatccttcagttgccagaaacctcgcacttgatggtgtctcaaagaaaaatttcagagttacaaggttttgaaattgagacagccgacgatgcgggaattgggcccaaagcagcacatgagttggctagtatccaagttggtggctcacttaatctcagatacactcttcgtgagcacaagaattatttacggggcaagcgccaacgagagatggcatatggtcaagcaggaagcatgctcatgtattttcaagataaaattgcagagaacccgtcgttccaatatgcattgcagatggatcaggaggaacaaatagcaaacatattttgggttgatgctaaaatgctcactgactatgcatattttggtgatgttgttagttttgatactacttttggaacaaacaaggaaagtaggctttttggtgtatttgttgggttcaatcagttcagggaaacaatagtttttggtgctgttctcatgtacgatgagacatatgagtccttcaagtggttattcgagacctttctaaaagcacataatggcaagcaacctaaaacaatctatactgatcaagattttgcaatgggaaaagcagttaaggaagtattttcagaagtatggcatggtctgtgcactttccatattatgcagaatgctgccaagcatctagctgaagtcgacaataaagaggaatccagtacttctcccgaacagatagttgaagacaatgagaaagaaccaagtattctcgcagattttagtgcatgcatgtttgagtacgaagatgaggaaacatttgaacaagcatttaacaccataagggcaaaagcgagcaagcaaagttggttggatagtatatacagggttaaagaaaaatgggctgaatgttacatgaaggatgtgtttgcattaggtatgagaagtacacaattgagtgagagtctaaatagtgaactgaagaggcatttcaaatctgattttgatatcatttgatttcttaagcattttgaaagggtggtggaagataagaggaaaaatgagctaaatgctgaatttgaataaaggaagaaaatacccagaatcaaaatgaggacacctatgctaatccaagctagcaagctgtacacaccaattatattcgaagcttttcaaggtgagtatgaaagatccatggtagcatgtagcacggcattggaaggcaaaaattgctatcttgtggcaattggcagtcttgaaaattgtacctttgagaaggagtacaatgtttttggtgatcctttagagcaaactagtacatgcagctgtaggatgttcagtagaactggaatatttgtgtagccatgctttaaaagtccttgatctgatgaatatcaaatctctcccaacacaatatgtactgaagagatggacacgtggagcacgtagtgggacagtacaagacaaccatgggcgaaatataatagagaacccaagattaaatgagatgcttcgctacaaagatatgacccgcaaatttctcaatttggcacttagagctgccagccatctagagtctaccttattagtaaacaacacactggacatccttagcaagtaagttgaagaagaaatcaatgcatgcactgatactatggttccggtcactgctcccacaaatgttactcctccaattgatttggtgagtacagcatgcctaaagaaaaaggaggtgcaaacaaaaagctcaaagcggaaaagaaattggcttgataagatgcacaagtccacagagaaaggaagtaagaagggaggtaagaaaaaggaaaaaggatcaaaggtatgtgattacataaaatgtatttgattctcttttactgtgctcagtgggaacatgttcagtttatttttcttttatttgaaggaacaaggaactataaagaagggagggaaaaaaaaggaaaaagaagcaacggtacaagacagtgcagcggtgcaaaatatttatcctaatacttctttgcccatggaagaattgtctgaaccatacatggccatcaataccttctctcagatattgacggtaatatttcaaactaacacaccatttttctataccatagatggccatcaatacattctctcaattgtttttctgaaccttttattttacaggggccaattacagatgatgttttggctgatttctagtagcatggacagttgctgcaatctgaaatataacagattgtttagggggatagcttttgcttttgtcgaagtgtaaagttcagggaattgcagaattgcatttctgaatagcagagcattttgtgcatctctgaacttgcaacattcagaattaccttttattcaattccaaacaatttacaacacaatgacaatcacaagttacagtcttgctagctctagcacaaatgtcacttcacaagcaagacaaccttcctctgttactcactgaaaatttcagacatagcacacgatgaataaaacacactggaaatttcagatatatcgactccaatcactgctatcctacagacatcattttcagatatgtcgactccaatccctgctatcgtacagacatcttctagcttaattggaatcacggctgtggcaaccctccagcgggtcctatccattctgagacatgctacaattgttgcgctgcctgacgaggccatgctgctgcagcagaagctgtaccgcggcgtgcggggcagccgcagtggggcaagtgggtggcgtagatccggctgccgcagaaccgggtgcgcgtctggctcggcacctacgactcggcgacggagtagcgctcggcgaggacggcgacggagcagcgctcggcgggatggcgcggcgctgctctcggcgaggacggcgccgctctaggtgacgacggcgacgggacggtcctccatcctcgactgcaagtccggatgacgtggtggcagtgaaccctttccttatccatagaagcacttgttgggccgagccgctgaggcccagtgtctgagaggagtagcgttagatccatcgttcgattgcgggtggacgatgggattcgcgtgactgctctctaccatcattccaggtgaagtcagacgatctgattccctttctttctctttctcttctcgccccttcggccggccgcgggggtcacaggacaggctgcagtggtggcgggcgggggcagagcggcggcggcgagctcaccttccacgacgaccgcgtcgacctgcctcgccatgacggcgcgcgctggtcaccgcccaacgccccagcgctgtccgtggcgcgtaccgcgcaggccaacggcatgtggttgtggagctcaggggcgtgttccgcatcgtggccagcgcggtgcccatcatgagggaggagtcgcgccgtcgcgcgtccacaactacggcgtcaccgacgacgactgcctcgtccacctcgacctcggcttcaagttcgaggcgctcaccgacgacgtccatggcgtgctcggccagacttcccttcatctatctactctactgatttcatttgatgatgattacccatttaccctcatgagttactgactgacatggacgaaaattttataggacaacttctcgaatgcctccactaattgccaattagcagggcagataatctccccaacaaccaacacaatcatgatgcactgatacacggtctgaagctgcatggactggaccgccggcgactccttctccggagcggcgtagcgcctccgcctccgcgcgattccggcaaccgcggagtccttcgcctacactcgccgcatttcatgccctaggaggctgccgtctcggccccccatggccggaaccctccacgaccccaactccgggtcaggaggcgaaaagcggcgcccactcctactactactcccgtggtcacgctgttcgcccagtacgtagccgactcctcctccacattgcaatccgccgccgccgctctgtcccccacccaccgccgctgtagcctatttcccccgcggccggccgtaaggggagagaagagaaagagaaagaaagaggggaggaagaagaaagagagagggaggggatgacatgtggggcacacatgtcagtgggccctacaattttcaatatgtgtgaatgacaaacgggtcccacgcagtggcgggcccaggtttttgaacttgtgtattcgaaatgagaaggggtaaaaaaaattgttcatacacctaaaagcctaaacatatcaaagtgccaacataataacatatgaaatacaaaaatgaaagaaaatgataaattaggaagaaatcttacaatttagagattaacttttcgacgcttgatattttgaaaataatcgatgatgtccttgtccttagcttgcaaattgaaatttttttaatgaagccccatcttgtttctccaaaaaagagtttaaatcaacagctggcccttcttcttcatgtttcagttctgaaaattaaacaaatttgataatatggtatgaactatgaactaccgtccagtgtccactagaccactacaaactaagcaagcaagtacattctcactaaatcagtgaattgcagctcccaatcctaaaattttcactacatttattcaaatttgtgtactcactaaatcagtgaattgcagctcccaatcctaaaatcttcactacatttattcaaattttgtgcatgtacagatttagtcactcactgtgttgtcactgttgtgctgctcctgtcctgcgcggcttgctgttgctgtcctgctcctgcttctgcggtcctgccctgcgcggctgagccggtcagccggccaggccaggtgccggcagccctcagtggcgcagccgcctaccgccctgcgcccggcgcggcgccccacatcccacgaccacgagcacgagggcacgagtcgcgcggccgggccggcgccacaagccccgcctgctcggcggcgcgccgccagccgcacgcctgcgcaactgtcgggatggatggggaggcgaattagggttagatgggaggggaattggggatatgtcgaaatgggctgagatgcaaggttgacaacggcccaattagaccgcgggctgagaggaaagggggaggggagtgggaagttttggcccaatagagaagaaatggtgaaataaggtccaatatgagcagtttaaggtttcttttttaattttttaaatacatatacgaactatagagtatatatacctattttttgtccaaaaatcttgggtatacatctgaatacccttgaatatacactgggcccgcccctggtcccacgtatacgtttttaattctaatgccacttaagcgccacgtcaacccacatactaggtcaacattgctacgtcagcgccacgtcagcgaaactaccctccaaaaccaccaaggagtcaaattgcaccggtttcaacgggtcaagggtcgagaattaaattcgggtcacttttaagggagtcaaagtggacttattcctagagacaacaaggtacaaaaggccgaaagacgaagacgaaatacattattgaatgggctttatgggccgggactcatcacgtgctagatgggctttatgggtcgggaatcatcacgtactagtatcagctgtattgctcatcatcagttgttctcagaatcttaagcattctgtgatgcaaattgtgacctgattttgacttgcagaggacagattttatacggaacgagaaaagttaagaggaaaattcgaaaaggcagcgccgtcctctcctctaatgtttgtttgtctggccatacaaatcaaagattcaagagatccgattctattcttggaatgacggtggccatttttgtgttgcggcagtagcaatggcatcttatcaatgctcttccttcatgttaacattaacaatggtctccccttttcatctttcgtggcgcctcggcaaggcactgcttcactccttgctgctgcgatgttcctaacctcacgtatcaatatcatcacaatttcttactgctactactgtaatcattgtcctttcgttgctgttacttttggttaaacctgctactagctgctatcaagtcaaaaagaaaactgtcatgcatctgtgacctgtacagagtggatacgttcaggctgaagatattccaatttaacttccccctactacactgtaaatctgtaatccatttcaggctgtaaattggaatatcttcagcctcaccgtatccacactgtaccaaagagtaaatgtaatatctgactaatgtcaggctaagcacacagaaaacagaaaacaaaggcaagagcttatagacatactatgaattggaacttttataatatatatattgtatgaattgaaactgcactgtttgagatgaagattgatctaccagcaacactaccttttagcttacagatcagtgttacaagtacattaactgaagaggatacataacccagctctgctgtatgatgctacagagaagatgtattacagccagtaactaaaagaaagctcatcacctctgtatccatacagattataggcatatttatgcatatataatagatgacatatgtctgtagtggctgacacgtggggccccagttaggaatggctcaaaaatataccgccatgtgtaactaacccgggagcacacgtgtcatggttgactcgttcagaagacggacatgttgtcgtcggcggccgtgaaccacgccgtgaggtcgtcgccgtcgctggcctgcctgcacagcagcggcgccgccgccgcgttccagagctccccaccgccgccgccggagtagccgcccagggtgtcccacttgagctcgtgctccgacacgcttcccatgacgtcgccgtagagaggaggcgctgcctgcgtgaagccggcgtcggagaagaacgggtcctgagtctgaggcatgcacagcggcggcaagtcgaacccgcacgcgtcgccgccatggtacgggacgcagctcggaagcagctggaacgggtcgccgccgccgccgccgacgaacatctcgtcgacgagcgggctgccattgttggtgggcgtgaacgacggcgaggcgttgccccggctgctgagctggtgttcgacggtgacaagggacgagctgctcgacaccttgctgatcattcctttcgccttcgccgccggcggctcgccatggaggcccgcctcgtgcctcttgatcacgcggcacagcgcgtacgccccctgcaccagaacacatctcatccgatcagcgcgccattgttgccgtcgcagcaagcaaagcaaaggcaatccggagaaatgaactcacgatgaagttggagacgccatgggcgaggtcctggcagaggcggtactcgtgcatgacccagtcggtgcgctcgccgccgggagcgcgacccttgtagaagacgagcgtcttgcggaggccgaagacctcgccggcgcaggcgatcttgcgatccttgccggtggccttccagtacccggtgctcgtcgccctgttcgtccgcgacccgttcggatacttccggtctcgtgggcagaagaagaaccactccaggtcacgcttcggcaagaacgacttctctgcacattttcataatcattttcttcttcagaatttgatttgatcatatttattatcattttatgtcaccaaggcgaaaccaaattgcaagagaatatccgaaaagtttggctttgcggttgcaggaggaattcattcttgaatactaaaattaaaaggtgtgtgattaaaaagacttatcagcaaccggcctagggaggaaaaagcccagatgcccgtgtaaaaaggtcgcttttatctgtctagaaaatgagaaacgcctctgggaaaaattctgcatgttcctttccaattttctaccacctgtttctctcttttcaggaatagatttgcgaaaaaaaaaaggctagcaggtcaaaggctttgcatattgtttagctactttccacagttaaaactgttttcaccaaaagttaacaatgttgacacgaccaaaactcaactatgaaacaacaacttgtgctaaatatatttgatgcagaatttcaactaccaaaaatgaagtaacatgaatcaaatggaaaaattgacaaaggcacaaacctggtagctcccatggctcgaacttgtagagatcaatgacagggatgacctcaagctcgatcttgaggctgtcgactttcctcttgaggtagtagccgaccaattcatcgtcggtcgggtggaaccggaaacccgggggcagagtcatggtacccatgatcaaatcaaccgactgaatttcagacaaatgtacacttgcaaaacctattcaaatatcttgggcaagcaagcgcaaacctaattgttcaatcgaaggttaacaatggaaagaagaggcaaacaatactactaatcggagcaaagctagctagctagctagatgtagtgtcaatttgcctaaatgctaatacttgaggcagattggcacaatttatcacatatatatggttgaatgcttgtcaattagaggcggcagaggcagtatctattgaagattgggaagatccagaagtagaaggtcttgagctgctcggaatccagcggacaggtgttgatgaagctgcctccggagttcaagatcattatcctatggtcaatcccctagctagcaagaactaaacaaccaaggaattcagttcaggctccttgatgaacttgaactgaactacgtacagagatatcaattggaggagcaattatggacgagaagaagaacaagaagaagagttgagagattcttgctagctaggtgctgaccaattaagaaataagaggaggaataggagagtgtttgggtttcgttttgtgaattgggggagttgggaaggtgacacggtaggggagtttatatagaggggttgagaggagaaaaagctaaggtaaggcggcgatgatgttcgtacgagcgaagcaattcgaagcgtcctctactctaccacggtagttgcaactccaagtagccgcaaaagacattcacacactactcgagctttactactgcatcttccattctctctgattagctcctgtccaaaccgacgtgtcaggttgcctctgtgattagggcagcgcctaatccactgattgatcagatatctgggcatgattaatgacatcgcttttggataatggcaacactgacatatgtaatgcatggtgatatattcttcttcttctctgaagaatcatactgtcttaccattcagggaaggggggaagtacgtacatgcagctagcaagcagcctctcccaaaagtgaaattttgtttcatatgcgctttgttttgtctatgaattcttgtctgcgtcacccttgatccgtgcttagccgttcggtttagttcactgatttgattttcttcggataatatcttcttttacgggtgttcagataagtttcgtggccgaatttactatgtttttacagctcgccttcatactaaacatttccgctgattgatttcccgctgaaactaattacgaattcagtttccagtacatcgaacacgtacgtcatgtgtaccgattgtgaattcctatgcatagtcagtactgacagggaattccagtggcgacgattcttcttgacctatggttattctgaaattgttatgaattgacctctcctactgtcctagtacatgatacacgcctgcttctgaataagctctatcacttgactagatatttttttctgcactgaagtagtatctgaaatggtatcaagttgtgagtgcccaaccgacctaatcatcaggaattagttcctgactttctgctcctgttgcgatgttcacttgcacagttgcactgaatctacatctgacaacagaggttggtagagtctcttgattacatcttgcccttgataatacatggttttttaaaaaaatcttcgatttgaagagaaaatcataattaaacaaagtgttcagagtcattaggacgatggacgaaagcacatgtgaattctagtcagacggattctgaaaccagtagctgtagtattctgctgtattgttaagtcgattagacatgaaaaaaatatatgcagacaatgtatctgtacaggtgatatggtgcagcagtatatctccttaatttcaaacagctttacatcgacgcgtagtataaagtactgcaagtcatgttcattacgatctcaatgttgcaacttgttctcctgccgacagccttcctagccacaaaaataacacaacaccgcaaattctcaggctggtccatagttctgaaaaactataacaatgagaacttccaagtttgcattactagatttcctccctattctcaggctggtccatatttttgaaaaactaccgtttgactggtttgaatttggcgcggtatcataattcacagaactctctgccagtgacgttttctttttcaaaaaaaaaaaaaaaacttccggcttctacaccaaactaagggtgtacacgaccatatttgtggatactgggatttaaactttagtgaacggacttgtgcactcaccactctagcacaccaatgatgctttcccataatgatgttttgtaagtccaactttccaatgaattttgagcatacacttagagtttatcagttagtataataaatataaaatacttaactactatttatatcccaaaatatagcaagttttagcctttcgcatggctattaacgagatggataaaatgacttatttgtctttcggggtggatgccatgtaggtctggactagttgggataataataaagcagagatgtggtatgagtagtttaatagtaaaaatgaccttttatatatatgcactatgttgttatatttggataaattttgaactatattagttattatattttaaaacggacggagtatttactaaatggaggctagtcttagacaagaaaaggtagattgtgaaatggcatctagcctagtggttgctgtgatctgagggtgtgtttagttcacgtcaaaattgaaaatttggttgaaattgaaacgatatgatagaaaagttggaagtttatgtgtgtaggaaagttttgatgtgatggaaaagttggaagtttgaagaaaaaatttggaactaaactcgtcctgagtagcaccttggtcctgaattcaaatctctataggaacgaattttagattgggttatttgatggctaagcttcctatttgataggctaattttctaatttaaaaaggctgcatatatctggttggatgtaaaggccgggtaaaaaatacacttctcaaaaaaaaaagaaaaggtagatcattaaggccattctttgatgacatcaagctaaattgactgctgcatgacccagctttgtatagtcactttcctcatagctatcttgcacttgcactttaaagagcacatttttccatcgtcattggctcacaacatgagcagccatgctccacatggggacaaatgtacttgtcagttggcattgctcaccaaacaccaaatctgagcaaaagcctgagtggttcagtcaaaacaatctccatcttatcactactttgtcactgtcaggatagggagttggacctcaactgcttgcttacccttgaccaaatgctagtgcttaacttcacaaggaggttcaaataggggaaaaaaacttcatgaattcaggttagctggtttatgactaactaggttaatttcaagctaactgaaagctagcctttcggtaattagtagctcatgtactgttgtatgctgaatactgtagccaacagaacagcttgatcaagcttgaatggatcatcttcaggtatgcagaaagaaacaagtgtagcctttgtggaagtgaatgcatgacccactgatcatgagtcattagcttttgattagtttaattaacaacatcgaggactagagcattagctgcatttgtcaaggcagaaatggtttaaggacagatggctcaagtgatctctctaattaacctgaccgttcttagatatgaacgctggtggcctggtgggtgcccacctgaagaccaggattgcttttataagcagatgtaggggcctgctagttatgaactgcttgacttgagcatccctggctgcatgaccaggcatcttgcaccatcagagctgcatcagcaaagccgcactaaggttggcttcttttaatccctagcaaaccctcccactgcttttcatcccttcctgttgatcttaattatccaggtattgttaaatcaaatgctatagagtagtagcattgttagcaatgatctgacacaacttgattaatttctgaattccaagtcgtcctagctagtatgaaacctctctgtgaacttttttgacacggtttatttgttttatacacctctgttgttgtatgatcaggcagggcatcagcattggatctttaagtggcactaactaagctagtatactagctgctgagctggaggtgagactgatgcatgatatatgcatcatcttatcatgactgcaagtctgcaatgtctttaacttatctttaacagattacattacctcaggggaaaaaaatatgcagttcagcttaactgttgtaatcaagaatctcattatgttcatatccagaaatggtaggacagcatgcatgaatgctcaatctttaactttcaggcgacctctgttcacctgaagtcctgaagacaagactcatgctgggtgtacagtaagtcagtagtgaatcaatcataatttcgagtaaattatgatcatgtctatccatgatggagactaaatagtaccgtttattagtcgcagaataattcgattctcctgttaattaagtaattaaggagcgcaaaaagtttcttcaagtcggaagactctgcactgtgaagtgttgcttggataatatatgttttattatctgcttcctttccagcagctgagattagtgggttccacgtaataattgttgataaattcaacattttcattggcaaaaaggcactaactaaactaactaactaatgtaatttaagatttaagaattaatgttatgcatatctaggacaagagaaaaaatattcagaggtgggcggcacaaaataatgtaatataagtagcaaaagcgagttttcagttaaaaatgtacaaaaccagcaaagctagtgcaagagagacgtttagaatcttcacctacggagtatgtgctaaacatatcctgtctagtagtgattagcagattaattaactaccatgtgatgaaatgaagaatctttgttagtggagcgacggggcacaaaacactcacaaggcatacctttcctaattcctacactaatgtaatgggatcctgaaaaacagcattagaaaactagaaaagaaatgcctttgcgcatagtataaccagcatagcttagctaggcagtgatttgcttctcggccaagataccaaagcaaaggagattcaaagcttaacgggggcctctcaggaaaggaatcgccaattaattgacgaaggcggttcggttttagtagtaggcgacaaaactcgcctttcattaacccaaaaatagtctcacgcctatttcgttgtaaatcagagaaaactgattactagtaatagtattaattaggaaactttgtaacttacaatttactggtaagaatatactgccgccataaaagggagaaatttctctccatatactataaccataagaaaattactatgcatacaactcaattgtccacgtacgactaaatttgatcaacggttataaacgagtgcagtgcgtataaacaatgattgatatatggctgcatatatctcattgtacatgagttgtacaactgaattgtacgtatagcggtactatttttataaatacaaatcactaggtaattttccccgctcaaacctattccctatatatctcttgtcatcctttaccatagcaaggcacccaccatgaatacattgtgccagatgggcaaggacggacgtgtggccagtggtggagttggacacaggtctaaaataaagattgctggagaagctcgataaagataaccaaacacaacatatatataccattgccatatttatattactattgcacctctagtattataaaaattgaagatgtttatgttgatactttggtacgtcatccgtatttaagtcggtttttaagtttattcgcttttgtaaatacatatggagtcgtataagaaatcctttaaaaaaacccgtatgctaacttggaacttagagtcgtactcttaattgctttagaattcttgccgggccataagaaagcaacgtacataatatggatgtcatcccaataagacttccaaattagatatcaatactatcaaaatgaaaatcccacatattttttaaacaaaaaaatataacaataatatattaaaatagctttcatgcattgcaacgcatgagcttttttttctagtaaaaaaaataaagtacaatcaataaggtaagacataaaagaacatccaagataaaaaaaaaatagagtacaactttggagtcgcctagcctatttgattgctatctctatggcatcaggcaagcgggaaacacattgcggtgtcacgccccgaactagtcccgaccgggactagcccgtgacgctccaatttaacctgttaatcgataccagtcccaggaaacagtgctggtatcacagggagatagaatatcacagcatcagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcatcagcaggatccgcttcatcttcttcagcaactgggggggaattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaatagggttggcacccggccaacagcttttcaaacggccacccgggccaacaacttttcaaacggccacccgggcctagctgatcccgtcagctgctgatttttcaaacatcgaacccagtttcacaacagcaatttcataagcagtagtcagacaaaactacgctaggaatcacctcacatccgcccatgaccgtgggcacggctattcgaacagttcaatgacctctgcagaggggggtacactttacccacacgacattactaacccgggtcacccagcccgtagggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaataaaggaatgatcaaatgcaacaaattaggtaggtctgccaatctgccttgcagacgggacaacagattaagtgtgatcctatcaatgcataatatttcgcaagcaatataattaaattttaaatataggctcaagatgttcaaaggtggcttgccttgctcgagatctggagcttaatcctcgaaattctcgcactgcgggtcttcgggctccgaaactacacgcgaaacgggacaactcaacaaacggcgaaaataaagccctattaaagacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagacttttcctcgggtggctagggcgcggtccaaggtaaatggagcggctcggccgagcttaacgggccggccggcccaagacggcccaagcgcgcgcgcgcgggagggaggagagagagtccggtggaccgggctcaccacgcgcggtcccaggtgggacccgcttgtcagcggctcggctcactgtgcggagggagtacgtggctcatgcgcgcgggcggggaaaggacgcggtgcacgcgagcggtccgtggtggacgcaggtgcggcgggcccacgcgcagcctcacggctcgcggtggaacgcgcgcacggggagggactgaccggggtcggctcgatccggtctaggctgagctggcgccgacgtggcacctacgtggcggccacgtgggctggcgggaggtagacgacgacccggcctcgaatggacggcgggcggcggcggcgagcggcggagcgaaccacggcgatacgggcaacagcgagcacaccgggcggttgcacgtgacaagggaaggcgagccatcggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcggattgggtggaactacgccgagcgaggccggcgacgagcgggtgctacggagctcgagcggcgacggcggcgaacacacggcgagcgacggaaacggtcggggcggcgccggctaactacggggaggctactcaagctactaccgaaagctagggggaggagatggagcgaggaggaagaacggagagagacatcaccgagaagaggaggggcgctgtgacgagaggccggcggcgcgggagtaatctctccggcctcgggctgaggaagaggaagaagagggcgcgcccggagtccccttccgcgtccatgaacgcaccggctctcccggcgcttggcgatggacggtggaggcgaggcagagcacgggagcggcggcaacggtgaggaggcgaatgggagaggaaaggaagggaggggggagacgggtttaaatgggcggcaatgtcggtttgagagaggggaaccgacatgggcggtcaagccggcgagctggcgctcggcggtcgcggccaaagcggcgacagggaggatgacgccggcgaggaggaaaaaggggaaaaggagggggagaaagggggcttgcccctttgccgattcgggaaaaagggggaggggagcgggggcgacgcggcagagagaggaggggcgcggcctccttcccttggcggcttgcgcgcggagtggcgggggccgggcggtgacgacggcgatgacggcgggcggtttggagcggagcggcgacactggcgacaggcgcggcagacgctgacgacggcggcgaccgggcggtcggccactcggcgcgcgcgcgcgggaaacaacgggcggcgtccgcgcgggcgcgcgcacgcgaacacggcgcgcgggaagcgtctttgcgagcggggagctcgcgcgaggggaggggcgctcggcgcgggcgactcccgcgcacacgcgcgcggcgcgcgggcggggcggagggggaagcggggagagaggcgctcggggcggctctcgcacgcgcgagcagcgtgcgggcggggaagagagagagagagagagagagagagcgggagagcgcccggggggagagggagagatgggccggggaagaggggaagatgggccgagcgagattcggcccatcgacctcgggggagacaaaatagacttttgcggaggaatttgattggaaggaattggattcggagttgaactcgacgatagatcggggattgagatcttgagatggcacggacactagacaacaagcaaagaaacaaatttcgcaattagggtttttaagagataattttcccgctaggcgccacgacggaacgggcgctacatgcggactatggagcaaaccggcagagtcatggttgcatacccatgcaaaacacggtgatggcacacatattggctctggtagctagtatagtcatttgcaccacgaaggggatgagcgttgagagacaagcaacggaaatgaacagttggggactcagggcgaaggggagcgtaatcatgaaattgaaagatgaaacaatgattgattgcctcatgaccaacctggagtaattcattgatttgattggctacttatgggttggtggttgatgtctaacatgtatggtccagtactaaaggagggttctggaggtggggggcgatgcggatcgtagttgggttggtcgacccacctaccttaccaaataggtaggtttgcccttgcgtacgacacgaacagagggatgggtcaaatgggagggaatgactcaaacgccaaagggatcggaggttcggctcacttgggaccgcaatggaataactctataggaaggttggggacttaagcatgaaatgactaaaataaaaaatattcttaattttgtggaaaatttctaaaatgttcttgtttatactggcaatactacaagtaaattactatactgtaaaattcctcattattattattattaacctgaaaaattcagttcgattcattctgatgaagatctatatcatacaaaatgtgtgctcaattaattctcctccgtcgaaatggaacctacgaagaagaattaagatcgattgatctgctaggttgtacacgtgagatatgcatttgattacataattaagtgaggcagctagatgcatgtcagggggaggcgtgttcctcgcacatgaatgtgtccctattatggatgcaaccatttttggattgtttggggatggtcggcaagagataaatagatagataccgtcaaacagtgacatacacacgcagttcaagtggtaagtggttacaattagtcaagggggtgaatagtgatataacgatcgggacaccctaattaactcctcgttcttgttcacgcatcggcagtatatttctgcaggttattgccatgccctctctcggtcagctcatctcgcttaccaactaagtaactgaacaacaggttaaatgtactaagcgaccaagcatatatacgcaaaagatcgttgcaatatgctgtacagcaatggaggagccagggatcaggggatggcgacggcggcgacggcgatccttgggtggccggaagaggcgacgacgacagagacgcggaaacccgacgagctagcaaggtagcggtcgaattgagagggattgatggacatggacgtgaacgctcctaattaacctaaagcatgatttcacattccaagaattgaagttgcgcgacgacgacgacgacgacgacacaccactcaccattccgaaatggaatctggagtggacgacagagagggtgcttatatctagattagattagaggtgtaaagttttaacgtgtcacatcgagtattatataaggtatcatatgtgatgtttagacactaataaaaaaactaattacagaatccatcagtaaacaacgagacgaatttagtaagcctaattaatctggcattagcaaatatttactgtagcaccatattatcaaatcatgaagtaattaggcttaaaagattcatctcgcaaattagttatttttttagcatatatttaatactacctccattccaaaatgtttgacgccgttgacttttttaaaaatgtttgaccgttcgtcttatttaaaaaatttaagtaattgttaattctttttctattatttgatttattgttaaatatacttttatgtatacatatagttttacacatatcacaaaagtttttgaataaaacgaacggtcaaacatgtttaaaaaagtcaacggtatcaaacatttagggaaggagggagtactttatataggtgttcaaatattcgttgtgacagggcctgactgtcgtgctactctcccgtttccaaatagaaacattttacggtattcagatttggtatatacagacgttgtaaacattggtcggccaatccttcttcagctgtcacggcaaaatatatatgttataaatatttctcggacactaatttcaatccactgcaaaattattcgcatgtctagaatcctaccaagagaatacccccatttttatgttattgaagtaggattgacgaataagaaataaacataatattatttattagtgtcgcataaaacccgaaatggggcgtggccaagtggtaaggcagcgggttttggtcccattactaggaggttcgaatccttccatcccagattttttctgatgaaacgaaagatgaaatcgtattgtattctgcacgagacataaagtttattaaagagaatttttttctcttataatcaagcttttatgacatcaactacgtacttattaggccttgctgaattctggtgatgtcgtctctcttgaaaacttaattatgacaaaaaaaaatctctgcaaagttcctgccttttgactttagaaaataagtccgcaaaaaagttcatggtattctcaatcgaattcctggaacgcctggtaataaggtttgactagtgactagtactatatggtcttcaagtgctgtactatactactatacattttacacggtcgaacaggtcctcgcaatgcaagtgccaaaattttaccaaattttataatggcattgcgagccagcaagtcgtatagtgttggagcaataagtctatgatcgcaatgcatggtcggcgcatttggctgctgaaaagagcatgtctatatattctctgaaacagactaactggagattagcagccaatatatatgcatggagaagaaaaaggttttgggttttgagaatattagaattcatgtcactttctggtgtgctgcactttcggcagaacagtcctgcatcaatcgtattctttgattggctcttcatttttgtttggatgcgaatcagcatgatcactcatcagtcatcacatattgttagtgtgtgtatgtaacaaatcttattatgtttgatcaaacgagagaaacatcatatttattatctaaaaaagataaaaacatcactatagtttgtcttgaaaattaaatacccttttgtttttaacaacagatctttttttgggcaggcaaacatgcaacatagagacaggttcattttgttatctgtatggaaccaataagctttaaagccttttacatcaccaatgcagtgattaattttcttatcattcttgttgtagtattgaacgggagaggtgtgttgtgccgcgcgctctctccctctcttgatttcgtgcgtatacttctcttctcacaagaaaaaaacatgttttgcacatcgacatggttttcaaagatgtatctgatcactaatttctactgtgaaatatttatgagccccaatccaaagattatgatattataaaattactttttcagcaaacatatatgcccctctgttctaataagcccttgtttagttttaaactttttctttaaactttaaacttttccatcacatcaaaactttcctacacacacaaactttcaacttttccgtcacatcgttccaatttcaaccaaactttcaattttagcgtgaactaaacacaccctaagaatcaatttctagctataaacagcttggatggacagtgtagaaacgatctgtttttttttaactttttggttctttttgaaaacttatttcataaataaacctctggataaaacttattctagaaatgaaccctttttgcgttgccgacatcatcggtatcgtggtccaatatgatggtgtcaacgacattgaccatgtcccgcgctcgaaactaagttattgatgtgaaaaagataccaatttgtaaataaaaattctgaaaatgaccctagtagtaataaaaaaatatttacacatagcacctcggcgccaatagcattggaccctttacatagctgaggtcttgttcggttaatccctcccacaagaggagggatttggaggggatttattccacacctattatggtgtggaattattcccccttaatccccattattccccctcttagggattaaacgaacaaagcctacttagatatcgtcgtgctgaaatacggcaccaatgacgagttgaattatggcaccaatggtgataatatcacgaaaatggtcatttttaaaataagtttttagtctatttataaaataagttttcaaaaagatctaaaatacgaaaattacagtagaaacgattgtcctgcattcaatctaaatacttgaaaataaaacactgatgttttagtgtttttatactttaactaaaaacatactttctctgttagaaaaaataacttcttgctatgtatttgaaagttgattttttcgggacggagggagaacagtacgtgatgtgcctcatgactaaggtcatgtttagttcacaccaaactttccccaaactcctaactttccatcacatcacatcacatccaaaatttttctactcacataaactctgaacttttttttcaaactaccaactttccctaaacttctctccaattttagaaacccaactttttttttaaactaacaactttccttaaatttctctccaatttcagaaactaatcacagcctaagtacatacgtggagctgtgaaaggacgaaggagatggctcaaacatcacagctttatacacatagccaaatgacaaggcagaggtagcaaacaaatcaatgagtccagagcaagttccctctttttctacgcacttttatcgttatctcggcactttctgctgttacaagtcccgaattcaaagcgtccagtcattgcagccaagctaggatgctcttcgtgttcaccggaccccacacatcgcgctcacgcactttcatttttctgactcatttttttgttcttttcctccgcatgttaggacaaaatgtagtttttccatgagggctttagcttttcatttctttttttaaaaaagaaacaaaatgtccttttagccctgttccctatgagtttaaaacttttcttttgaaatgcttcaggcgcttaaaatcttccatgtttccattcgttacatttcactattttacattaatcatggaaaaactttggtaagcagcaaaatacaatggctgaatagatgccaatgcaaaccgaaattgaggactggaggtctcatcagatggttcaagcatataggcgatgtgtaattgccaaacgagaaaaaaaaatttgaaaaccatcaggttccacatgatgcaatgcacatcactacaaaactgaaccataccttcaaaaggttaaagcagcaagtaacacatcaagaacatggtagaaatgaatggaatttagatggctctagtttattctccatcctaggctaatcacaaggaacccgcctttcttcacactatcatctcacctggggcccaaagattccaatggaaaacgaaaaaaaaaggtgaaattgtcagaaaagcatccccttaattacaatcttctcatctcatcaattctctcgtctctagaggagcactgcaacgcaatgatcagcaggtgtttgctcacatcacccgagaaacaaagtgcaactcagactcaaaagcgtagtataagcaatgcctctctgccttttgccttccaggtcacaacaacgccactcatttatcgacatttgggcggagattgcacaataaaacagtgcattttcaatcccactcctagtagtgcaacagtcgtcccaatgaacactcatcatcatcttacctttttctgttaaaaaggcaacaacagatttgggggtgaaaccatgacttgttcccctaacctcgccagctattttgcttcttggcctcaaaagtggctccatcgtttagcatatcttgtgcgtcagtttccatgccgagctttgagagagcaagggcttgtaggtagaaggcagttggccactcgggcatgcagacctgggcctgcattgcgtcccggagagcaagctctgactgcccattcatcaaataggagaaacttctccgggcaaaaactgtggctgaaggcactgacatcattccaacaagctgcatcatggcaaatgagcttgtcataccatagggcagaagatattcataacgctcactatatataagtcacataaggaccacataaggctactagtggctagtagcactcgagctaacgggctgagggccaaactgtttcagaaagttgaactttttgaccagttagggtcctttcctattataaagctccaaaacaacttgtgtcaaacaaacaatcgtgaagcaaaatgtcaacattgcaaaggtacggtagcatagcctaggtaagagaaaacaatgataccttggagtagtagtcaattgcagtcttgaaatccttgtctctaaatgcaatgtcaccaaacttcttggtattcagcatctcttgcacttgctgagtccattcttgaaaggacagcttcagtttttacatcaccataaacatgcacaaaataaaactagcttatcttaacaaaccaaatgaatgtgactccataatttctgaaatatttcagcaagtggggacagcaagagaagagctaaggtacataaaatgaggttagcttttgaaattataaacaagcatgaatgtggtggttggtgaatgcaagtaatctctcttcatagcaagaaaatagatcatgatgcacaatccatgttttctagggcatttcaagaatgagtaaattcagtgtgtgatatagctcagatgcatcatagactaggaaaacaaatgcaacaactttacagcaagatagttacctcattttctgcaccttcttcatctttgtaacctgttttgagcaatatatcatgtactgctgtaaggtccataccggaacaggccttcccaaggggagaaagaatagttggcaacaccgccgtggcttttgtaatacccatcaacacatgtgatgctacctagaatgattgatataagaaataaatggtgttaccaaatgcaatgaaaaacattagcagccgacaaaaggctgtcaagttatttacctccttttgcttctgaagaggcccaacagaagacaagagatactttatattgggtctgtccctcgcttcaaattgcaagcatttcgacgcaaggtcaactagttttgaagcatcttcattagcatactgcccttctaaggaggaatccatgagcaacagtatattcttccctcttatcaaatcaagtgcctggaattccatacaaatcaagtgagaaacctactgacataaacattgatagttgacaataaaatatccttggcataaattcactattccgcagtcatgctctatcagatgcacggcatcctaggaataagttcattgtcacatattctactagaagtctatggtctgttatttgagacaagaggccactgtctgttatacaaatttagtggacatcagtaggttaaaggttaaggttcaaatccgattgcagtccataacactttttatcagttgtcaatgtgacattaaatacagatgcagtgttatccaggatatgagagtaatgataaggagaagcgctgatatatatatttcttgagaaaagtaaggatttaaacgaagcatacatggctaggaggtatgtgcttcccactcaaaagatccaaaagaactgttccatagctatatatcacactctcggcgatgactctgcctgtcatacaagtgtcatgcacaaattgttcggtgcagtcaaacaatgttagtacttgggagtaaatatatagcaagcttgaaataagttgacatgtttcatttttgctggaaaacatcaatagagtaaggtgcccatgagtgcggtaataaggatcatgtgtaaattcctaccagttcgtagaaactcaggcggggtgtaagccagattagtgctataacttttcccatcgcggctgttcttcattagtccaaaacttgacagccgaggatcaccttcctgatagaataaatcatgccaaagttagaattctctcggtagttacagacatcagcaaagcttcagaaagtagtaaattttgatcagaaagcatccgagttcacaggaggaaggaagtgaaaagcaatgcaaaatcagcagaaacaaaaggtgttttgagtggaatgtactagcagcaacaaacatacctcatcaaaaagtactctataagcattcaagtcatgatagatttttcggttctcggcattgcagtgatcgagtgcctgcgcaatgtaatacgcaacccttaaccgcatttcccatggcaagggctgcttatcccctgcagaaaaaaggtagatcgcccttgagtcaaacaagaaagaaaacaaaagggggaagtaatgtggcgagccaggttgtccgggcaagcaacatccatccacataagtagcaagtgctagtagcatttggcatgaagagcacacacaagtcaaatgtagtaatggtgagaggtgttccattaatgcagacgagattcgtggtttgatctacggatcatcaccaagtacgtcacccaagtagttactcctagtagtggacatggatacggaaatggcgaaatgaagaggaagagggtatggtagtagagtacagtggaagagatgcttggaaagggtgtcgttgggcatgtactcggcgacgagcagcctctcgtcgccctcggcgcagcatccgatgaggttgacgaggcgcttgtggcgcaccttccccaccccggccgcctccgcctgcaatgcaatgcaaccacaagagaaaagcagtaatagtgaggaggatgggtggcattgcgagatccggagagagagagaggcgaggagaggtacgaggaactgctgcgggtcgggccaggagaggcgggagaagcgcttgacggcgatgaggcggccgccgtcgaggcggccgcggtagacgacgttgggggccttctcgccgctctcggagacgatgaggtcggcgctgaagcccttggtggcggcgcgcagctcggcgaggccgaactccctgaacaccgggaccgcgcgcttggcggcgtccttgtcgtcgccgccgccgtcggccgccgcggagtcagcgccgccattcgcggccgccgcctctacaacaaccaagcaataggagtagattagattaggaagcaagagcggtggtggtgtggggatggggggttagggtttaggagggcggcaatggcggcggtggggcttaccgggatctgcggggttgtcggcggggagcgcggcggcgtcgttgggcgggaggggacccgcccccgccggcttggacaggaagcaccccattggaggcgcgacgcgaggtggtgagatctagggcgaggcggtgggaacgcgaatgcgagagaatatttggggcggggggaatggcggcgagtgtgtagtagggaagcagtgaagcgaagtggggaggcgaggcgaggcgaggaaggcgaaggggggcagggccgatagaagcggccgcacagaagcagatgatgtggtggggagatccggccggttggtgcgcccgcaacacccagacccagtcacccagagcacccaccccacccacgctctctctctctctctaagttttttaaatctcattttcgaagggaatcaaatttctttgctccaaccaagtggagtggactaagagaaagtttaatagaatagccaactactagcttcaattcatctataaccaatctaatagtttactcatacaatagttacatactacactattaatatctggtcccatatgccatatacacactgcgtcttagagtccgtactgcagctagctacaaatctgtagcccgctgccattctctctcctcatttatctccttaaaatatgtttgcagctggcttatagcctgctattgtaccttagcccgctgccattctctctcctcatttatctccttaaaatatgtttgcagctggcttatagcctgctattgtacctgctctaaggctgtgttcgagcgcaggagaaagcgagaaagattgtttcgctttccgcgcgcacgcttcccgaactattaaacagtgtgttttttgcaaaaaaatttctataggaaagttgctttaaaaaatcatattaatccatttttgaagtttaaaataattaatactcaattaatcatgtgctaatagctcacctcgttttgcgtatcttcccaatctcctcaatccccttctcctcaaatacaccctaagactatgtttagattaagggcaaaaatttttggcgtgtcacatcggatatatgggcatatatttaaagtattaaacgtagtctaataataaaacaaattacattgtcaaatgtttattaaattgcgagacaaatttattaaacttaattaatccttcattaacaaatgtttactgaaacaccacattgtcaaatcattgagcaattagaattaaaagattcatctcacaatttacacacaatctgtgtaattagttttttatatttaatatttcatacatatatgaaacattcgatgtgataaggtgaaaaaacttaccaggagatctaaacaccttaatacttgtactactgtaaaaattattatagaaccttttttttaagagataagcatagaagtactactatctctatttagatcagaatatgtcgttcaaaaaaatatttatatcagaatacaggtctcctttgcagtgaaggtaacttcacacacaaaagaaaaacagaggggattgaaatggttcttttgaaattcctgtaaaatttctatgttccaaatgagtcattgatgtttttatcttagtttgttcatggcatcgtatctatttttctgtatcgggtgatttttcttcagctggcttggtaatatttacatcaaagtataggtcttcctttgcagcgaaggtaaataacacaacccaaaacaaaaacaaaagaagaaggagagggggattgaaatgtttcttatggaattcatgtagtaatatttgtgtttcatgcgagacattaacattctatgggcctgtttggatccggagggctatttaatagccctccgaaattttgttatttatgagtattaaacgtagattactgacaaaacccattccataaccccttggctattttgcgagatgaatctaacgaggtatattaatccatgatttgctacagtgatgctacagtaatcattcgctaatcatgaattaatatacctcattagattcgtctcgaaaatagcctagaggttatggaataggttttgtcagtaatctacgtttaatacttataaatagcaagattctagagggatatttaataccgggaagaatccaaacaagacctatatgtaagtttgttcgtagcatcatatctatttctgcgtgtcagattacttttcttcaacttcaaaacttgtttagcactcttgtactccccaaactaaacagtgtcattgttcttatttgggggagtgaaatcgacaatgtaccaattggtcaatgataatgtatgtctggacagaattggttccatggacaatgatgaggtcaaacatttttgctcacacaaagtctcaaaagtacacactttgacatgaaaaatgctgcctttttgcgttgagtgggattcagattccacattctatatccctttgcatcatccactgaacagattgctcatttgccacttccatggtcttgtttatgatacagcgtgaagttcgtcgatcaagtggccatagtggagaataccacgagtttaattcaggcaacgctgctattagtattactatgtactccatccgtctcaaaacaatcaaacatatgatatcctaatactacgaatctattaaaaattttagtactataatactccctccatctatttttgatagtcatatttccaaatctaaaaaatttatttttgataggcatatttcaattcaacaacctatcatcttaatgatttttttggatttaatgcatgactctccattcttccacacaagattggctatatgggtattgagaaatgtaaacattaatgaatcgcttatttacgaggaataactagtagcatatttaaatggatgataagtagaattacttatccttggtctatttaccaagataaaatatgactatcaaaagtagatggagggagtatatcatactaactagtaataggcttatttattttgaaatggatatattacgtatcggaagaaaagaatatagttattgcggacattatggaagaacagcctcccctgtcgtgttatattgccatttattactctacgatactccctccatctatcagtcatatttctaaatttaagaaatttatttttgataggcatatttcaatctaacaacctatcttcttgatgattttctcggatttaatgtgtgactctccattcttccacacaagattggctatatgggcatcgagaaatgtaagtattaatgaatcgcttgtttacgaggaatggctagtagcatgtttaaatagatgataagtagaattacttatctttggtctgtgtgcctccctctctccctatctccggtatacagtagtagtaactgtaaatttgctcacgacgcacggcccctatcagggtttcctaaaccattgggaccggggttatcgcgcagtaactatgaaaaaccgtacaaaatttatcaaaaacttaaattattttttaaatttatttgaatttaaagaagttatcgcggtatttatattaccgtacctcgcaataaatccagtaaccacggtaaccgcgcggttaccggcggtaagggaaactctgcccctactacgtctacacccgcgcccaggctgagataaacaaaaagaaagtcgcatgttcgcaggcacgacacgtgggcttgccggcgatcctccttttgctgggccccacatgtcaggacgacgtgacaccaccaggccgggacccgcgccctgacacccccacaccccaagtcaactcgctgtctcacaggcagactcccctcctctcgtgcgctgtctccaccaccaagagctagtgtcactcacactgacagcactgcgcctcgctggctttgagattttgatttgcatctcctcctatcctcggtttgtttgttgggtttaagtacgggagctcatgccccacatgcttcatctgctgatcctttcggctgagttcgggagccgcctgaaaacaatgttacctattaatacgtgattaattaaatattgatttaaaaacttaaaatatgaattgatataattttttaaaacaactttcttatgaaaaaaattgtaaaaagacgtgctgttatttactccatacgtcccagaaaaactcaacttctagagtttgaattttgtccaaaaaaacaaatttctacactcctatctaccctcaacacgtaaaacgagaaattttattccttcaataccctttaccaacctatcactcttactacttttttttaataattaagaacattttagttattcttgattcctactaattttatctaggaatgctaggaattgactctctgtgggacggagaaagtaatagttaaaaaatgtgagaaaagggaagaacacaccgtcttggtcccgcctctactctacccaaacccaaatggagtattcctacacagcacagtgtagtacacaccttgttttgattgatggagtactactagctaagctaggacactagtactactccgataccgttatcacgtaggcctagtgcgcctaattaactttgattttagtactagcatgaagatagtgctagcgctgttttttgttttgtttttttgcctttgggaaaacatggttgcagtggatcctatgtgaactgaagctagaggtagcagtggttcagggctcatgacttgttccggcagaaggtgggcccagttagctgggcctgggacaccacatacatatgagatcatgatgccattgttatcaccagctcgatagtactatggcccatcagactatcatggattcatttcatggtgcagccaaggacatcaaccatgatgcacgagagaacacctctactctgctcttcaccaggaaaaagggcagcgagcgaaccctcgtgctaacccaaacttaacactccattaccatctgcttattctcataattcctaaagtaatacttactgactccccggtcccaaaatataagagattttaaagaaatgtgatatattctactactatggatttggacaggctctatgcattcataatacagtcaaaaccccttatattataggaggaagggagtaattaagagtaaaactgacgaaatgttcagtccaattggaaccatgtgaaaattaatatagattatcttattcaattccagagcctacaagtaaaatcaacataacatataataatccaaacttgttccccgtaaaagttactcgtaatttagcacatcaagtaacaaacaaaatttgaacaggtacatccctgtgacggtatgacggtcaggctcattagccctggactttcctcacttgaatgtggtgagtagactcctctctccagatcgacttcactccactctgaacaagggtcacgtagtccccttctttcacgaattgggcgttctgtcaaacattcaaaaccacggttcataagagaaacacaggagtactttgtaaaaggactgaaaaatgatgtcaataatatcaactgtgtcggcagcgtgaagtacatacgcttaccagcaagctactaattgctctagagaaagttccctctgcatcatcagaaaacttcatgtaaatgggaaccacaccctggtagagtgccagacgttgcttcactcgttccctgcaacaacagtttcctcataatggtcagtcctccagagcatctttttcaacttttatcatttatttatttagaatgtttacaaaattgatttactaaaatgaaaacactagggaaaaaagatttggcattgcatgtaggtagaaatccaaaaaaaacttactcatttgtaaatgcaaaaattgtagacgagggccggtagtggctgagaaggactgccatggagccggttcgtgtaaacacaataattggggtgcaaagggtgttcgccatcattgtagcatgagatccaaacattttgcttagttggctttgcgaaaattcctcgttgagcagagcctaccaaaagaatcatgagaaaataaggtgctaaaattcaggtaacaaacttaagaaaggaacttgatgtctaagagcaggtgcaatagcatactacaagccagctataaacatatttcgaggagataaaagaggagagagaagagcaccgggctacaaatttgtagccagctgcagcacggactccaaaatacatatatgtatgacaggtaggaccaaatattaattgtgtagtatatgtttataggtaactattgtatggattgctattaagttgactataaatgatttggagccagcagttggctatactattaaacttgctctaagcaatgaacatcgaacaatgcaaaagctaccatatggtaaatttaaagttgtgggaataagagatatacctgaggatgtgcaacaagactaggagatgtagttgggttatacaggctggattctgttctctgtgccactgtgtgcatcaccttgactgccttcagtgggaacctaaacacagtaagatgcacaatcaaggtaagtctaattggaaagcagaattctatgcacccacagcaagagcttaaagaaataaatttcttggatgcacatggaggaacataaacaaaaagtaacctgtgtcaggttgaaatcttactttccatgggcagtttcaccagacagcatgatggcatcagaaccttcacgaactgcaattgctatatcagaaacttctgctcttgttggagtgggatggtctatcatgctctctaacatattcgtggcaacaataactggtttctgcatgcttcggcatgttctgacaatctcctcctggagaagtaaaacacatgtgatttaaatgttgttagtgctttattcatttgttgcattttaggcgtgctaataaacaaataaaagggatgtagagagtgaggggggaacaaacacatgttttcttgcactagtaaaattatctacaaatttaaactaacctgcagcaaaggaacttcctcaattggaagttcagcaccaagatcccctcttgccaccatcgcctacaaacattttcagagattcagtatctagcactaagcagttacgaaattgtaaaacattcaaggacaaacgaaaccagaaatagaacaaaagaaaacaaggtaacaacgaattaagtgtttgaatttccacgaaagcttaccaaacacacattgcttggctcccattatcatgataactatctaaaggcaaatatatgctgaaaagagatgccacttgccaagatgtttttaatacaaactggttgaaacaaccaatgtccatggtcttacttaccccatctgaagcagcaataatggactggaggtttggtattgaatctgcactttcaatctttggaatgacatgtatatctgcattagcacctggatttggaaaagaacacagaacacaggagattaatcaagttccggatatagatattagaaattccatgtgtgccagagaaaatggttacttttaaggtagtccttcagttcatgaataacttttgcatccttcacaaaggaaacggcatagaaatcaacaccattttcaacaccaaactttatgtcctcccaatctttttctgttaaagcagaaggatgtcagcatcttgtgcataactatctagaggttgaacatgttatggagaaatcaaccgacctgtaatagatggcaaagtcgcactctttccacggacatttaggtggcgccttcctgttcagttccccaccatcaactacttcacacttaaccgtatcagctgttttagacttgacagcgagggggtgcag

SEQ ID NO: 68773 - DNA, 8075 bp, Oryza sativa
cccagctctttggaactcctcaatggagagtaggatcgcaagagccgaacttcggaaaaaaatcgctcttgtctctttctgtgatgtttctttgatctatcctctgcttagaatacctgcgcaccatcttgtgaagattggcttagtctcctgtttcgaaatttcaatttcttctttcatctgttatccgaaagttcctgtcctaagaacaccggaagttccaggcctggcaggccggaagttccggagttccttaccaggaagttccaggtctgtttgaattttaccgctgcgatttgtctttaagtttttagggacagcctattcaccccacccccccctctaggcttaatcagcgcgttcacttagcacttgtttcaccaaagtacttacatcacatgcatatgtggaaggtgatgtagcagtcatggtttgtctcccgtccaactttatctcatgtccataagaaatgtaacctgccattgttagtagaaaacagagaacaacagaatagtattatccctattaactacagaacatggattgtagtggaggctagcaagtggaaacaccttaccaagatcttacaagtgtcttaccagcaatgctaaagacggtacaaccggtggctggttcatgtcaccttgaaggacgtgatgtggtgattgcaaggatcaaagtggtgcgaaccagaagtatatatgtggagcttgggagacacaatatatagtagcataggaacacaattgtgctaatcagaaaattcagagttgaataatagttcaaagtactagtcaatgcgctggcctagcctagactcaattctagctcaagcaagcacccgacaacactaaggactagatataaatcaatgcacaactttgcactctcaaaacatactcaaaagatgattgattttttttgtgcggtttttttaagcatctttctgcattttttttatatttttaggcgcggctttttttctttgcacctttctggcttttttttcagcaggaacctttcaatgacctcaacgagggactcaaatgtaaataaaaatattatagggagtcaaatgcaaagtgcaaaactaaaattggatcacctcaaaaatggaatgctcacatcatgtaggttccgtttttacaaaaatatctcaaatctacaaccaccaaaatacctaacaatgtggtgaccgaggagaaggctgttgggatttcttagcgacactactggaaatataattcccagcaatagcactagaaataaccctggtatattatggtcacagatgtgatccgcaagtgcacagatataccattgtagcatttcacctgggagtattccaaggtatcgtatttattttatcccaagggaagatatgataagagagtactatgctaatagtttatatattacttatatacatcaaggtctatgcaggggtaagttaagcttaagggtagagtgacacacagctaaggatttagctaattcctacatctcctaatcatggctaagtggaaaagtatagaaatattctattcatgtacttctagtatacaagtacctagtctatcctaattagtatactctactgtggcataacccctttaacaatgcagcacagctgagctgagactcggttgtgccctcccgatgcatcggaaagttaccccgggttgccgagttttttacgacaacctgtcataaccatccaatcgaagaaggatacggaggagtatccaaccctcggaaattgtatgtaggaatataaactgtggggaagactcccgtactgagctgtcaccatcagtggcccgctgctcttccggcgaatatactcccaaataatgataagtcttagcctaaaccccatgcttaagctactacttattactctgctgtcatgcctagaatttctgggcgtgacatctgcagccttgcaattggtgcagagcatctatgtcccagaaccatagccctcagcttagcctaggctgacgtatggcccggtaaacagacattataccagcatcaatgcaaatcccagaaggtttaaccaacgagattatactaaatataaataagactaagcatagcactcatattctataattggataaagtactaaacttgtataaaaagaagaacattatattactgaaaaggaagtcttacaaaagagaaaaggaaaagctaagaactataccgaactctccgaagcttccgcggactccgaactattctattcctattccactagcactatactaattctaacttcggagaaatggagcttcaatccttgcttgtgtgtgttgtgaagtgagcatgagagctccttaaataggcaggtatgacagttgtagagcatggaaagtgttggaaatgccctgcaaccgccatcaggagttcattcggagcgtccacgccaaaccctagcctgaacggctgtgatctggcccaaacggcccaattcttggcaggccgactcctcatttgctcctcattccaaaacatggaattttgggcttaattgatcatgtcttttctgagttcttagcgcatctatccataagtctgatcctcgacagcatctgattgatcgttcatctattttctgtcgattctcctccatttatatgtgcttctcctgtatacatgttagtagcatagtatatagtggaagtagatattttatttggaatttatgcattgtaagcatagccagtcttcattaattgggtaatattgacagtcgaaacaggtcgataacgaccgtcaacaaaggcacggaagaaacccatgaggtagaggtgggggtcagccgtgacaaggagctggagtcggactactgtggaagattggaaaatatgtggagattttattccgtttgacgacacagatcagataaccccctgtagaaaacaaactgatatgccaatatgtttctctcctcaacgtgcacacaaaaagcacgacacagaatagacatggcaacagacagcaacacagaaaccctagtaatctagcaactccaaaaccgctcaaagaaaactccaaaccacaaaaacggaaacctgatgatgagtagattcgatttttcaaggtcccgacaacaaccgacgagatgcaaaactggacccaaactgatggacgtgactaacccaaagcgatgtacaaatgcagtactcacaactaaaaattaaatctaaaactaaaccagcactcaacacgaagatgcaatctaaaattcaacaacgcaaaaactaatagaacaatgcaatggatcaaattgtcttggtaaagaataaatatttttgcatagcaattttttggttaagggaagataaattatctaacggcaatctggcgctttgataccgactgatgaggatgttaggtctcgatcttccgattgttactgataaacagtcgatttgggcagagtcgcgacacactcgatccggcttctgaacaaacacgctactgagccccgtaatcgcagaaccacgtctcctctggttatcaaccgtaccgaaactcagttgacctcgccgagaaggttaatccctgcatgcgaatcgaaaaacacaagaaagaacaagatatattgcaaccaaattgcacatgaatgattaagcactcgaatttggggttccacaaaccgatctagcggcgaaactgttattgatagattaatttaagcaaaacccaactctaaacgatgacggctactgaatatatatgattagggaagtcctagggttgccctagggcgcacacccccttgggctaagcccacgacacaattacaaggcccaaaacccaaatcagattcggactggatgagatacgtggcttgttttgcagattcctggcagctcggtaggaattttgacgtgcgacgaaaaccatctgaaagtagactacataatctttccaataagtacttatgggccccaaaattccttctatatcagcggctaggtccgtttgaagttggtgctgtcaggaggcctgaatccgaatccaaaacatatagaacttcatctcatctcttgtcttctatggacttggtgaggtagaagtagacttggagaaggtaatggtttggtccccaatcaacttttttcatcatccatgcattcgttacgctcggtctcttttcctttgcccaagcaagtacctctgcaaaaaaaaaactcacgaaactcattgtgtagcaaagtttgttcaaatatataacatgtaaatctaatatagaacatatgcacctttggttgattaatacataaggtagtcatggttatatccgagctagttgtgtcttcattacgttggttccaaagaggagacaaatgaatagtgttgacaaaaattagcgacacgagagcgagtggttaccctctttctaatgtcaccaagtatgttgtcgacgggatgatctctttggacggtgtgatgtatccttggatggtgcactgggaggacctaaccctgattaagatgctctacagtgccctcggcatcaatcccattcacttgtgccgtaggcacgccttgactatcatcagtccggaacttccgggctgatggtttcgaaacttcttggcatggagaggcccggatgttccggtcctcagtccccggaacttccgggtctgctgacagtggacttgatgtagggctattgggtgtcgatgacggaggttgatccctatcttcttggtcatcctgtgtctcgactggtcgtatatctccaatagccttagtaccaattgctttgctaggatccgcatcatctacaacatgtacaacaacatgctctcgttgggagccattagattcatcaaatgtcacatacgtagtaacttcaacaatactggaggttttgttgaagacacgataggcatgtgtatttgattcatagccaagtaagaatctcttatccaccttaggtgagaacttagatgaacgaggcctcttactcaagatgaagcacttactcccaaaaacacgaaaatatgaacatttggcttcttaccactcaagagctcatatgaagttttgtcacatcctgattttcatcttaggatttataaattatttaagaaattattattagaatttatattaaatgttcattaatttacaactgaagttaaatgtgggaaatcaaatttcctaaatataaagcatggttggatttaatttttattaaattctccatgattaattatactctctgaaattttttcggatttttcggagctcaattcttaattttaatcatacaaagaacatttcagtaattattcacatattaaattaatcattaaatggtcttcttataattttattaaatacttatagtgttcaagtactttcaggatttttcttgaaattatttgagcaatataagtatttttaacaattcaaggatcatttcagtgattaatttaattggaaaagtaattaaaatccccttttcattttcgggctgaaactggaaaagtctatccgtcatcctcagcccgtccttcctctttgcctgtctctgcttcctgtctccttctttctcgaagaagtctattacttatccctctcttcttttcttttcagaccagtgaaaagtctacttttcctccctgtcgctgttgttcatcttcaacctcaggacagccgaactgagaccgagttggctcggtttttctcctccgaatccggccttatctctcgtgtattccgaaaattagttgaggggatttgtttcccttatcctcctctatctcttcccccaaaaatccagttttatccctttgaattcgacgcgaatttggattcgtttgcgagtttatctctccaccaaaccctaggttttcccggcgcgattccttgcgttccaagcccgatctctctctcccatggctataaatagagtcccctccctctcctctttcgtttgccaccctcgcccgagctcgccgtcggccgtagcgccctagccgcgtctgctctagcgccgccgtcgccgccgagtttccagccgcgccacgccgcctttgcagccgccttctccagtcgctgtcgccaccatcaggttcacgaggaggagccgcacaccgtccaccactcggccgaagccgaagcccgctggagcgccgccgacgccgtcaagccgagctcaccaccgcctcgatctcgttgccggccgtttttcattgtcgtccttcgtcgtgccgcccctcagtgagtttcccacgtcgtgttctttcttctggtgccttcggtttggccgcctaaaccctccatcgccggcagtggtgtggtccagtaccatgcccggtagtgatgtcgtcatgacatcattaatccttttttgtttaaggctaaaatcagatttatcttgtaaaattcataactaatttatttgaagttggaattaagtggttcaagtctctaaattcatctaaaatcatgatttacatgtttgtttacatttatgtactagccgcgccacgccgcctttgcagccgccttctccagtcgctgtcgccaccatcgggttcacgaggaggagccgcacaccgtccaccactcggccgaagccgaagcccgctggagcgccgccgacgccgtcaagccgagctcaccaccgcctcgatctcgttgccggccgtttttcatcgtcgtccttcgtcgtgccgcccctcagtgagtttcccacgtcgtgttctttcttctggtgccctcggtttggccgcctaaaccctccatcgccggcagtggtgtggtccagtaccatgcccggtagtgatgtcgtcatgacatcattaatccttttttgtttaaggctaaaatcagatttatcttgtaaaattcataactaattcatttgaagttggaattaagtggttcaagtctctaaattcatctaaaatcatgatttacatgtttgtttacatttatgtactatttatttggtttttattagtctttttcttcattttgcgtgttagcttgtcgttttcgtcgttgcgaaggttcgcgagtgcgtcggaagagattcagaagactaattgaagaccgattattgcaaggcaagtcacacagatcccaaacacaatcctttaagcatgttgatcctatatttaaattatctatttatttcaactgtgcatttattttcgaatgtcaccgggtggtgtgaacctattcctttgttatggccaatttgcattgaataccctattccacgataccttgggtaatgaattgattagcttaaaccttatatattggtttggttcagctaaatgctatatatataattgcttagccatgaacattagatcgttaatgggatgactcatactacattattatttatgattatatttaatggtagctcacgatagtcaatcgtgattggttaattaattatttgccaattaaaatttgacaatggtgggttgtgagcacatggttttgaaggtcgtgctcatgacaattaaggaccggttcgcgggctactgttgtgagacattaaccgtaccaaccacaagccagcgtgggcaacggctttaccttttgtatagcatggttcattacggggtgccagactaagaagtggcgagaagtccgtgggggtcaatggggagtccatgcctctggttatatttatagaggggttgattatgatccaagaatggtgcactgtggtgagttgtgttgtgtagagggtattgtcacagcctctattcgggtactttccagcatcgcgacgcatggtagacatgatgttgaggctgtgtcttgtgggtatagtggtacacatctggctagagtaaaactattcgaatagccgtacccgcggtcatgggcgggttgagcaatgtttttcgtgattagtctcacacctctcacaataattattgatgctataactggtaataatttgcttagctcctggtttggaattagatctgtacaaccgggtatggttgttcagaatggttgggcctgagcagcatgggcgtgttgttcagtgttgattaaaattaatgatt

SEQ ID NO: 68774 - DNA, 33650 bp, Oryza sativa
  unsure (1)..(33650): unsure at all n locations
agacggccccgttcaggcccgggacctccggcggcaactgcgcgccgctgccgctgtccagggccgtgccggcgcgcgcggtggttgggcagcagcccaagtcgatcctcaagaagacggtcaccgacgacggcgcgccgtcggcggcggcgctccgtgatgccccgcgggtgaagttcatgctcgacgccggggacagcaagctcgagccgccgccacctgcagcgccggcgagcggcggcggagacgccgccgcgccgctcgccaagagcgccaccaagtcggtcgggttcgcgccaccgcctctccagccgccggcgcgcccggcacagcacccccacctgcagccgccggcgcgtccagcgcagcagcctcctcgcccgccggtgacccagccactccctccgccgccgcctctccatcagcaccagccataccaacctcgccacaccgacgcgctgccgctgccgctgccgctgccgccgccaccgccgccgccattctccgtgcagcagcagcagctccctccaccgccaccataccacctccgccacagcatcgacggaatgcaccaccagctccccggaccaccgctgccgccgtcgtaccagcatcgcgccgccggcggcgtcgtcttccccggacagcatcagcagcagccataccgccccaacaacgacacccagctcggcctccccggcgccggcgccgccgccggtgacgtcacgccggcgtggaagagaggagggagagagttcgactctgaggagttgatgagggtgatgcggggaatcgccaagatggtggagccattgacggacaagaacggcaacttcccctaccacctcttcacctcagcttgagagagagtgagcagcgtctctcacagacatatgggccccactgtcagtggcagtagctgggctaccataacctcttcacctcggctcgagtgagagagagctgtctctctgacagacagatgggccccactgtcagtggcagtagctgggctggtagtactagtagttggactagtagcttggtgacttaattttgccaagaagaaaaaggattttaaaaacaaggtgtgtgtgcctgtcatgtgatgtactcttgttgtagcggtactgggattaagtttggtttggtatgggtgcatcgaccatactattattagtacctttatttctgggattgactcatggtcaagtgaagaaacagttgcagacttgcaatatgttatttctgactatgatgttgcagggataacataggaaaatcaaaatccacaaaccgtcaagtagctcttcacgaggcacgacttatctccattttaagctccccggctgcgttaaatagtcttgattctcgctctggattattaggttcagtaggtttagaattcaaaactgtaatagtagttctagatttttttaaaattatcggtgagaaactgagagtacgaaaaaaattctttagctcttccaaacaacaccttagctttgtattcttagttgttgctctttgtcaactagctattgggtcatgagattcccgtatataacgtgccatattggtgaggaactttatcatccttcatatatgactttcgccttttactctgttatagttcctagctacgcctctctctctctctctctctctctcacacacacacacacacattgagatggcctccttttttatttttcttttaagaagaatttgagatggcttcctagcgatgttctcttgtcaagaagcacatgcatgtctccctcgtcttatgagaaatggattaatgaaccagttattattctattatacctctaaagaacctctgtaaaatcctatattccacgatgccgggggtagagccaggattatatcaagaatatggcttaatcactagagtatgtacttcttgaacaagttttaataagaaaattagcaaattccttggtattttttccgtcaggtgtggggccctgcatgatgcccaaacattctggacatagagaggccagtttacacgatttagttttcttataacattacttcatttcaaagtataagttcacacgaataagatagtgttcctttctagtgaagataaaaataaagttagcaaacgtaaaataaaaacgccgaaggaagacctgaaggatggaacactgtcctccttagcaggggcggattcacaatgggggcgaaggggtcttgagaccccactaccgcccccgggacagtggagacccccctaagcccccactaattcttttttccatagatccataggatgtggggactggaggttcgatttatactgatgtagtttattcagtccccactattattttttttctagatccgctcctgctccttggctaaacaatgttaatttacatgccttgcgactgtcacatttgaaatgaagcacaaaccaaaccaggtaatttctattaacaaatcgatcaattctcattccaataatattggcacggctaacaatcccacatgacaaactcttacaacctctagtcctagttgaaaatacctacagcccgattaaaatttacaattactttatttcataatcatagaaaatatattaaaattaacatagttccacttaatccataaataattgaaaatttttaattcaattttactctattatattgcccattaattaattatagtaattaatttaagcagattttggcgccttgactgcctcgaagcgtggctccttcgcatcgaacttttgcttggcgtacacatccatgtactccccgaacacgtactccgggtactcgccgccggcgccggcgccgccctccaccgtcggcgagatggtcgcctcgaaggccgggttgtagaaggacgcgacggagcgccggttgccgtcgcgcatggggaggacgcggtgccacgcgctgcgttagcggccgttgctgagcacctccacctggttgccggtgttgacgacgatggcgtcggcgagcggctgcacgtcgacccactcgccgcccctgagcacctggaggccgccgacgcggtcgtcctggaacagcaggatgacgccgccggcgtcggtgtgggcgcggaggccggtgatgaggtcggggcgcgggcacggcgggtagtggctgaccttggtgccgaagaacggcgcgtggcggccgtcgccggtgaaggcgcgcctcatgcgccccttgtcgaggccgaggttctcgtccatggcctccatcaccctctcggcgagcccccgcagcgccgcgcggtactcccgcatcgtctccttgaactccggcggtttcgacggccactggttgtcgtcgtggaggtagaagatgtcctcccagtccatgtcgtccaccggcgccgccgcctcgccgcgccgctccgccgccatgagcccctccagcgtcctcaccggctcgactccatgaacgccgcctcccggagtcggtagctctccgagcacaccttcttcacccgatcaagaagctccttcgggacgccatggttcaccagctgcagtgatcccaagagattattaaccatcttaatcaaacatgatcgatattgctgtcatgatcagctaatcaccaatcatcacatgatgatctggttaactcgataatgaaaatgaattacatttccggcttctgttataagtcaccagctaaccgttaacttgcattataatataatttttggtcgctgtaacaatttcagctccaactaaaatactccctccgtctcacaatataagggattttaagtttttactcatagtgtttgaccactcgtcttattaaaaaaattatgcaaatataaaaaaataaaaaattgtgcttaaagtactttggataataaagtaagtcaaaaaaaatagataataatttcaaaaaattttgaataagacgagtggtcaaacagtgcaagctaaactcaaaatccctcatattataggacggagggagtaggagtgaagctgggtgcgttggagatgaacaagagagttggagatgcgttttgactagtccacaacttcactccagactcaacacctggagctaaatttaggagttggatctctaccaaacagaccctaaaaatgcacgcagatctgattaattagctacctggaagaatccccactcctcgcagccattgtcgatctgcgccatcgtctcggccctctccgcggcggtgccgtcgagcttggagaagttgatcaccggaaccaccatggctgaaaccttgaagaagatggtggtttagaagttccttgtaaagaatatcaactttggtgttttcagtaattgagctgctaatgctgctgcttaattaagttgtgatggcttgagttaagctggagatggagatggagcatggatgaacgcatatttatagggtagaattgcactgatcaaggatggacataatagtttattttgcaataatgaacaaatagtttgcttctaagaaataaacaggataatttggtcaaagcacaggaaaatgttggagctgacctggcatctgccaggttatctgggatgaagcttctgggcagcgacagccgttggatgcttctggcaaattggtactatttgcatctccatgtaattatgcaccaattggagcaagctgatgatgatcatgtccttgtcatacgtgacctttgaactaaccctcattacactggcagaggattgccatgttgacaggacaaatccttgtaccatgatttcatattattgttcacatgaatgatgattcataattcatggagttgatttgatctcgtttatcatgatggtagaagtttagtttatcgaaaataataaaaagaactcgatccttgaaactagtagaatgatctttattaaattaagaaaaaaaaactatacaacacgacactaataggattctcataaaccacttaataccttctgccggcccggcgaaaaataaaccactgaacatagcctatcttgtttggtatcttgtttggtgggaggtacggatgtaaactcttagaaatagagtctgtcgtcaactcctattattttttactaaaaaatattcgcgtatggcggtatctgtaccaacaagcactcctcaattcttggaattctctcgtggaaaatatgtgagactatgacaaatttctatcaacacggtaaattttcctgaaaattggcatctgagatagtcggtgctactctctgaagattcacacaccaaagagtccaatgatcgatggcaccgtattccctgaggaaaaagagaagaaaatgaaaaagcttgctgcatcttgccaaagaacaaattgttctgagagtgttattgatgtttcctggatttttttttctctccaggaaagtgtgaggaaaatggctggaattcgtaggggccagaattgtgttcctctctctatctgtgtctgaaactctatctctgtttctgcttgtgaattcagagttgccatctcctttaatttttaatttggtcactagctcatccaattgctcagacttcacagtggacttcttgttcctttgctcttgtgttttttctgcaagtgcagcaaaattccataaatcccagtcactgcacctatcagcatgcaactgggggaccaaatgaattaaattgtccatgtgattgtcaagctgtcagatggaacctcggttccctcttccattttgtttccattgtggatatgtaaatgaatatttcagtaaatgtttgcagcaagaaattttgggactccctctcctcttctgaggtttctttcaaacaaaaaagaaattttgggaaaaaaaatttcttcaggtgtaagacgtataagtgcataacagagcaattcattccggaaccctactagttttggccttgttttagatatattgttgagcaggttattttcacgaattatcgatttaataatatgataaattattttttaaaaaagttaacaaatgacttaaaacatgtgatttaaacaatacagtagaaaaaagtatttttatggagaaacatgtttttaagcttagatcaaataatttgttttaataatccagtgaataagcttaaaagaacgtagagttagtggttgatttagggctaatttttttattggaaatatgactatcaaaaatagatggagagagagtggatttatgaaatcagtttacagctacgtatggaagaaagtttaggtcaattttttcgttaaagaaagtttagacccaattatattgcatattgtcagtgctatcaattctgtaattaattttcacgttgaaatcggaatctggccgtcgcatcacgtcagtgtaaaaaagataatagacggccaaatgagaccaagaaaaacatttggcaggcaaatgtcgccatcacctttacctgcataggagggtcatgtagaattaggcatggttaggtgaagtaattaattaattacataatgccttgttgagttaattattcagttagttgccattcgttccagatcaagaattcaaagattgaggatgatatatttaatttgcatgttgcaacatgtatatgtaagaaaagataagagtatatatcaccattgcatcagggggtttgcaatttgcatccaagataacaaaatatatttttcttgaggaacatttgaattcttctccttctcccatgccactggtgatgtatgcattcatgcatgtgcattttgaataagtcatttgtgataactaatatacctaatagcccatgaagtaatcatgcatgaatcaattagttggaaccgtatctatatgtccatgaaaataaacgcattatatgtacgatggaccacatggcacgtcgacgaagaacacatgatgaaaaagaaagacattccaatttgccagtcctagctatgttgcattagggatgatgtgaaagacaaaaacttttaatcaacacaatattgaattgaattgaaatctttctcgtgaactcgagaaatctccaaattaaacatcatatattatcagttccctcacattgttcttgagcaaaacatgcatgcatatgaaacggtcagcagccacacaattgtcaaacatggatgatcaaccgtgtgcatctatatattggaacttttttaaaagtttttcataaatatgttactagaactactatagcgcgcgtagctgcaaagttgattttctcactgctcgatcttcaaatatcactcattttttttacggtgatcgttgaaggttactacttactagtcaatgtacacgtgttgcgtgtgttttgtggtcgaagttgtatcctttcattctctttaaacattatttttcttcttatttttaaagaaaaagtagcaaccaagcgttaaaaaagacgacaacaaataagagtacataaatttgctaattcctgaaaattcatatttttggctctagtagatggggataacagtcctaaagggcgtttgcctacatctggttatttggtgatgaaaccaggatttcttaattttatttggtgcaagggctattaggccaaattttatttaaattccgataagtacaataactactattgaaatctcaaactatgggagatgcctacctacggcccctaccatgccctataggttatttttcatgaacattgggaaattataatatattcttttttaaaaaaaagtgcccccaatttcatttgagaacacaaaaagctgagtgaaaataatcagaaaacagttccaattttgtccgatgcagaacaacatatcatgagtcgatatcctctctctgcatcaacttgttcggagatatatcaatcatcctttatgacttgatttgctttcttcatgttgcatcgaccggtagactagactctttgagtccgtttatcaatctactctttagaagagaagtcatacaaatggacaacacaatgactacgttgtttgggttgatgagaaaaaaattaaagtcattgataatgacaagtaatcaatcaaacaatggtatatatgccaaatctaattaagcatggcacatatccaaccaaatacttggcaatctatccaagcatcctggggtgcgctacatcccagaaacttctaatttttgccacatgcagaaaattatttattatttacagcagccaaccagctgattaattggcctataaaaccctcattccctagctccatttgaagccatcaactgcaagcttacatcacactagctaattagctacttactcttcttcttgctagcttgctagcttctgcatttagacattgcaaaatctgaaaaaacttgagaaattaactaaacaaaatggttgttccggtgatcgacttctccaagctcgacggcaccgccgcagagagggctgagacgatggcgcagatcgacaatggctgcgaggagtggggattcttccaggtagctatacataatcagatcatgtgtcttcttagttgttgcagagatcgaaagttataaatcctcaattatatataagaatagttggtgcagtgatcgaaagttattctcgatgaatttaaacatatcaacatattgtgaccaaaattatccttacatttttaagaatagttaatcaaatgaacatgtgatgattggtgattagatgatcatgacagcatccatcatgttgattaatgattaagatggttaataatcacttgggatcattgcagctggtgaaccatggcgtcccgaaggagcttcttgatcgggtgaagaaggtgtgcttggagagctaccgactccgggaggcggcgttcatggagtcggagccggtgaggacgctggaggggctcatggcggcggagcggcgcggcgaggcggcggcgccggtggacgacatggactgggaggacatcttctacctccacgacgacaaccagtggccgtcgaacccgccggagttcaaggagacgatgcgcgagtaccgcgcggcgctgcgggggctcgccgagagggtgatggaggccatggacgagaacctcggcctcgacaaggggcgcatgaggcgcgccttcaccggcgacggccgccacgcgccgttcttcggcaccaaggtcagccactacccgccgtgcccgcgccccgacctcatcaccggcctccgcgcccacaccgacgccggcggcgtcatcctgctgttccaggacgaccgcgtcggcggcctccaggtgctcaggggcggcgagtgggtcgacgtgcagccgctcgccgacgccatcgtcgtcaacaccggcgaccaggtggaggtgctcagcaacggccgctaccgcagcgcgtggcaccgcgtcctccccatgcgcgacggaaaccggcgctccgtcgcgtcgttctacaacccggcgttcgaggccaccatctcgccggcggtgggcgccggcggcgagtacccggagtacgtgttcggcgagtacatggatgtgtacgccaagcagaagttcgatgcgaaggagccacgcttcgaggccgtcaaggcgccaaaatctgcttaaagttaaaaatagacttttatttgtgaattaattaattgattagttgcataaactatacataaccgcttttgctattcaagataaaaaaataggtgaccttacaaaatttaagtggttattattgtcatgagaatacaactattgttatgttacagtatatagtttggtattttagtgtgtcacggtttgtcagtaggaatatataataatgtaatagatcgtgttgttatatatacatgaataaactatatagatttttttaattaagttttgtcctatttattcgtacgacatgtagtttccgtatcattaatgatgcgatgccttgctggttggacaaaacaaaattgttatcccaattcctcagtaatattattaacgactctcatgcagggtacattttgacttttcttaatgattcttctaatttgtgacgtttaagatatcataccatatagtactactaacgattgttttacatacaggccatacattaaaaattaaaaagtactcctatgttgacctaatgagtaggatgttattaatggatgagccttcagtggcttgtgtaatttacagctgtgtcactgacacgtgaatcataatagagtgggactcatatttcagtgatgctagtacccatgatacgcactattctaataaaagctcctttcccattttttaattaatgctatgagagaaaatataaaccaaattagtcatacaatcgtaccctaggcgggtgtgccgacctatgcatcatatcccatattttcctccaaattcagatcctgatactgatagtgtcggataacatatcactcatactatatcatgttccatattattttatttgaattagattcaagaacgaataaactatttgtatctctagtatataaatattaaatataagaaggcaattaaagtaccaaaagagatatatcaaggaaaatcttttaaaatattacatgtgagctcgtaaaatagtgattaaccaatcgtttatcatcatatttgtaggtggatttataatagatgttcatatatgttttataacatacgggcggatacaagtcttcacatatcctaacccataattttttatggatttggattcgaaaagtatctgggattccattttctctctcatattcttcccgcgagtctcgggtcaggtgggtggtcgggtaatacccatcccattttcacccctagtaggaagtgaccaagcatagatcaggtgataaaatttaccaaaaaaattggcaaattttgtatgagaaccatatgggtctctcgaagtaattagtaattgcttttagaatgttgtgtgcttaattgctcaaagagtgtagctgatccttaaacttgtataattgtatcatctagatctttaaacttttagaatgccgcaattataggtccaaggacttgttaaattgtgttatttcgatctcaaactgcaatgacctcatagggatcctatatagtttgccacatagacgctgacatgctataatcaactatcctacctcgagtgacaagtgggtccactaagagttcttttttctttcttttccgtttttcttttgtttccttctttttttttctctttcttttcttttcttttctcttcttctgctcatggtcatcgtggaagccatctaggggacaccaccagacgagggtggatggatagcggaggccggaggggacaccactatggtggcgaagcaagaagggtgggagaacagcggagcctggaggctaggatggacaaacgaattgtagaggcgctttcgtcaccgctgcctaggaagcaagagcaaacggtggggagcgacatggggacaagggttggtgggatggctatagcaaattctggagcaagctcttgctgtctagtgctagcgaaaagacggaaggagggacagcgccacccgttactatcaggtgccggaagaacaagtcacggctgctcgtgagattgtcttagtgggagggggatatgtgactatcagttggtgtagaattagtgataataccacattagcatccatgtggcatgccacgtgagcaccacatagatcttggaggggtcgtggcggtttgcgacacaaaagggcacaatttaataggttttgggacttagatctgtgttttgagagtttaaggacatatatgacacggccacgtaaagttttaaggactagctgtgcactttactattgttcaaaagaatatagtaatagtagtaggagtttagtacactcatcacaagtgcgttaggtcatatatggcatgacacaactccacgttccacgttggatttagagtttaaaagttaaattagagttatttccatgttggatttagagttatttcaatttgtatatttcatctaaaataaaaacaaaataatttatctaaatattacttatcaatataatcacagctacggttcaccgatttctgaagctgaacacccagctgtcagtcataagaaatcttgatctggagtaccacgggacggtttagtgtgcaaccgtagatccctagatgccaactttctggaccaccatcagtgcgcgtccaaatcagtgctccagcctccatgtggtagcgactctgccattggcgacaacaagggaacaggatgctattgcacagtgcacacaaatggattgaaagaaaaatggccacaaaggctctagctacctctatgatggaatggtctttttttttttttctctcctttccttttgcgtttttttggatgattggtccatagtggagcaagatgccttagctggaggctatccatatccctggtatagcataaatgtcttctgtggcgtaggttatgccaacttacatagtagaaatttaggccctgtttaattctatgggtgaaaagttttggcgtgtcacatcggatattcagatatacatttaaagttttaaacgtagtctaataacaaaataaattacggattccatctgtaaactgtgagatgaattttttaagcctaattaattcatcattagcaaatatttactgtagcaccacattatcaaatcatgatgcaattaggcttaaaaggttcgtcttgcaatttacacgcaatctgtgtaattagatcttttgtctatatttaatacttcatgtatgtgtctaaacattcgatgtgacagggtgaaaagtttttgtgtgagaactaaacaaaaccttaatagaaaaaagggcatgtaactagactcaaggttgtctacgaaattgttttgagatattttgcgttttgaatgaattttggttacttgttggagggaattggtacacgaatcccctaagaaatgcatataaataattgtttgaaacaaatatggttttaaagcgtattttatcgtcctcggcataatttccctcaaggattggtaccaagtcatccaaaatagtgatggtttttggttaggtttggtatcaccgaaattttataactacacctaaaaatatttaagcaccgacttgtaagacaaaactatttttgaattttagaactaaaatttagggttaatttagaggtattcactcgctgttttcatcacttaatgttacattttaaaaccataaagaataaaacgtactacctccttgcacaaatatatgacgttggttagttcaattttgagctaaccaatgtcaaataaaaaaaatttggagggagtaagattcttacaacctaattattttcactgcatccatcacatgtctgcggtttataagctgcaaccaaaacaatcctttcaaacaagtgcttggttaaaaaaacaaaatggataaaaacaaaatcatatatatgccgtacccgttggtacacgtaccagtccaagacatgtgcaagagtacaaacaccaaataaaacacccattgttcgattcgaatttcgaaaagcccgcacgaatctctaggcacaattgacggacagatccaacaaaaaaataataatgacgacgttaattagtaattactcaaccattaccatgtgctaagctaggaggaccgggtaaaaacttaaaaaccgctgttataactaacagcgagagaacactggcaaagcatgcacaaattcggggagccaagaatggcattactggatcacatcacccaccacactagtagtcgtcgtgacgccttcccttccactctcgccgccgccgacgccgacgacgacgccgccgacgaggaggagccaagaattgcatggcgggatacgcggcggaggcgggcgcagctgctggcgcggggcgtgggcgcgcagcacggcatccgccgctgacgtcgctggtggtgtccaccatcgccgccttctccgccgtcgtcgtcttcgccatcctccgctcggtgcgtgcggcgtctcgtctcttcgatctcactcttgtagtcttgttcttggcgtgttcgatcggatcgatcacctgtggatggcggcgtccatggcgtgcgtgtgtgcaggcgtacgacgcggcggtgtcgaggacgacgacgctgctggggcacaacctggagccgacgccgtggcacctgttcaagcacgacaaggggcggccgccggcgcgcgccgcgttccggtgcgcgccgtccctgacctgccggccgccggtggcgcagccggcgccggggacgacgaacgcgagcgcgaacgcgtcggccgcgccgcggctgtgcccggcgtacttcggcgcgatccggcgcgacctggcgccgtggcggcgcggagggggcggcgtgacgcgcgcgctgctcgacgcggcgcagcggcgggcgtcgatgcgcgtggccatcaccggcggcgggcggcggctgcacgtggagctctactacgcgtgcgtccagagccgggcgctgttcacggcgtggagcctgctgcagctgatgcggcgctaccccggccgcgtccccgacgtcgagctcatgttcgactgcatggaccgcccggccatcaaccgcaccgactacggcggcggcggccacggcgaccacggctcnccgccgccgccgctgttccgctactgcaccacccggaaccacttcgacatccctttccctgattggtccttctggggctggtaagaattaaaaaatactccctccgttttagattataagacgatttaactttagttaaagttaaactatttcgagtttaacttaaatttataagcaaatataataatatttataatactaaattagttttatcaaattaataattgaatacattttcataataaatttgtcttcggttgaaaatgttacgttttttctacaaacttgatcaaacctgaagcagttagattttgatcaaagttaaaaacgccttataacctgaaacggagggacggagggagtacttactttgtcttattgcttgtcttcttcccagtagtacgacagtagtactattaaaatatttgagtttagaacatgatttagttagaattttagaacttttaacatctacaatttcccaaaaaaaacttagttcatgaatagaaaatatggtatgtttaaattgacctcaaaatgcactttccattatatcataaatttgttacattttatagacatattctaccaatgttatgattagtggccaaaattttaatggtttactaaacatcgagtatttcccaccagagagagtagtattatccgttgggttctacaaaatatcaaatatggtgtggaaaatcacaaattagagagaaaggattatgcattgatgtttttttaagtagtgattcgctcgggttccgattctatgaccgatttgggtaaagtctctgtttttcagcaaatgtgagttgaggttttatgtatttttacataatatataggcctgaaacgaacatcgagccgtggagcaaggagttcagggacatcaaggaaggggccaaggcaatcaaatggcaagacagagtggcaacggcgtactggaagggcaaccctgacgtggcgtcgccattgagggtcgcattgcttaactgcaacgacaccaacatgtggcacgccgagatcatgcgccaagtatatattccactcacataaataaacacgtgatcaatcattacattatactctctccatcctaaaatatcgtaacttttagctattaatcataaccgaaagtattacattgtactacctatgccataaagtatcgtaacttttacctattaattagaacataaagtattttagaactaagatagtaataaaggttaataaaactgactaacattatgatgaatgcagaattgggatgaggaggtcaagtccgggtaccataactccaagctctccagccaatgcacccataggtaacgcaacggtgtcgtggcgttaaaaaaaccctatgatttagttttatgcaccgatcaattcaacccaaacctttgtttcaggtataaaatatacgcggaggggttcgcgtggtcggtgagcctaaagtacatactgtcatgtgggtccatggcgctagtgattgacccgcagtacgaggacttcttcagccgtgggctgcggccggaggtgaacttctggccggtgcacatcgacgtcgccgccggcggcatgtgcgagtcgatcagggacgccgtggagtggggggaggcgcacccggcggaggcggaggcggtggggcggcgcggccagcggctgatggaggagctcgacatggacgccgtctacgactacatgctccacctgctcaccgagtacgcgcggctcatgcggttccggccggcggaggcgccgccgccgcggccgccggcgcaggaggtgtgcgaggcgtcggtgctgtgcctcgccggcgagaagcagaggcggttcctggaggcatcggcggcgagccccgccgtgtcggagccttgcgtgatgccgcccgatgccggcgagtgataaaatgtgttacattatgttttttttagagcaacacggtaggatacgtaggcagaaaatttgagcagttcaacttgggattttaggatttgctttcagccttaaacttattttattttcagccgagcgcaaaacaattcgaaaattttgagcaaggcgtgcatttgaacctccacatgttgagttctcaactagcaaaagtgcttcaattacaagatcgaactttcaattacaagatcgctttcgtttaaaatccaaaccatacccaacatcttcatccgaattgaccgaaactagtcagcacttctcaacctctagaaacacaccaggagaaaaaaaacaagtgtgcttttaagaaaacgattccatacaccagaaccaacagcgctggtattttttttaaaaaaaaaaaacaaaagccatcctggtgattaaaatgaagatcaagagcaaacccaatatcgcatcgacgcggcgcgaccggttaaattaagacatactcatacattcgcataggaaattcgtaactaaaaccgcatttttttcttttttctggcacagggcaaatgaaacgagaacaaataatgtaagattcacttaatactactatttcatagagcaaataaatacccatttagcatccaggttaactcaggagtgccaaggacatacataaaagcatactgatgatatgcataataacggcatggttagcacctgcgcttaacagtgaccaagtgcctcacttatccagccgatatgccctgctaccgttttatctttgagattatcatcattctcctatccgatgacgcatgtacaaaatgagaccagaccagccagtgctgcagccagggaagaccgcggtacatcgtaacatagaaatgcccaaaaaaacaccgcatgaccacgaaatcgttgatgaagcatcatgacaccgctgcagcgaagctcgcgagtcagcaaagcttagctgtttcttgacttagcatcaaccaccaatcaagccaggtatctgtacacattagcgttgtccttctcgcgttccaggtaatcccttgtgatgaggtcctcgattcgcttcttgatggctttgaagtcaggctgcagtggacaaaaaaccaaagtaagggaatgcagtgtactgtagtcatataactaatttaaaagaaataacttcttccttatgataagaacaacttctcgagatgaaagaaaaacagctaattcaaaatgattgacatgtgagctcagaacacattagcacatcagctaattcaagatgcattgaagacaaaaatatgccgcatgagttgtactcatatgcaactatacaagatgtgataaggattaaaatatgtgggatttcctagaagtaatatgtagtcggtaccttgaacatgcggctgagctgctccacacattccgcaactagctgctgatggcccataactttgcgactcttcataatgcgcacaatcgatgcatcaattgcataccgcctgtccttgtcaacatcttcgacaacctttttcttttcatcaacaggaggtaggggtatctgcacataatatgaagaatacaaccattaacatcatagcattcatactccagaaagaaggcccaccaacacgcaaaacacaaaaacacgaaataccttaattcttctcatcctgtcagtgaattttgaattgaactcaaaaacatcgttgggagaaatagatctattagctggttccttgttaagaatcttgtattttgcacaggagagagaatggagcaaacgcactacatcatcatctgataagtttagctgtgttacaatctcagaataagtaagcctgtcagatccgttgaatagcagcagcaacgcagcctgcaaaaggagaggcatgtcaaaaaagtatcataaaggtttttagtgcaacagatctgttgacagtcatataatttaaatttacctgatatgttgtgacaatgagctcaatagtttttgcctcaaactttgcattgatattgcaggttcccaaggaatatatccaggtaagctttctgtgttttgttcttgtttggtaaaactccttgaaaacctccacgcatttcacctaaaaatgataaatgcaaatgttcatgtaaaaaggatcacatggcaataaatgtttcatggaaaagaagataaatatggatcatgtttcagcttaacattatcaaggacaattgacaagcatgtaatgatgaaccctaaagatctgcaagaaaaagtcacttaccatctcagcaggaaggttaatatcgaaagtcttgtaacttggccagaatcctgttgtcaaaacagtgacagccaagtctatcccaggattcaactcctgatgtgcagccacaaactcttcaaacttagtttgatggtcccttgcaacagtaagatcagtaaccattccctccattttagaagtaaattgtccaccacactgctgcttgagtttggtaagtatgcttctttcatgttcatcattggcactcttatcaaaaagcaatctccttgcaagttttttcctgcaaatagctccacacatgaagcaatatgaatacaaagtccaaaaagtaatgtttcttaaattcaggaggtatataggcttaaaacaagataacacaacattacctgtaaaactcagcaaagaggtctttatcgctgatgtatgcaagcaatcgcaccacctgaatcatatttcattttcagcttagatttccttctacaaaaatttaataatggtagcaaaagagaagggagaacatgcaccttctcaagagcatcttcgatggcttcatcactgagcttttcactgcaacctttcttcagaatattgtcacagaaggtggcaagcagttcagcacttgaactgccagagacacccttgttacagaagacctcgaatgcttctttaagggcctgtagaatgagaagtttaagaatgaggcatcacatttgacttaatgaaccaatggtaacaacaaggaataggaatgtgtcgattggcagaccttatgaaagagggtgtgaccctggaaacattctgtgacataagctacatacttgtcatggagctcaatgattttccagacaaaaacctaaaaagaaaatcacatgttaggtggaaaacatttcatcaccaacgaagtgcaagaagttcaagttgtgtacctgttcctgcataccaaccatgtcctttttctcgggctgtacaaatagttgatattagaatattagctaaataccagtttgttgcaacgaatttgaaataatcaaaagttctgaacttcaaaagatctatatatttctcagggaaacatataattgtaatcaaatataaacccacaaataatctaactacaactctacaagctacatgcaaaaacaatcttaaagatataatgtttctcagggaaacatataattgtaatcaaatataaacccataaataatctaactgcaactctacaagcaacatgcaaaaacaatcttaaagaatcacatagcatcccaccaaccgtcaccagtaggttctttatacagtagagcacaaaaaactaaatcaaataacatgaatttgaatcactaataataaatgcaagggaatcaagcatttgagtgtaaccagaaacagcatataccgtgtcaggaattgtgcacactaggaaaactatagaataaaggacaattttacaggattaaatagaaagagacagtcagcgacctctgtttgatcaactgaaaccagtttaaagggagctaatttaaagcactaatctggcatgcacaaatcacaatcctaataaccatactttgatggaacacaagtaagaaaaatgctaaaataaataccgcaccttcttattactagcagaatcttctgcttgcttgaccaaggctgtgccctcatttgtaacatgctgcagagaagtaataatttaatcagaatgcacaaaaaggttatagggaataagcagaccaattttgaggcaatgaggcaataccgttttaaacatgttagcaataggttctagaccgcggttaattttggagaagagcctgtacatcctagaaaggtcttcctcctggagaagataatgggtattcaatattatttgttttcatgatatacggttaagaaatgaatcatgttgtccaacaaaccttgtcatcacgaagcaatgcaaaacacccagaatgctccttctccaacaggggagttgcatattgtgcaagcaattcattttgcactttctgtgacaatccaggaaggataataatatgagatgatattccaaaccatacagggaaagtgcccaaacattatttaagaaacatcgatatggcagtccaaatacaaatctgtaagaacatatctcaaatgcaagtataagcactcatcaacatgaagtgattggaaactggaaaagggaattctcaaacaaacctccagtaacttctgttcactactaatatgcaagtagtgaccaactcgctccttctctttcttcaagcactcctcagcctaacaaaaacagcacccatttattacaccagagatgtcatttacaaatacagacagaaccagtcagaagatcctcctcaaatgtacctttatcatgtaatcaggacaagagtcctcgagaatccagctttgagccttgagagagtagtaatctgtagtatccttaagcaagaaatcttcaaagtcattctcataacattccatactgcctagtccaatttcaacaaatatgcccaggacattcttcagcagggccctgtctatctgttcgccttcacgctctttgtcaatctgtcaaagaaaggtattgcaactatttaagtatacgcgcaaaatcattttcccaattcaatgtaggaatgctgactcaccagagctatcactgcacctttaacttgtcctttgatttcttggtatatctgttatgagttggtcagattaggacacagaaagtttgcaacacagagattgaacaagagcaaaagctattttaccaaatctcggaagcaagtaagcccaacttgttcaagtggtataagcgacctccgtgagatgaagtatcgatcaagataaaagaagaaacgtgacagccaccgaaccatgattttatggtttgaccacctctttactagttccctcagcataaactcgtcatgtttatctcttaatgaaggtaagacctgaaatatattaaaattaagtgatataaagctcagagtgtacatacaaatataacaaaggagcatagcatacaaaaagagcatgtaatacatgttagaatatcagatcaatatgcacaagtaggaaaaatagtttttgtttcaagcaaaatgtgtcagtttgcttagcgcaatcctaaaaaattatgtacatgatttctaccatgtttagacaaaaccaggagagcaatgctaggatgcaaagcatgatgttcgtcaaagaaccagtatcagccagacatttaaggatatctcctgacctcaaagtcatggaaacaatcagcacactggcatgaacctaaaaggatgccttttatagttttatgtttctaggctatagtcacttttacagcagccttggccaaaacagtgggggcggaaatgcaacgttcacctagtcactagtcgttagttgatcaatgacccactgactagtcggaggctccaagcctccaaaataaccaccatttaaggatatcggcacaattttttacatgtttcgtggtatatgttgagaccacagggtccacactgcatacactagtgtgggtgtgcctgggactggcagaagggaagaccggtatgcgtgcggcaaatgcatgggcccactgtgagcaggggcatggcagtgtgtaggataaaaaagaagcaacaaaggagccagggggaatttggggaatttaggctaaccgtagacccctttaccccccttttaacccacacttttgggcctaaatatttcagctcataccatattctgtctcctagttggtctgcctgattgattagtcaccaactaaaaccaactgactaggaccgactagtcggtcgaactgactagcccactgtttactccctaatcgagacggtgactaggaccgactagtcggtcgaactgactagcccatgtttaccccctaatcgagacggtgactagtcaggctggtcggccaactaggtgaagtattacaacccgccgcacattggtagagcgatcagctgttgactgactagtcatagattcgtatcctacttgcagagttttgattcacaaggaaaatcatcatcgtttcagttaagttaactaataaaaggaaacaaattatgacctattcaactgagatagacttactacacaatcgaatcaaatagatcacctctatcaacaataatcaggtaaccgaatcagacaaaactaagatccccaagtacactaaccccattctcctcctaaccaaggaggaattataacccatcggtgcccggccaccacaaccaaaatcgcctggatcaaccccaaatcacctactatcgaatccaaccggaaatgacagacatgcacaatcatatcaaacatttacaagaactgcagaaaaaaaaagatcgtctcaccatggaggtgatgtactcctcgaatgactcccggtacttgtcgtagagctgctgcgagtagtcgtgcggcggcttctgcgtgcacatgttgtatatcgtcctgcagacaacaacagacacggagtggggggaaaccctagatcagcaccagatcgaagcgaatcggaggggaaaccctagcgggcgggaggaggaggaggaggaaacccaggaggaggcggcggcggcggcgggggacgtacgtgtagagcatcatgtagtcctcggagctgaactgtggctcgggcttgccctcgaggatgttcttcagcttggtgatgcccttctgcatgaacgcccatccctcctccagatcgatcgtcctccgctcctgccccgccatcgccgcagccgccgccgccgccgccggtgaacggaggccgcgcggaccaaaccctaggggagagacgccgccgcgtgggtttgggttgggttccgcgcgagaaaaatggggaggaagcgggcgagagagatagagagagagagagagagagaggaagagggagcggcagactgatgacaagttgaggcggtgacgcggttgggggtaagtataccgcttatatcggtgtagtaagcgtgtcacactgtcacacaaatccgcaagtgaaattgggctgcgaattgcatgggtgatcgggtcgaggctatcctctggatatactctatttcaaaatataataacttagatttatttattcaaatttgtactattaaaaaataactcatccgattctaaattgacaatgagagtattttacagcgaattattttgtatgaatttctttatctctatccattctataatcagagtcgtcatccttccgttccaccaaattctatgttttctctaagttaccctcatggcacatctctaattatatgggtttggcatgttataacatattaacatgttacctctactctcttaaaatcaccggatccactgctttattctcttaaaaacaccttcctgacacatctctaattatatgggattggcccattacaacgtatcagtatgttattggtgggagtatgagagattttttttttgcgtgcttcggtaataaaaccatatataaatcgtaactttgctatttgttgagcgattaaataaatcccaaatcacagataattgataattttgttggtttgatattcaatatttttcgaattttttcaatcttgagagttgagacaccgtacgtctctaaaagcaactgcttcttcttcggcaaccacacctctcctcggataactattcgagtgcactgacttaaattttgaggagtggctaagcatactgctttaatcgtgtcacatgagagcattgtaccaactgcatttcgcaatgaagtgtttttaaggatagtgggagacaaattcctcgcatgaatcggtaatagaggggtgctttgttgatttggtagttaaaaacatattacatagattacaattttagtatacttgttagctaattaaaaaatctcgaatctcacaaatgatctcaccattagtttgattcccaatagctctgttatatctttaaagggagacattgtctccctatcatcggcaattgcttcccaggcaaccacgtgctcctccgattctttggcaacaacccttttagggtgactatgacgttcctttagcgaacacgacttattgtattagatcaccacgctgactctatttcatgatggtttttcctatgcagcggtgggagagaagtttctcacgtgctttgttagtagagaaattttttacttcggtaatagaatcgtatataaaattctaacttttctacttgttatcaactaaaattttccaaatctcaatcaatttaatctcactgctagtttgatattcgatgaatctttgagtgtcttcagcctatagacatcatctatccgccaacaactgatccttctctagcaaccaaaccactcctccggcaactaccctcttatagtgagcacacccacaactcatcgtggatcaccatgtaaactcccttttgcaatggacttttgtcgacgtttgatatcacaactacggtattttgcatactatagggatcgttggtaccagggtatatgcgagattgaagtagaaaagatggagacaatgatttttatacatgttcggccccttatctgtcaggtaatagccctactcctgttggccgaagccggtgttgcttctttattcatctgaatcacacaggtacaataattggaataactcatctgactgtcgtcgacttggcggtatggataaccaactcgtagttgacgacagggtagtcttcctcctcgaatccgcactcggcgagatcagagatagcagctatatctctcttgttgacctccgcagacaccatattaggtttgtctaggcttatctctgatgtcgatatctggcggcgtgtgttggcttgtattgatctatattgatcttgctgtggctttgtgtcattgtggcattgtggcgtgtcccctcttctcttagggggccttgtatttatacccatagatgtccccttgttcaagtagaactagggagaccaatatggatacaatatgttgtttccatatataactctactcgtcattccttatccgcaactctttctatatacgaggtttgtttccgtataagacatagtatgtggtgggctctaccgtgcttaggtatatggtatccataaccctgacaactttcttgtgcggtggtggaagataaatttatcatgtgtttcagtgtagaggatttggtaataaaccatatataaattgcaactttgctacttgttatgcgattaaaaaatatccccaatctaggtaaatgatatccctgtgggttcaatatccaacagcttttgcatgtgctcaacctctatacatcatctatagatattttataaaatgttacgtaagatccatctatctttctaataaatagatagatgctttttttttgacaagttttaaacattgtttcacctgattaaccacattgccaattgtaatctaatttcaaacaacatgcaactaagtttgcgtggtgatttctatattgttgaaacatgtaggatatatctcaataaatatagtaagttgaagtatggtcgtgataaaaaagaagtattaatgctatgtttatcttacgatgcctcatatattacataggcactagaataagtcagttgttgcatttagtgaatctgccaaaccccaccaatctaatgatgaacttatcggtaagaccataggctcccaagagtcctattcatgtttgttaatcaccttggtgttcgggattgacatcaccctggatgcccgtgactaacaacataggcggtaaagcatgccctggaggaaccgaatggagctagaccaagatcaagggtgaccaatagaggtcaacactatcaaaatgacactggcattgataaattaacaatggaggatgatggattttggtttatattgcccaaatggctttcaggctcactgtccttgtttactactgcaaaaagggtgtggtagtagctaaagagaatgagagagaatgagagaagggagaaattgagggtacggtggtggctgggtagggagggaagaggagacttgggatattgacagctaaaacgagcgccatgttgtcatattataaaaatatattatttgataagcctcttatagcaattttttattttacatgtgaatgtacatgaactagctaataccaactagcattgcttttccattgttatgttgctcttacaatggcaaatttcgcctattaaattctcatacaaacgaacagttcattttattttatttgacagtgatacgatccatttataacctactgattttttggtatgtgtttaaacaatgtatcgcccttattatattaaccgtacctagtttttgatatcttgtaggtaaattagcacgaaaaaattgctgttctcttctaaatttgagacctacttcaacatatttcaatgtctctgaagactggttatgatgtgaaataaatattattcactatgatattttctatcgtagttagatagtacataaacctacacagtgatatcatatacggagtaattaaattgtgcttgattaccagcacactatgccacaatttaccatgtacaaatatttggctagagccattaggggtgggcatcggtccgatcgaaaattttggtctcggtcttcggcctttcggttagtttggtcattgaaaagtgaagaccgaattttaacgtaaaaatgtcaagaccgaaaaattcattattggtctcggtccagaccaaaattcaacaatagtttcatatatgcgatcatagaaattttcaacacaaaaatcacaaaaataatactttcttcgtttcacaatgtaagtcattctagcatttcctacattcatattgttgttaatgaatctagacattaacaacaatatgaatatgggaaatgctaaaataacttacattgtgaaacggagggagtagtacgtatgagtaaagactttttttttcatgtctagaaggaatagagatgtgaaaaattagaatttaaccctattgaactcagtggatcgtaagttgcatttggacatttttttttgttaatttggtcttttcggttgaccaatgagactagccgaattgaccaaactaaattcggcatttcactacttaggaccgaattgctcggtcttgatcttgtcttttcggtccggtctttttctgcccacccataagagctacagttgtagcaaggttcttttggaataaattagatccacaccaattttacattgctccattaacttgacaacaccatcaattttacattgctccgcatgacttaaccatctataagtctaacaccatcattgttataaccgtatacacatgacgatcacttaccctacactggctatgcttcgggagagggttgggaagcctaactccctagcgcgcaaaacaaagcatcgtttagtgcataattaattaagtattagctaaaatattaaaaatagattaatattattttctaaagtaatgtccatatagaaaatttttgtaaaatatgcacgtttaacaatttgaaaagtgtgcgtgcgaaaaatgagaaatgtgagttaggaatgtagagataagagctcaaccacctttaagggaaaaaatgaattttatatttttgcaaatagaaaagaaacatcgaatgaaatctgcagtatttcgaattcgaaagatttcatttcatacgcattttgtcttttttcttcacccccaacaacacgcatccggctggctcgatctcgacacaccaaccaaaaatcgaatcgcgttcgagccatcgagccgacaaggcgacaacagccacaacgcctcactccccccaccccacgcgctccgacgagctccgatccgccgcccacctcgccgcccgccggcgatgagcaccgcctccggcgacggcggggacggcggcggcggcggggatggcgcctcgtcggccgcggggggcggcgggaggcggatcccgcccgcctcgtccatgccgtgggtccgcaacctccgccgcttcgtcggcacgggcgccggcctcggatccgaggccttgatgggtcagtgccgttcgccgccgccccatcccttctcctttcctgtggtgtttggccgggccgggattccgttcctcatcgtggagatggcggtgcggttagggtttacgcgtctcttccatgaaaatgatgatgtgattggggaggagaaattatgggcccccctctagtgggaaggattactattatgtgttcctcaggtttgagattgcataacgcagcgtgtggatgcgtggaatgggctcgctcttgcttgatttgcagtgggtgatttgggtggagcggcatagtttcttgacatttgacgaaggtcacaactcacaagatgttcaggcttctgggagtcctctgcacagaggaaggcttgccggctgtggacgcagtcagtagtggcaatgtagggtgatgggctgggattttgagtcttcgtcgtggagatggcgataaggttagggtttacgcgtctcttccacgaaatggtgatgctattggggagtagaagttagggtgctctagtgggaagggttactggatgagttatagtgcctcaggtttgaaattgcataatgcagccggtggatgttgaaatgaactcactcttgcttgatttccactgggtgatttgggtggagaggcatatgcttttcacctttgaggctttcacaaaagtcacaagatgaaatcttctgggagtccttttcacatactccctccatcccccaccccccccaaaaaaaaacccaatcctggggtgcatcgctaggattgggttttttttggtacatagggagtagtaactagtaaggcactgtaggcttgtcggccacagacgagtaagtagtggtaggagtagtaaggcactgtaggcttatcggccacagacgagtgagtagtggcattgtaggaagacaaacatcagattttagtcatgtgcgttttacttgttgatacgtaagctgaggctattggtaatgtggcttgaggatatctcccagctagttcaggaaaactttgatccatatagtgcatatagttgaggcttagttgtccttttctgttttaatcgcatttgtggaattagggactataagataagatgtctcattggcatgcaatttttgggtgcatttgctacaataacatggttgctttgttgatcaatattcgcatgtttttcatgtgcctgcttgtaaactatttgttttaaacctttgatcgcagaactggaaacaaaaaggatactgcttgagattttcaaggagcgccaacggaagagtatggaagctggtgccattccaagtttttataagaaggtgcacagcttggttcagtttattggataccgagatttcataatcttttacgttattatcaaattcgcagcgtaagcaaaataaagatcttgacaacagtagctgctttgacaaacgatgataaaaaagatattggtttcctaagtatcatagtttagttctgattcaagaatgcattgccttctcgtcaactcatgaaattaatatctcctttatggacagaaacctgaagatggatccattagcaatagagttcagaaattggcaaagtacaggtttctaaaggtaatgtttgatttcttcttattgctattgagatattcgtgtttggttggcagcttacttgcattgccatttaaccttctcatggtttgggccttacaatagttattttaaacaaatggcagaaacaatctgaacttctgcttaatgctgatgatcttgatgccatgtgggtttgtctcagagaaaattgcgttattgatgatgctacaggtgctgaaaaggtaggttgttttatgtacctttatttcagaccagcaatctgccagtttttaatctaaaaagttcagatccttggatgacaatatgcatcatatgtctacaatatgcacgcaaaaaactcatccaaaatgaaaaaaatcttttggtgtgatatgcttaatctcttttaggggatttttttagttcattgctacttgcttgaatttggtgtacatactgccctgtaaatctaacgatgatccttgtatctgtatttgtgtttggtgtagttgttcatgtagcagttttggttcgattaccttgctcatctatttttctggagtcttgcagatgaattatgaagacttttgccatattgcaacagtatgcacagagcagatcggccagaagtgcaagcgtttcttcagcccttcaaattttatgaagtttgagaaggatgattctgggagaattgcaatcctaccattttatctttatgttatgcggacagtaagttattttcaaacaaatattattaggattaccaaatttgttttgtgtaatatttgatgtcttccatttgcatctctgataaactggtaattctagcccacaccatgcttcttttccaatttcccattggatgtactcctagttctttttactaaatgacaaagtaggctagttatatgttatcatcagttgctccattattattgttagttagcttttattagaaaagccattcaaagcaataacaccaaatcgctattacaatacaagaacatgagtcatgtcattcaccaaaataaacttgatgggtgtaacaatgcccaaggaagctaaaatcgtttcctcctattacatcagaatgggtcacatttaagtctgaaacatcacataaactctgaattcccatccagcaaattttttgctgaatccatatttatagctgtaacttatttcaaatcattatcatgcatgctactgtttctttttccttgcgtatacaattgtatgacattcttttaactaatttcttcaggtatctctcacacaagcgagaattgatatgagtgagcttgatgaggattctgatggtttccttcaacctcatgtaaggacatcctaacacacgttaacgccattgcacaccttagtaatgtttgacatgacttaattctattaacaggaaatggaagcatacataagagggcttatccccaatttggcacaactgcgtgatatgccatcagcatttgttcaaatgtactgccgcatagctgcacgcaagttctttttcttctgcgatccacacagacgaggtttagaaccaacctttaagtgcagttgtattaatatgcaaattactttaatcgatacatttattctttgtaagagtagctaactgtttgtaatcgatacatttttttttcagggaaagcatgcataaagaaagtattgctgagcaattgtcttcaggaacttatggaactacatcaggtaatagaagaaacatatttcatggtttgctggtagaaactctgtaaattttatacccttataggcttacaacataatattgctgtatcctatattctgtttctttgtggttacgattcttatcaactatattttcaggagagtgaggaagaggttactgatactgagcaggctgaaaattggttttccctgacgtcagctcagcgcatttgtggtatgccagccaccctcatgtctggttttctgatttttcttttgggtagcagtagcacacaatcagtgctctccaaaaagttaccttttgccattctattgcagtatagttgatgatctacctaatgcgcatggtcccatgcagatatgtttcttgcacttgacaaagatacaaatggaacattgagcaaacaggagctcaaggaatatgcagatggcacattgactgatatcttcattgaaagaggttaaaatccattatctgctctcatgatactttatgtttgtctttctagacgtcctaaccaaaaagaaacatgcaattgcagtatgtgaagtttttttatgcattatacacatagatcatggtgtatttcataaatctttagtcgtgaatagataaacaatattataacttcttttctttttccagtttttgatgagcatgtacgccggagcaaagttggaggtggcaacagtcgtgaaatggactttgaaagctttcttgactttgttttggctctagaaaacaaagatactcctgaaggattgacatacctatttagatgccttgatcttaatggaaggggattcctgacaactgctgatatccatacattatttaggtatgtacggggaatctgtattgtatattttttgggcagtgacggaaacatctgcttcggaaaagtggcttaagcaggagaaagttgattgttgttcattagaatagcttttccatggcatataaaagttgagctagcattgtttttgtcaaaattgggaacagcctctgcaatcacatgctgaataatttactgctattctattcctctgttaacttttatctcggaagaaaagaaaggaggatgtgagagttagcattcctgcctgatacaatcttcctagatttaatctgccattttgtttgcttgctgaactattagacagttttgctggccttagtgggcaggacatcaccatgacattggttcaatcgcacataggtgtcgctgtttcttacatactcacaagtgcaacatcttcatttgcacgtgtacatatttttatatacttcagtattttctcagtttcttatgagaactaattagtaaataattaggaaatcttgatgtgttcaatagactataggaatggttcaaactagatgtcatacatatttgtaatatcctttggacctttgtaaggccttgttcggttaatcccaagagggagggattggag

SEQ ID NO: 68775 - DNA, 37181 bp, Oryza sativa
  unsure (1)..(37181): unsure at all n locations
tgattgagaggcgcgggtggggtggtggtggattcggcggcggagtggggtggcaatggcagcagttgccggcctggctagaggtcggggatgacaggtggggtccaccggtcccacctgtcggcctgagagaggaggaaacgggctagggacgtattgtagacttgagggagagtgagagccaagcgggctgagggagggaaggccgccctatgaaggaggaggggagggatttgggccgagcccgaaagggaggaagggaaagattattttcctttctttttatttaattgattaaatgaactttgtgactttaaaattatttattgagctccgaaaattcgcgggaaatttcagagaatattttagggcacaaagaatattacaaaatattctcggccaatgatttttaaaggacattttaattccctcaataattcacttgattaaattaatttaacttttatttaatttctagaaaatgcattattaaatgatttttaatcccgaacgaaaatcggggcgttacaaatctaccccccttacaggaatctcgtcccgagattctgggatggctagaaagaaagctggtgtatgcggtctgactgatctaactgaccaacctgcacgactgaactggttggattcgacctttctgtttctttgttttgccaaaactggaccgactggttctacatgaactaacccagaccaggactgtggatgttcatggaacttatgtatcttggactgaactgtttgatgtgctcgagggtgtcccgatctttcgatgagagggataagtcgattggatggagtgacattggcgatctgactacaactatccagggatgttgcgccttagcaatcgttacaccaactccagaggcggtcgtgaatctcgacggatgcacgatcagcccaaccacgagggtatttgttcctgcaagcaatcgagaaccagcaagaacaagatgaacaagcaactaaatttgcaaatcaaagatgatggattgaatcagcagaagtaacaagtggggttcagtaacaagcaatccggcgatctaatcgatcacgggatcaactcggcaaagtagcgacgctatactttgatctaaacaaaacccgattattcttggcggtgaagaaagctataagaagaggaagaggacaaccacaggggtgctggggtcgttctctcaccctaggacgcgtccctaatggacccaacttgatacacggcccattgggcccaaagaggtgacgcagcaccgtggatagaaaaggacttggtaataaaatgaagattgcggccgctccagaactgatatggatatgaggctagatccatttaaaagtagacttgacaagctttccatgaagtacttgcacgcccaaatcggagttcgcatgaagtcgtgacggctgtcagaagttggtgttgtgctgcagtccgaatccatcccgcgcgaatcctctccccgtttgatcctctccattgttactgagtaaaacaagagtgcacgtgtctccggggtataaataagaatcatatgaatttaagaatgaacgcacctgatagttgagttgacgtgcacgagcacgggcaataggaccatgaagttgtacttgtggaggcgtagatgtatcgttggtgttgatgtcctcatcactcttaatgctggcaattttggtaacccgacaattcaccatgctggctagaagaggatgaagttgttctgaaacttgcatgtgacacttgtaaatcattgaccctacgtccgcttgagctggtcctaactcgaatgacaagtaattccagaaaacctagaaacctgcttgacctgtctttcgtctgaactgcaaccgtccctgatgttgcttctctaagctgaactattgacctggccccacgagtgtaccttagaattgaacctatcaacttgagattggggcaactctgcctatggcttgcaactgactcctttaattactaaccaaattgttgcactgggttgaaccttcaagtgaaatgccgacgaggcaaaccaaaactcatctctgagacctaccccccttacagagagtagtcatactttcgtctgactgggaacctttgaactgttgtccttgaaaaatcaccaacacttctcgaatttacggagccctgactttgaaaattgaaaacttgaccagtcaatcaaaatgacttaacccttagctgacgataggaaattccacacaaaagtgactctcatctagctcatgaacatactgactcttgactcactttcccatcagttctaactgctggcatgattgtcctgcttctggcctgacttcggtgtcgagttgcatagttgatttctgaaaactaacctgaccgactctgcattggaactgatgcaatttgaggagctggggtgctgcaaataaagttgtcgacctgatgacgctgacgccttgccgatgaataaccttctgagaagtgacttgtcgtacatcttccatgaatggttggacactttgcaaaaactgcccttaaaaaccataaccactataggtagcacttgttgcttcagggatcgatggcggcttagctgtgctggtctgctgagggcttggtggtgtactgttcgaggttgcgggtgcttgctcttggaaaacaaactggctttggctctgatcctgattccggcttgcatctgggcttgtacctgttgttggagacacaattgttgcatctgctgcatcggactctgcgattgctgcatcaacataggacacatccatcatctgaccttgactaaccagaatctgaccagagcgtggtgctcggactcagctggtagcttgttgtctcggactgatcaaaagctctgacctcaacacactactgctggagttgcttccgctacattcgaccttgcatcgagctttgcatctcctgcatcaatacgcccatcatctgatcttggacaccaaatgttgatcacgagcaagggttcttctggcattggggtactttgttgctttcaactgaaccgttgatctgtgactttaacacaccatcgttgttgttgctcttctctctgacactgaccatctgctgccaggatggaagatagatggaaaagaggggttgctaaaggtaagaccttaaaccacttgactactgatctgttgtgagtagacttttattgttcaagttgcttaaggaaacaacctagtatggtcgcatccccaccaatgatgcaaaccatacccctacacacaagcaaacaacacatgatctagcagctaacgaaactactcttccggggaggattgggattaggaaaactctgggaaaacttcacttgaccttcgtggaacgacgaccctgaactaatcttctcgctctttgcacgaagcttgaggcttgacttggcttgacttccgaacagacatgaagctggcggtttatcctccagggtttaacaactataagaattggagggacagggagaagaattttgaaaaaccgttttgcaaagaaatgccgaaggttttgaaaaaccgtttcgcaaagaaatgcccgagaattttgaaaaaccgtttcgcaaagaattttgagagccttatggcaatttaggaccggtttacgggaaaccctggaagacatacagtgcttgccacaagcgggagtgggtaactgcttgatctaaagtatagctcgaccctttcctaggcaccggtggcgagggtgggcgtgatggagttgggtcggccggtgtgtccggttgtccagctgccggattcaccgcggcgaacgaggggactgcccgctgccttgcgaggagtgggggtgaatccttagcgtggtatggatggttagggagggttatatgaagggtcttgtcacaatcactcgacatggtgacgtgttcatcatgggcgcatgatgacgcggtgacatgccggtggattgtgccttgtgggtacagttgtgcacctctggccagagtaaaattattcgaatagccgtgccggcggttatgggcgatcgaccagattcaccgtgattagtttcacccttaataaatcgactcaatgcacagtagttcaggtgggttggttgggcctgttcaacgtggtgtagcgttgatcagtggagatttaatgttactttaatcactcaactgttttactgttttgcttaataaaatgttttacatccgcctttatgcaaatagccacaaaccgtccttgtgttccccttgcacgtctgcatcattggtgtggcttgctgagtacggtggttgtactcagccttgctattgttccactgctgagctgaagacggagttagaggaccaaggctcagaccccagttgagttttgcctgtggagtggagctgaagccccgctaggatcgcctttttccactgctactgctttcgtttcggtgtgaggactaagagccacttctgtaagtatttacgctttatttacgtttaggacagtatattacttgtcgttttatgtatcctggctggtactggacagggatttaatacacaaaatagtctggaaatttgggctaaatttctaggcgtgacacctaggcacggcccaactgtcgagccggccagcacgagctcgacaccaatcttgccatgttgtgcttgggctgggccgtcgggcctcggcccttatggccatctatacatgcatgatgcatggtcatgtaagctatacattcatatgtggtgtgtttgggacatatagtcacattgttgagtggaccatatttgtggttcaagttagaaatttttgtttgtgtgtgtatacacacacacacaccactggaagaacataaacactattttttgttttttgcagcggcgaagccacctcttagataagtcagacgaccaccaatgctccgtcgatgtcatctcctctatcgatagccgtgaacacttataaaaattagtcgatcactgaaaaacattattagtcattcgggcttgacgacatcgctagctccaccatgttttatcactacatgttcaattgacttggcatgttttggactttttacacttgacccttttgttgaaaacttattttacaaagactcttataataaaaacgtattgtgagaatgaaacttttttctcaatgccaaggtcattagcgtcgggattcatgtctctgtaccaatgatactggccccgaaacccttgcatctccagtagttaagtcggtgatgtgaaggggttggcgccaagaagaccaatacaaggacctacatgtaaaaaaaatgaatgagttaaaaaatgtaaatatttttcttacaaacagatcctagttaactagggctgaaaacggtaatggaaattcccggccaaccgatgttcgtttccgactttctaccagccaagccatatggaaatggtaatcgatcgaatcgaaaatagaaatggaaacggaaatggttttgctattataccgatcatttccttatttaccgtatttttgtggaaattaccctttcttataatatactccctccgttttaggttataagacggggtnactttcnccaanntncgtctgctttggntttgaccgnccttgtgggaaaaaaagtattgatattttcaacccaaaactaatttattaggaaaatatattcaattattgatttgacaaaattaatttagtattataaatattactatatttgtctataaacttagtcaaacttaaaactatttgacttggacctaagtcaaaacgtcttataacctgaaacggagggagtagtaattattgtgtttctaaatatgttgatatttaatttaagggtatgtctctaattgacccaccgtttagaaattgattgactcttcaatcaaatccctaacttgagtgcatggttaaaatggagttaatttataatttatatagtataacatgaatttatttatacgtgtagcatacttaggtaaagctaagagaaaatttcttaaatgtcacttaaagttcacgagttttcttatatgccatcgaaaagttgttattcctttatatgccgctgattgaacttattcttcccccatatgccatctatgtcatcatcttatgtaataagaatgtaaaagtacaataatacccttttagtataggtgtccactcgtttctttgcatgtcatccaaataattacaaaaatatatttttttaataacatagaaataatatgtgatatatcactacacaaatatgcaagtttaaatttcacttttacaaaaaatttaaaaaaaaatcaaatttggttatgagcacacctatactagtttcaattaaatttgttgttttcgttacaacttgcgaagatcaaatttgaaattgatttttttgactgatatatcaaatattaatgagtgaatttcagaaaacccatgttttgaggccaatgtaacacataaccacaggttttatttattttctcaagtaaccccgtgcattcaatccaattaacataataccacaggtttaagtgagggaaagtgtcacaaaggcaagtgacatggcaaacctgctccacatcagcagctagccccacctgccaggtcaatgcgtggcctattagggtaggatcacgcgggagaacagaagcgcacattccctgttcccacacacgcgacgcggcaccttccgtctttctcgcgcacgcgggcggcggcggcgttccccaaccatctctcgcatgatggcctccaacgatgatcgtgctgttaacctaggtggaggaagattggaggaagagaacttgttgggtactaagaccagggagatggataaaatcaatattcctagcaggtaactttcatcccttttcttgagatgatcatctgaatagactccaaagcatgctggttggtgatttgcaaggacactctgattcatggttctttgacgaggaattaaatccagccttttgatcatgtttgtcttgtcaagaaattagggctaataaaatataattaggggattattattagggcattacaactatgcaatcgttcttgtgtttgtcattacaaatttgctttctcatcatcggaccgtaattttttaataaaaaaaaatgtagattgaacagtattagaactattgtattgcactcagatacaagactaaacacaattgatatttaatggcctgcaacatttttttctgcttcacaaaagagcatacatgccttcctctttttttttctcggcaaatatgttgtggttttctctgcttcacgatgtatatatttttttctccttgaatttattgtttgctttttaggacggaaggtgatgaatggacaattttaataactgtaataacgaaggaacatccctataactagcaaaaaaaaaagacagatcaactgtaaggtgaaaccattatgctcaagtgtgtatgttgataatggccgagtaaaagcaataacacacgaggatagttttgtcagtttgttgaaaaactgacaaggtcaaagtagtttgacctggcaataaaggacaaaaaatttcgttggatggtatataaggaaataataactttccaatggcatgtaaggaaattcataaactttggaatatgtgtttttatagtttaatgttaccgtatttgttaacggtttctaatctataccgacatatttccatccgtattgttccgtttttggtttttgatatttccgatatcgttttcatttccgactttaccattttccatttcgtttttaagaaaaatatggtcatgaaattggtttgtttctaaccattttcatccctatcgataacaaagcgttgaggatctattttgagaaaaaaatatttatgttttgactctaggtaaatagtatattataggggtgggcataaaaagaccaaatagaaaagatcgagcctgagaaattcggtcctagacagcgaaagaccaaattttgttcgatcagtctcagtctcctcggttaaccgaatagagcgaacttaaaaaatgtccaatgcaacctacaatccactcagttccatagaagtaaactctatttttcacattactactccttctagacatgtaacccaataagagtctttactcagatgtgcttgtgattttttttgactttggtgttgaaaatttctatgatttctttgcatatatgaaactgctgctaaatttcggtcaggattgagaccgagaccaaatttaccggtactgatattttgttattgaaattcggtcttcactattatcgaactgaccgaaagagcgaagaccgagaccgaaatttttggtctgaccgaatacccacccctagtgtattctaccggaatccatgaattgaagcttctaacgaacatactaaataatcaaccttgtactaacttgcatttccctaacaaaattcaacgtacatacaacacacaaatcgatcttttttctaaaaactcccataatcgagatagtaatttttacgaaaatcgtacaaacaatataaaaacaataacgcttttccccgaaaaaaaaacaataacgctttgaccaattaccttttgctgacagttctaacaagcagaagtcaaaccttgtaacttacatttccctatcaaaaacctaacgttcgttcaaatacccaaaacatgttcctcgaaagaaagacccttcccagaatcgagatctcgcagcatcgccttttcagagagaaaaaaacggaggcccgatgtgttccagcgcgctttcccgctggccggccgcgccggcgcgcgcgggaccgccgccgccccaccgcctgctgcaaaaccgcacggcgcgcggcggggccacctgcggttgcgggcggcgtgcgcggtgaggcgccgtgaagatattaattaatgaaggaacacgaggaaacaaataccctgtactactacatgtctcgccttcatcacctctaccgctgccattcgacggtccatattcatttttaccatcaatccgacggcgcaataacagtcggcctccgctactactagtaaaaaaccccatgttactccacttgttaccactattagtaatagcagaaaccatcattagttactaaagtttatagtttcatcgaagattaggaaatcaactcccaagcagtatcaaccgcacgtgcttgtcgcatgccccctggcacactttacgttaatgttccttttcttgtcatagcatttgccctaatcctttaagcctaaccactagcagcactggtagtacaggagtaataatctactggtactaggctaatctgcatgttgtttcgccatcatccaacagctagcgacagaatctagaacggatttccagccatccagtccgataaaaaagggtcaaattggatcctttgtgagagtcattctggcccccacatttcatacctcgcgatgagctagttattacagacaaattaggcatgtttagttccccgtaaaaacttttatcatatcaaattgaatgtttagacatatgtatagaatattaaatatagataaaaaactaattactccgtacacagattgcgtgtaaattgcgagacgaatcttttaagcctaattgcgccatgatttgacaatatggtgctatagtaaatatttgctaatgacagattaattaggcttaataaatttatctcgtagtttacaggcggaatctgtaatttattttgttattagactacgtttaatacttcaaacgtgtgtccgtatacccaatgtgacaagccaaaacttttcacccctgcatctgaacacaaccttagtttttcttgtcataaattatgaattaatccctccgtcagccatggtttttcgcgtccaactttgaccactcatcttatttgaaaaaattttgaaaaaaaataaaaacataagtcacgagtaaagtagtattcatgttttatcatcttataacaacaaaattgctaattataaaaaaatttcaaataagacggacgatcttgggcgctgaaactcatgactgcacttattttaggacggaggtagtattagtactaccggcgatgagccaaaacgtcaatttttcaattgaaaagatattagcctctatcttcagttaaaatagaattagagggagtactccctcggtcccatttcaagtacggccgttaacttctatttaatgtttgatcatctgtcttacttaaaaaatttataaaaaataaaaattaaatcacgtataaagtactattaatattttatcatctaataataaaaaaatattaataaaaaatattaataaaaaatttaaataaaatgaatagttaaacgttagacacagaaaattcacgagggagtatttggatcaggaggacgcgagagtctcaggcctaactttttcttcaaacttctaatttttttatcacattaaaactttcctacccatataaacttctaatttttttttcaaactttaaattttaatcaaacttctaattttagcttggaacacacgctgatgatgagtgagctgaggtctgtcctcttttgagttttgagtcttgactttgacaagtgttgtagtcagtggtactgtagaccacttccatgtgggtggggcccacacgaggccacgtaggaaccgatatggcgacggccggatcgggcgcgcaactgttcgtgcccaaccccggagcccgggccccactaccggatggagtacgtgtactatactcgtagttttagggggtctttgggcaaatacataagtagggtagggacttatattttatatttttatgagagggactaaagtttagtccctagttcccaaacaccctcttagagcatccacaatggtaatctataggctctctataagagatccatgtcagcatatttttctacctgaaagagattaaatgaagagagagaacaaatctatctactaaactggagatagtctataaaaaaaccgaggcaatgtattatagcgctatagatacccatgtagacatactattgaggtgatttactattaatctaatctattgctgagatatacatatagatagtaccttatttttttcattgcgggtgctcaaagttttctcataccaaaaatgccaaaccatttaaatgctcctattaaagtctcccaacccagtgatctttctctggattccttctctctttcccgccataaacggagtggtagtagtactactcaataagtttcccgcgaaattatatattttctttttaaaaaacctagtacgatatactagtagtacgtactcctatacatagactgtgttcggtgatacaagaaagaaataagaaacggatttgctacaaacctatcgccattcgccatattttctgacaaagaaaatatcagatgagtcatgagtgtgaagattcgtactcggcatggagagaaaaaattggcagcacaaacatgtggcgataattgacctaggatccttgtggataaaaaccaatgatgctagccaaactagtcagctttgttttcttgtttattttatgacaagttacatatagttaaatttcagttacaatgtactaattacactagaggtatactatagttatatttaaaagtttttgagtcaaaaaaaaattgtcgatagttttatagatagtcttataagcctgacagtttactgagccgttaattttttgtcaaaaatattatatagctaagttatttaaaaaactatattcatatatttttaaaatttaaaataattaatcatggttcacctactaggttagcttttttttattttggagggaggatgtctaggatactcctcctagggtgtgtttagttcttgaaaaaagttgaaagtttaaaaaaaaatttgaaagtttatgtgtatagaaaagtttttgatgtgatataatatgatagaaagttgagaatacgggaaactaaagacaggtctactgtatatagacgtgatttactaggcagagtatagagaaaaaaatgaagaatgcatcagcgcgcgtgaaggagtcggaggaaaagaagggcatatggcatgggactatgggaggacatgctcccggcctagtgcactgcaacacggccatccttgaatacaaagacccaagaaacacgaaaaactcgaaagctcccagctgcatgcttgcccctgctgcacagagaccaatggccaatgcccctcctcctcctcctcttttctctctcttcgcccacctccgtctctctctctcctcacggagtctgactgacagaggtaaagcagcagtagtcgcagtcgcagtagcagcaacagcagctcgcaccgttgcagcctttgctctctctctcttctctctcctctctcgctcgctcgctgtgtggctggctgcagcgtctgacgcgctctcctaggcaggcctcactcctctctctctctctctctctctctctctctctcttttctttctttctttctcgcacagatacaaaggtgcacccggccccgcccctcccgcgagagcacttcggttttaatcgccgggagaaaaaaaataaatgggaggggcggtttggggaagaagaagttgaagaaggagaggaggacgctgaaaagaccaagcaacaagaagggagtccctctttctctttgggagtggagagagagagagagagagaggcatcggccatggcgaggtttctcctgggtgcggccgccattgcgctgctcgccggcgtgtcgtctctgctgctgatggtgccatttgcaggtcagtgctactgcttcgctttactactcctacctgtctaacggatcggttttttgttacaggagtttagagaataaatatgccatattttctcctttttttttattcttctcggagggtaaaaaaactctgatatttctgggcttgggaggcttggaccttggagtcacctgcttgcttaatgcgtgttgttttgcagtcaaaggttgatgcttctttttgggaaaaaaaattatagcgtttttgtgaatgttttcagtccaagattccttcgaaatggcgccattttgttttgagctcacacatttcacccttcctcaagttggccttgctgcgatgctcgcatggtttctcctctcgaaagacaaaaaaaaaattaaaaggaaaaaaattgctgtcttgattcataagaaggaatgtttcctgaatcttgagtcaggaataagaatcctagtaatagataattatatctgcggttggaatcacgtgaaatcgtggctgcggtgtactactcaagttttatttcgtggacacgggtggtggaacacacaaaagggctgcggtttataccgttccattgtgactagtagtacacctctcgttttaaagaatctagttagaacattagccttttttgggcatgtggccatgcaggtattgtgtttgtttgttaactgtccaaacaatgttgtcctaccatggcctttgtgctctgattctgggctctgttactctgtgtcaactctgtttcatagagttccatattattagtccaagtccaggagttggtacttcgtggcaagaaaaaatcagagcaaatgttgctatagcagtttaccaatttcgtatttattgatctgtttatgtaattattatgttgtatgaagttagaactctgctccccacaaatgtagcatttttcctattcagtccaggaaacaaaggtagaactttcatgagtgctggaagtagttaggcaaaagaacaattatgatggctgtggaacatgtgaattgggcagttccagagttcttccccgtggtttcgtattatgtatgtagagttgaatgcatgcttttggtctagcatcatgtaagcgccgaattcgacccaatcgcggtagtttgtcaatccagttatgtaaactgttattcgaagtagcacttcaggtttgcaaattgcagggtagccacatttatttgcttttactttgtgatatattatacatttttttttgttgtgaaatttgcctgtctctctgcagaagcatatgatcctctcgatccaaatgggaatatcacaatcaagtgggacatcacacagtggaccccagatggctatgttgtaagttcactagattgtcagctttcaacataagctggggctctttgagcctttcatctaaaaaaagttcacgagattatgtgtctgaaactaccatttaccaatagtgttaagtcatgcatggtaatttactataaaaccctgatgtgatctcaattgctctagacatctctctgaaattcactttacagcaaggaacctttattttgtgtttttctcttgtttatagttctactttgcatcctatagaaccccaaataaacaaatgcaagttattcttctagttacattttgatagtgggcaagacagatttgtgcatcatttagctataactctctgttttttttttgtttcatggacacctctttcttaaatgattggtaacttaacagcttctaagagatgtttacttgttcttgatgtcttgtataatgtacttcccgtaggctgttgttaccatatacaacttccagaagtaccgtcatatccaagcgcctggttggagtcttgggtgggcttgggcaaagaaagagatcatttggtccatggctggtgggcaggccacagaacaaggtgattgctcggcattcaaagcaaatataccgcactgctgcaagagggatccgagagttgtcgacttagttcctggggcgccttacaacatgcagtttggaaattgttgcaaaggaggagtgcttacctcatgggtgcaggacccactaaacgcagtagcatcatttcagatcactgttggacattctgggactagcaataagacagtaaaagcgccgaagaacttcactctaaaggccccaggtccaggatatagttgcggattagcgcaagaagtgaaacctcctactaggttcatttcactggatggcagaagaacaactcaagctcatggtaagtcatttcagtgttttttgtctttctggcgtcacaattatgacaccctttcttcctttttttgcagtgacttggaatgtgacatgcacatattcgcagtttgttgctcaaagagctccaacttgttgtgtttcactttcatcgttttacaatgagacaatagttaactgcccgaaatgtgcgtgtggctgccagaataagaagccaggaagctgtgtggagtaagcactgttgctttaggaagtctatggattaacaaactaatttcccacttctgatttcttctatgtattttcgttggtaggggtaattcgccttatttggcgtctgtggtgaatggacctggcaagggcagcttgactcctctagttcaatgcacaccacacatgtgcccaataagagtgcattggcatgttaagctcaattacagggactattggagggttaaggtcacaatcacaaattggaattaccggatgaactactcgcagtggaacttagtagttcaacacccaaattttgaaaacgtctctactgttttcagcttcaactacaaatctttgaacccctatggagtaataagtgagtatttgcttcaacttctgagtaagtttgacaattttaatgtgaaatattttggctaacgattaatcttttgcttcagatgacactgcaatgatgtggggtgtcaagtactacaacgacctgcttatggtggctgggccagatggaaatgtccaatccgagcttctattccggaaggaccggtcaaccttcacctttgacaagggttgggcttttccaaggcgcatatacttcaatggcgaaagttgtgtcatgccttcaccagatctgtacccatggttacccccctcttctactcctagatttaggactgtattccttctcatgtcattcctggtttgtggaacattagcattcttgcacaaccacctagttttagacaaaaactgtggaaagtgctgaccacattgggcattggctgttgacatactgagtcttttggaagtttagggtgtgctcttgcatgaaaagctaattcgcgtttgatttaggttgtaagtttaggttcctcgaaatcattaaagtttgggttgtacattctgatggtgtgtattcttggtctgaagtgtgaagactaattgagaaccccaagtcccaacattaattgtctagagaaatgtttgccatctcatctgattgcaagaaattgcattttgtagttggtcagtaaatgtggaaattgtttcttttttcctctcaattcaaggtcaatacctgcatacatatttgtagtcacaacagaatttgcagaaaagtttgtggtgtgatttctcagggctggcctaactggggactgaccaaaactcttccagcctgattgtgttgtacattatggagatctatcaggcaatttcaaagttaacacaatatcacagatttcctctttgactgaatatccagtatgaatagaccaaaatgcccctacctacactgctctccaaacatgtgggaattatcaagaagacaaagcaaaaggggacatttttctgatcatgccaccaggaggagcaccaccaagatcgccgaggcggcggcggccacggaacgcggcggcccgatcggagcggagttgggtaggtaggggtaggagtccggcggcggcatcttgcactcgtcgccgttgaagtagatcttgcgcgggaacgcccagccctggctgaaggtgaaggtgttgtagtcctttcgcatcagcacctccgactgcacgttgccgaacggccctgcctccatgagcaggtcgttgtagaacttgagcccgtagaacatgccggtgtcgtctgcaatataccatggccgtggtgtcgtccaattagtacaggtatagatatgaaagcgagaacgatgtcggagaggaggaataagaggttgtggtagagagcttactgatgttgccgtaggggaggaggggcttgtactggaagctgaagacctcggtgacgttgttgaggttggggtgctgggcgacgagcgtccactgggtgtagttcatgcggtagttgaagtttgtgatggcgatcttggcgcgccagtagtccttgtagttgagcttgacgtgccagtgcacgcggatcgggcacatgtgcgacgtgcactgcagcagcggcgccccgtccttgcgcggcgtgttcacccccgccgacagcgcccgcttcgagtcgcccatgatgcactcggtgccgccgctgtgccctccgccgccgccgctgttgcgtctgctgcgtccgtcgccggcgcgggcgttcttcccgccgccgccgttgccgcggtagccgtcgtggccgcacccgcaggcgcacctggcgcacggcacgatggtgctgttgtagaaggaggagaaggagacgcagcaggtcgggtagcgcgacgccagctgctgggagtaggtgcaggtgacggtccacgtcatgagcgcctgggtgcggcggcgccggtccggggtgaggtagacggtggaagggacgatggtggccgggccacacgtgtacccgggtcccgggccggcgagggtgaagttggtgggtagcttgacggtcttgttggtggtgccggcgaggccgacggagacctggaaggcggagacggatccggcggggtcctggccgtaggcggagacgacgccggccttgcagcagttggcgatctgctggttgtaggggacgccggggaggaggtcgacgatggccggggtgcgcttgcagctgtgggggatgccgcccttgaacttggagcagtcgccctgctcggtggcctgggcccccacgatggaccagatgacctccttcttggcccacgaccaccccactgtccacccgggcgccaggatctgccggtacatctggtagttgctcatcgtcaccatcgccacgtacccgtcgggcgtccacgatatcacgtcccactttatcgtgatgttccccttcgggtccagcggatcatacgccactgcaagcacacacacatgcatgattgattaatcaacagcaaaagtataatttaattaggaataatgggcaagaagatcgaagaagtaattaacctgcaaccgagcatgtcacggcgaggagcagagcgaggagagagcatctgtgcagctccatcgtcgacctcaccggccggcgagcaagctagcacagcagcagcagctactcgatcgaggtgagcagggaattgaatgagaaggcgtgcactggctggccaggaagagggaggagaaggtagaagaagaagaagccaccgagcggcgagatggcgcgtcacacctcgatggattgatcgtcggttgggtttcttgaggaggactcattgcatgacggaaggggtgatggctcagcgccacctctccgacatggttaacatgccgtgaatcttgggttcgtcccgtgcatatgcgggcatggcgctcgctctgcacactcgtctggctggtctgtgaagctgatgatttggacggcctgcggctgcggcatcgcggctgggcgaagcaaccgtggttgatggtgacggagggaaagggacgccggagatctcgcgcgctcacctcatcgatcgaaccaggagagaagagggtgtgtttgcgatagcgacggcggaacattttgccaatttttcgttcgtgtaaggtgcgcggcatctgttccgccagttgcaacgtttgatcgatcaccgcctctgcagccaccgacgacatgtatatatgactatcaaatttgttttcttcatcaatcactttatattagtactgaagatttaaaataataaaacaatcaaattggtgatcattggatgtcaaaataccatagattacggtcaggccaggccaacgcgagatcgatggatcgtgtcatggatactcgatctgctaccgctcgctctatacctgacgtgattataattgatgtcattagattctgttacttgcttttccatcatacttctgtttggcggtacgactatccctggcttacaaagtggacaaggattttgatattcctcaaccaaccagttggcacgttttttcaacacgaacgccaacctcatcgatcgcatatgcatccttctccatctgccgtacgtacgtacgtacatattcctgtgtaagtacgtactttacttacttgcgtgcgtgatgcacttatacacaatacgagttcagtagaagtagaaagcacggaaccattcattcctctccgatgatccagccaagcagtaagatgaagcatcacacctgacagcaacccctcttatttttcgtaaaattatgcaaccactcttaattttgatgagaaattttcatttacctttatactagtatatactgtagtaacatacaaaaacaagaactcccttaatttttaaaagagtgttgttaccatcctgcgttttgtaccgtgaggtacaggtaccgcgcagtaccaaaactaatccagccgttgattaagcgggggtaggatcggaatagagaaggaacagacaaacccgatgtggcggcgcggcagagaggtgaacaaggcgaagcggcagagcatgattcggcggcatggtggagcccgacgcggcgacgcggctgagcatgaagcagcggcgtgcatgggccacctggtctccatgatcgagttcggcaaggtgttcgccgcccgcggcctcgccgtcaccgtcgtcgtcgtcgacccaccatacagcaacaccggtgcaacgggggctttcctcaccggcgtcaccgcggccaacccggccatgacgttccaccgtctgccgaaggtggaggtgccgccagtggcgtccaagcaccatgagttgcttaccttcgaggtcacccgcctctccaaccccagcctccgcgacttcctcgccggcgccttaagtcaaattccgcggctgagcacgacgcggcggcgcggcggagcccgacggtggcgcggcggcgcggcagagagctgaacgcggcggcgcagagggcattttgcgatgcggtgcagatcgtgctaatgttcaaagactaaactacccttccacctctactgccaaagcggtactgcgccaaggagaaaaatggtaccgcgaggtaccatgcaatcctagccgttagatcaattcgaacgaacggtccagatttcgtacctcggtggtacctcgggggggggggggtgctggacgattaaaaaaactatttttaaaaaccatcctacaactaccaaactaccacatgggttgttatatatgcacgtggcaccatcttgccagctccgtgtgcaccggccgccgggggcctgtctaggcctccgcctccacgcaccttgtcgcgtggccaggcctctccaccgcccgtgcttcgggaaacagattcacagagagatggggaggaagatgagtggaaatagaagagggtgaaggaagaggagaaggggtaatttagtaaaaaaaaatgtagaaaataggtttaaagggttagtagtgacatatgttaaagaaaaaagtctgacttactcccctgaactattgggtgagtatgaattaccctgataaaccctaagactagacatctttcatcctcaactattaataccgtatccacccagcagttttgcaggcgattttggtcctacatggcaccaacatggcaatccaattaggcaaaaaatataaaaaaatgggccccacttatcatatactacaactctatcttttctctctctgtcggcaattgcgctgggggcagggggtgaggcgggcggcattgagcacgacgacgcccgggagggcgcatcgccaacagggcactatggcgggaggcaccgggagaaaagctgggcggcggacgcgagaacgatgccagtcgaccgcatctcccatggaggcagcgttacacagcagcggggtaagggtggcaagcggcggaggcggctgagggcggcgagtagcggaggcgtctctcgtcgtcgatctggtgggccgcaccatcaactgctctagatccactgtcgcccaggaccccacgccattcctcgtcgccctccatctccggctcgctgcttgcggagcctagtccacctctgcttcgctagttgttgcttcctccgactcattgcttgccgagcctggccgctgcttcgtcgactaggagggtggaggcagggggaggtggacttcatcagctgccggagacggctgcaaagagagattgaggaatagatagaaaggtgagaggggaaaaagatggagaacgggagagtatggcatgtagggtcccattaatatttttttttaaaaaaacaaattgctgtctggactgccacgtaggactaaaaccactttggattaagttaagttgtttttcatgcggtattaagatttgagagtgatagatgtctgattttaaggtttaggggagcaattcgtactcacccaatagtttagggggtagtttggactttttcctatgtcaaataacaataaagttatacttcaaattcgtaaaaattgtaaagattgtagtggcatgtatccaactaacctttgaaagaaaggccttactactagaaaaatgacactactacattataaaaagatatttaacacttttccaactcgagtgcgtatatgcgcatctattacatgtctgtgaaatgaatgatcataaaaaatattctacctagttcatatgcgatttcaacaaaattagtactattgacatagatcgtagccaataaatcaatcaaccaatatatcgttgttactaagtgtattattgcaaaatttacagggaaaattgtacaacacacagtatttcttttacaaatgttgacgaaaatccttcgtctcggacgaccagccagggggggagcaaaatcgggcgctctcccctgacgcgcacgtgtcctcatggccccaccatatgtcctgcccctacctgacatgtgtctcaaaaaaatgtttcacctagtgtactcacaattttttattatgtatagatctaatattgcagtaaattaaaatattcttttgcaacaaatcatccacatatttttggaaaccctctattaagggaattcgttttattttttgttccacaaaaaatgtttcacctattgtactcagaatgtttcactatgtatagatctaatgttgcagttaacaaaacattcttttacaacaaatcacatgcatattttggaaaacctctattaagggaattcgtttcattttttgttccacgaaaaatatttcacctagtgtacttataatgtttcactatgtatggatcaaatgttgcaatgaactgaaacattctctcgctatttgctgaaacattgtttttatataaggtgaaacaatgtccgatttaaacgtttgaaacattttgaatctacttagtaaaacaattccaatatacctagtggaacatcgtacaacatttaaaaataattcaataataagctaaaatgttttttcgttggaatatatccatgtgtggtcttgttttgaagatttcattgcaacgaatttaatggtgcaatcagatcatgatttggataaataatttaagagaaaaaatagtttaaagtgcttttgcacgcatgcgtggcgttgacgtcagtatgatgtcagcgcctgattttacccccctccccatcgggcacccgatcaaggcgtgcaaaaatcgggcgttgacgtcatgcacgcatgcgtgcaaaaccactttaaactgtttttttctcttagggcttattcggaacacaggataggaaaaatgcaggaataggaaaaacacaggaatagcataggatttcatatggaaaacggaggattgaaaaactaaggaatttgatgatagaaagcattcggaatacaggaatatatataccacataggaattttactgtcaagagtaattaaccatgtagattataatctaattaagcaacagaatactattttctatctagtcactattctcgagtactctctagacaggaaagccttatcctcttcaccgcatcatccttttccccaatctttcagaggcatggggagcagcaaacaaacaaaatcaacagggatggcgggctcgatggttggcagagcaagctcgcgcgcgcagctgagctacgtaccggggggagcaagcgagacggcggttggccgacgagctcgcacggccgcgcagcaggagcgagctgccgccatggccatcacaagctcgagcagctggcaacctcgagttgcttcttccccttgttttttttttctaattggattgcttcttattcctatccttcagagttcttgctcagttgctttgctcgtattcgtaaaagttcttgtttactgcttgattacctcggtcttacgcgaaggaaaacaaaaatgaggtcggagtggatgttatttttccaatgtttttcctttgtaatcagcagcaaaggaatctttccttagcttttcccatgacctgtttgtgccttccaaatgataggaaaggaaaaaatccatgtcaacattattccttcaaaaatcctttgaaaatactgtaatccgaagatgcccttaaattatttatccaaatcatgatccaattgcaccattaaatttgttgcaattaaatctttaaaacaagaccacacatgaatatattccgacgaaaaacattttagcttattattgaattatttttaaatgttgcacgatgttccaccaagtatatcggaattatttcactaagtagatcaaaaatgtttcagtcctttaaatcgggtgtttttcaccttatataaaaacaatatttcagcaaatagcgaagaatgtttcagttcactgcaacatttgatccatacataatgaaacattatgagtacactaggtgaaacatttttttgtggaacaaaaaattaaacgaattctctaaatagagggtttccaaaatatgtgggtgatttgttgcaaaagaatattttaattcactgcaactttagatctatatatagtgaaacattgtgagtacactaggtgaaatatttttttaagacacatggtggggccaagggaatgtgcgcacgtaggggagggggtggagcacccgttcctgctccactcccgtcggtcacccggggctgagcattttcgaagtttttctccctccgtttttgttcagatagaccaggtactcacgcgtactagcatggcggaggagggtaggggccctcgcggatccatccgcatgagaaggcggcatgggtggctggactagggataaatgggaagaaaatgcttaaattatttttctaatttacaactatatagtgttttttgaaaaaaaagaatcaaaaggtaaaacacaaatgaatattaatacattggaaaacaatcgggaatgaaatgaacagccaatatgattgaatcttgtataacttccaactaattaaattattagacgagtgagctttattagtaacattctttttctaagtatgtatatataattatatatagcactaacaaatttaaccccgaaaccggaggaggctacctctagaggcagcaataaatgggtcaggcaccgggaaatggtcaatcgccggcgttatccgcaggatgacgtcatcctccttggtcttcgccggcaaaggccgctggtttctacggggcttgtcatcgtcgtgctcttccacgctatccctgatcatgagctccacggcggccaacgtggcggcgccgacgagcgcggcgcggcccacggcgagcgggccgtggcgcaagcgggcgacggcccccgtggcggcgccggcggcgacggagacgagcgggtcgtcgtgcctgtcggtcgccgacgacagggcgtggcaggcggcgctgtagacggcgaggcgggcggcccagcgggtggcgaggcagggggcgccgtcgcggacggcctgggcggcgccggcgaggtggcggccgcaggggaagtcgcggaggcccgtgaacaggtgggcgagcgtgccggcggcggcgccgcccacgaagccagcgccggcgttgtccaagacacagtccgggtagggcaccccccactcctcctccatggatcgatcgatctcgacgacgaccttgcactagtgcagggaagaagaacggatcgaatcacgatgcagatttcaagctgggagtgggttgtgataattaagggagacgcgcgcgcgtgcgcctcaacagtgaacacgactcgaatacttggatgaacaccactggtacggatcggattcgtttccaattcccggctcggtttgatatgtttcggccttgttcggttggtccgggaatgactggggttgggctgcaatcccgtggatcagcccaacgcggattcaatgccggcccacaagaaaatacgtgttcggttaaacccaatcagtgtgctacctcaccccaacccgggaaaaaaatcagcttctcctgaggtgtggaaaaaaaaaaatcctcacaacgggagccgggaggcgacgcgcaagcgcaacacgctgcggcggcgccacaactactgaaaggcgatgacgcgactaggaggcgacggcgatgcggtgcctcccctccggcggttgtccccttcagtggctaacttctcaccggtaaacttccttcttccttcccctcttctctctggtgtcctagggtttcctgggtgtctcttcgctcgcggcaacagcagtggtggcatctatcttgatccttttttaatatatagagtgtatctttatagatatgtctaagaataaattaattacctcagtagataattatatgttgaatctttcaatttttgtccagatcaaaaattgataattatcctggtagtatgttggattgattttaggttcaatttcagacatgaagagatcctaccatttcttaaagaaaagaaatcatgcatcactaagcatgtttccgtagtaatatattgaatgcaactcaaattctttgtttgataaagatattagattttacttattaactattgcttatccttttcactcaggcttctgttggttatttgtttctctttatatgaaaggcatataatgacattcttgagagcaagcatgtgtggctttctggtttgtacatgcaggaagaacacttcttttctttgtttttttagcacttctgttcagggtgaagacatcctttggagcaagcattggtgttggatcttatatgattgaatttttgactgatacttctaccttttaactgagacatgtctactcattttactgcttatgtgattaaatcattagacgtgcatggatagttcttgtcagatctgtcaatcttgtgaactaattatgttcagatgggcaagcgattaattatgtgtctgtgtgctgatgagtatgattaattgtgtgtatatgtgctgatgagtatgattaattcgtgtatatcagtatatgtgatgttgagtagatgcatatggccatatgggataacttgtggtgatgctttcccggtcctaaaccatatagaggttttaggagagggattaggagaagcaaggggattcatcccccacagggtttgagtgagacgggagggattccctttggggtaaaacccaataaactgaacaaggccttcctgtgatacagcttgaaccacaataccttgggttttgtgtaatttactcttgagcaaatatcatataaccctaggttttggaaaactagtttcacagaaccacgtgttttgaagttttttttccacgaaacatgcgacttggagctcccgacttactcctactctctccgtcccaaaaaaagacaaactctggttttcgtgcccaacgtttgaccgtccgtcttatttgaaaaatttatgaaaaaaattaaaaagacaaatcacgcataaaatattaatcatgttttatcatctaataataatgaaaatacgaattataaaaaaatttcatataagacggacagtcaaagttggacacggaaacccagggttaacggtagagtaacagtggtgggttaagcggggaacataacatatgcacacaaacttcctgtggacactccatccacaccaactagctaatatcatagaaagttctaggaaaaattggacacatacttccaatagtattacacctatgtgtgaaatcttatcttcaaattcattatattttagctgtaacaaaaaagacaaaattctgacatatttttaccctttaaactgtcagatttttcaccttttcgctacggctaaaatataataaattagaatatgagacttttcagatatgtgtagcacaattaggagtaaatgtccatttttttctagaagttttcgtgacatttgctagttggtgtgcatggagtgtgcgcgggatgtttgtgtgcatagaatattttctatgtcagcgttacggataaggtataccctctacctctggatatatgccgtatactgatacggtatacctgcgcgtatacggatgtttcctgtacacgttaaggaaattcatcacgtaatagaaacggagtctacggatggaaggagtcctactcggactgaactgggtcgtcactgtatcgtgtggggtctgatatctccgagttctacttggagatcaactgacccgcagtataaaagggacccccgggaggacctaaggcattgaatctcactgccaacacaaccaccacagcctacgaagtcgaagcccacaggagccaagtcgccgggtgatctagtcggaccaactcgactacggtctcgtcggtatcatcgagttttgttattccctttataatctatggtttccaccatataattccatatcaactgaattagggctattacctatcaaggggcctgaactagtataatccttgtttcttgtttgcttgatgtcgtattacgtagatcctcgtaccagcgtaccctaataccctttatatccggtctacgggtatcccccgtcgacagaatatgttcccggttaagtgatacatacaagtagcctcaattgtgtgttatgtaaaaaagaaaaatctcaaaacctgttattacgtgaaagtagtcccaaaacatagggatctcgtaatatttactcataactagcacgcgatcgaacggacgatagcggcgggaaccggtgcacaattaacacaaagtgtgggggcctttttgcaaaaataaccgatgatgtggcacacctaattctccaacgatctcacgacatttagagaagttaattatacaagatgcacggcccagtggcggatctaggaagagatagcagggggtctgaataaactagataaagctacatcccctttccatttgcatatagcaaaaaattttagtgggggttttgtgggggctcccatagtactcgtgccagtaatgagggctcaagactccgccgtccccatgctagatccgcccatggcacgaccttttgtttagtagaacttgactatatcattttcatatcaaaagaccttacgacattcttaatagtacaaaattaacttatgttaaataaaatagcctgtatgcgagtttaaaaagctttaattttgagaagcagctgattagttgctagatgataaaaatatgaaaaagctaagttttctagctactaacttctaattgattttatggactatgtagctatagattcttataatctagatagaaactaatttaaataggtgcctaacttaacatataaaacactctctctatcccaatttaatcaacacctgagaaaaaaaatgcagagacccaaaatgctatgtcgcttttttatcccgtggattgtatcatgatttaaatttaatcttatttggttacatgcaacacattcaatgatatttatttactctttaatttttacacaaataaagcccgtggattgcatcatgttttaaatattgtatagaagtgtattaataaagtcaatcttatttggttacattgagcatattcaatgatatttatttactctttacacaaataaacgaagagacttgtttggggtattcatccggcaggcacctcctccaccacgacgggcttcggcggcacccccaggaacccaatcggcggctcgtcgtcgggtttggggtcgctgccgccgccgccatcgatgtcctcctcggggacaagccgcctgtggtagtggacccaggagcgcaagttgtccagcgcggcgtcggccctctcgatgacggccatggacgcggcgccgacgagcgcgccgcggccgacggcgaggggcccccggcgcaggcagtgcgcggcccccgcggcgcccgcggcgagcacggagaccacggggtcgccgtccgtcgcgcgcggcagggacagggcgcacttgaaggcgccgtagaggccgcagcgcgcggcccacgtggcgctgatgcggggcgcgttggcgcggacggcgcgcgccgcgccggcgaggcggtggccgctcgacgagccgaggaggcccctggcggcgtggtaggcggagccgaccccgccgccgatcaggaagccgccgcccgcgtcgtcgagtatgaagcccgggtacggcttccgcggagggctcggcaacggcaagtccgtgtcgcgctcgtccggtcgcggcggggacggcgacgccatgatcggagcacggaggaggctgagctgtgcttggcttgcgctacaagattggtacagtagtagtacagagatcgaacaccgtgatcggcgagtacttgaagaaggaacttgactttgaattcgaaacagatttggattggattgaatttgcacttaatttagtcgaattctagtttccgtgtaatgtaacacaaatcaaatcctaatagattcacctcacgaagctaaaaagatgtaaaattaacaactccggcgacgccgctgtcgatgtcggtgtcctcactgacgctcttcagcgaagaagccgtcggaaaagccggagtcgtcttcgttgtcggcgacagcgacctccttaaccacgatgagctgacccgggaatcccggggaggcggggaggcggcgtggacggcccaccggtgcgcgcgcggcgaggccgcgacgaccgtccgccggcgggaggtcgtctagggcgcggtggatcgcgagggaggcgccctccgcgagcgcgaagaaggcggcgctccagagcgcgtcgcggccggcggtgaccgctccctggcgcaggcgaaggaagccgctcgtggcggcgccggcgaagacgaagttccacgattcctccttcccgccgcgcgcgtaggccatgccgcactcggggacgcagaaggcggcgaagaaggcggcgaagctgccggcggcgcggggcgcccccgcgcggacggcccgggcggcggtggccgcgcggcgagccgcggagccccttgaagaagtggaacggtgagccgagcgcgaacccggtgccggcctcgtggacgatgtggtccgggaacgggatctgcgccgacggtgcgtgcgagccgcccatggagatcggcggcggcggatatggcttggtgacgccgcggcggatcgcgcgcgatggagggcgtacgtgtatcgtaccgtacggggtttcgcgcggtgtatttggacgtgtgcttgtctaggaatacattacgaggcggtttgtttgcgacgtacacgtactcatcgtgtcgctcgcgtgagccgccctgcctctgtttgctccctcgtctgagttgtcgtcggtctcacattcctctgttcgacgcaggcgaggacaaataccagccaactactgcctccgtcccaaaataagtacagctatagatatccgtgtttagcgcttggaccatccgtcttgaaaaacttatgaaaaatattaaaaaaaattagtcacacataaaatactattcatgttttatcatctaataacaataaaaatactaatcataatctttttttcaaataaaacaaacggtcaaacattgaacatgaaccgtgctaaaactgtatttattttgggacggagggagtagattatagataaaattagcagggaacctacggattgtctattaatttaccgtgtaagtggatttatatatcgatccacttgcattactagatgcggtaagccggaccacaatgcgggaatccgcggaacatttaactcaatgccacttttaagatgtggtaattaattatttgccactcattgtctatgacatatgggctctcatttgtctatgacatatgggtccagtgataaataatttatcaccactcgtaagagtggcaaatagttaattattctggaatctactgattattacttattgacctataaacaaatttgcgggttggccccatccctaggctaacgtgattgtagtcactcctcacggagagacgtgattgagttgaggtatccctctggctgttaccatatgactctaaatattatggtttaaaaatttacaaatcactagtatttctatgaaatttactttaaaacacgaatggttttcaatttcgtttgccacatatatagggtgtagcgaattttttaagtttaaacaaatttgaataattctaaaccaaattcagaaaaaaaggaaagaaaagataaatcacgggcgaaacagtttcatgccataataatgtgattttttttataataatgtttgttcgtgccataggattatgatcctcactttgcatattgcgaagctatatttatggcgctatatttttcactaaaaaatagttagcatgtatttacattgtaagtacataaattacatattatgcaattagtttatgtacaatacaagtcccaaaaattacatatgtaaatcccaaaattattatatttgagagatgaagtgaataattcaagtcatcaaacaagcataatgaaacatccgacgcctcgagagaggaatattggagacattgctgggcccttagcctgctagtcaacttcaatctgagatgtgcccgtcaaccactcgaaggcggtgaccagatgtgttacacattcaggagacttgacaaaaatggctaaagatctacaacctctcaaatattcctaactcatactcatatgaatctagttccccggatgggcactagatccacactttcatcttaagcatgattatacatagtaaacacaactaacatgaaagaaacttaagacttacaacaacataataattacataggccgaccggccaaatagacttatttagagaacaacggaagcttgactacccaatcacaagcacaccgactaggggtttaccccattaagttctcatcctagaagaagcaatcggaacccgcatcacttaaagactaagactaaacctacaaacaaaaggttatatcaacagcaagagttaggacattaaacaagttaatgtactagcaagcacaagtcaatcctaccatactacatgtaaggcatatattcaaaggaaggcaatatgtagttcaattttagcataaagcaagttttgtttcgcaattcttttgtaaaggagttgatacttcaattaacaaaacaaattttaagtttcaataagttcatcataattccatcataatcaatctcttgttgtcatcctttgacaacaagtcataatatatcacctcacacacacaactcaacacatttatcaatttcaaaccaatgtcacatatgatcacattttaaaacataaagtctatattcatgacacatcaccaaagcgctcatgaccgtgagcacggctaatcgattagttttaaagaactctacagagtttgtacagctttacccacatgatatgaactctctagtttgttttgagtttgcaagactccaccacactcttcatgttgaatgtgatctagaggtcataacgaagactttacactacttagagcctagccttgtaccagcacaatatgtgtttctccatcctagacatacttggaatatacctagaaccgttaagtggcgggcctatgccttaaacttaacgccgtggtggcggacacgacgggaacccaccacatggcacaataccgttgtattggacacgcttagtcacctaaactaccacatcggggtaaataggaagctcctctgaattacacgaactcatacacaccggcctaccagaatggaaggctagtcctaaatcccatactagcacatgtggatgtacgaataactttaaatgggtgacacaagttcggtccttatggacttgggcaaacactccccctatcggtatgcaactaacaccatatgcacaccacttgccgtctaagtataaaatcacattttacacattttagttcgcaaatatccatcatattaattttattccagcaagggttcatgtatcaaaattcatattttaattatagatggaatgagcatttgcatatttctaagcatggctaagcaagtagttgcacatagagcatatataaacccatttgagcgcaaagagtgtactctaaccatttctaagggttcaaacagtaagaggatcaattattcaaggtggggtatgcagcaaataggtcataactaccttaacccaattttaaatatcgacatagtctaagttcacatgcaactttgcaaacaaatattttcattcctcaaatcatgggattcaatgtgttcaaaggatgggaggagaaaacttgccttgatcagagaaatgttagtacctaatccacttcttcaccaattatgtaattatctagataaaggacacgttatgcaattaaacaccgaaagagctaaaaatctaaaatactctaaaatgcatgatttatgcacagtgggttggtactgatctaaaatgaatttaggtgaaagaattactattttatcttattccattagggagttatgaattttagaagttttatcggtttatagtagtatagtcttatgtagtgttataaaatacttttgtaaagtgatttttattatattagacttcacaggggtgtagaggtgtgttttctaagactaatgcatttggtttcacaatttttggagttataatgattttcttatagattttacaagttacaacgtgttttaggcatatagtgttttatatgtgcatgactctcaagttgtagtttcagaacatgctacttcctatttaagttgaataaaaggaataatttggttaactaaaacatttttagttcatatgtttatggtctttactactatggttcatattttataaactagagatgctctaatctaaactagcaatatattatattaacctagaaattggtatatgagctaagttcttctaagttttagtggatggaaatgaaactatatatggcttcactggtcaatcaagtttttatttaggtttaattagacctaaagtgtatatatacttatacatgtttatgtattacttcaacaacactatgtgtttaaattcttatttcactaaattaaggttttgatctatgttctctacaataggtgccaaattttattttactatgttgaagctaactatttgctggttctatagaaactttgttcatttcatttggactaaaaatgaattttctacaagttttacaaattaaaggctgctctatattagcaaatcattatatgaatatttagagacttttactacacagtaagtatataatcttatttcataacatggaaatacatgttttgatgatcctacagaacttaaatttactcaaattgaagctaaattgggttctacatgaatttctaaagtttagcttatctaaactaatcattctagagataatagttttagaggcatttgatgcaaagtaagtaattacttttatttcacctaatcagagagtgcataatgatgaatctgtagaattttattttgtttcaaaatgagttgagatgaattttctacgtattttataagtttgtacatgttttatgtatgacctatcttagataaattttagagacattatttgtacagtgagtgtcaagttttatatttctaaaatagagttcataactttaagaatctacagcaactggaataatctcaaaatgagttacatttgattttatatggattttacaagtttgggtgttttcctgttaaacatttaatgttttagttatttttcctttgcattttcagatttttatacacatgggtccactgatcggtggctgaaccaatatacaaaaaggtccctgggctttatatgaaacgcatttaggtccgtgggtccacatgtaaacgactgaagttttatagtttgaaccctatatttttgatcatttacaggacaaagtcctcatcttcaacctccagcagcccgatggactgggagcttggccatggctttggcgagctcgtcggcgacgattggtggctcgattgggaatgaggtcaaaagataaaatgaagagaatgctctcacgattccattcctctagttttgttggctaggagacatcggagtagcgccgatagtgagggtgagcggaaggtatacatgagctgttactgcatgttgcctaggggctttgattttgctagatgcatccatgcatgtgtttcctaagaggtccaggaggctcaccaagctgtaggaagaaatctccgaagcttggatagcagcggcttcagttggaacggttcgacggcgacgctcctcctcgggtgaacggcgacggctcaaacgggacgacgagctgctaaaggaaggcatgcacgagggttgtgaggtcaaggagatggtgtatgcgcgaggaatcgaacaatggctcaccgaggcagtggtaatcgacgatgacggtggaggcgagttcggatcggcgtcgaggaagaaaaggatgtgttctccgtgttcttgatgtttccggctggggttcttgaggcgtcttgaagaggtggtcgaggcgagattcttggcacagcggcttgcttcgggatggacgagaatggccggacgacaacgatgtctaagcggcggcgctccggtgcgtgctccagggcgtcgttggcgtggtcacgttccggtggctgtgatgcacaaaactggaggtggtcaacagagaagtggtttggtattgtgtggagagatgggaacgcgaaagagatagaggtgaccttgactcaaacggagatggcgatagtcgtcacctccatggccggtggtgaggtcgctagtgacggagaggcggaggacctaattagtatgtaattataatataagtaggatatatattatgatatgtagttagtatgtaattataatacaggtatgatataattatggtgtaactaccatgtcgtcatatagatacatgaaaaaaccgatgctaattaaaaaaggcaagggattaacgataaaaaggtaagctgcaacctcaccagtaacgaaatcaagcatttatcccacggtacattaaacagatccaactattttcagcccaaaaaagatactacacatatacgataatactgcgcccaacagtaggggagaaaaatcagacgctgcatgtgcctgctactgcatgcaaagaccgataatactgataatactaggcgtcaggcgcccgacgggaggggagaaaaatcggacgttgcgtatgtctgtcaactgcatgcaaagactaataatactgggcgtcgggcgcccgacgagagaggagaaaaattggacgctgcgtgtgcctgccactacatacaaagactctctcctcacatgctcccttctcttatttcttcaaaagattttttttctcataaattatttatctaatctacgatctgattgcaccactaaattcgttacaattaaatctttacaacaaaaccacatatgattatattcgacaaaaaaatatttttgcttttttattgatattttttttatgttgcatatggtctcttttgatgtttcaaccagtagttttacgatctttcagctagtgtactcatgatgtttcactatgtacggatcaaatgttgcagtg

SEQ ID NO: 68776 - DNA, 2581 bp, Oryza sativa
atccttgtgcacttgcatatttgctgtgtagcttgcggagtattccatgtactcaccttgcaataatcaatcaacctcagttaaagaaaaatgatccagaaggagaagacgtttggcttatacctcagttaagctgcctgtgggagtggagctaaagccatcgctagatcgttttttcgctgttgttttcttttcttttgtaagtatgtaacattattattaaaatggatttatatattaaattgtttgtttgtgtacctcggctgattcctggacgaggattttatgcacaaataagttcggaaattactagtgaatttctgggcgtgacaagttttctttagaagcttgtggaggtagaggcggttgatggcatggcatgcggtgctcacggcctccgcccaaaagatatctgaagtcttgtagtcatcaagcattgtccttgcggcttcaatgagggtttggttcttcctctcaataatgccattttgaggaggatcatatggcgcggagaactcgtgcttgataccctcttcatcaagaaattcctccacttgaatgttcttgaattctccaccattgtcgctttgcaccctcttgattgtgagataatagaggttttgaggttgctctacgaaacgcttgaagacatcttgtgcttcactcttgtcatggagaaaatacacccaagtgaagcaggaaaagtcatcaacaacgacaaagccatacttattacctccaatacttatgtaggccacgggtccaaatagatctatatgaagaagctcaagtaggcatgttgtagtcatgatgttcttgattggatgcagactcccaacttgcttcccagctttgaatgcactacacacacgatctttctcaaatgtaacattagtgagcgcgaggatgtgttccccatttagaagagttgacaaattccgcactccaacatgggctagtctacgatgccatagccaacctatggaggatttagcaatcaaacaagcttccggattcactctatccacattgaaatcgacaagatagagatcacccttcaactttcccttcaatgcaacggaagagtcatctctcctaatccttgtcggtaaacaagtaattgtaacccaacttacacaattgtgacacggataataaattatagcttaatgaattgacaaggtgaacattagagagagattgattgttggaggtggcaattttacctagacccacctttcctttaccatcatctccaaaaacaatattctcacgagttcctccctcctcgtcaagacttgtaaacatactcctctttccagtcatatgattagtgcaaccaatgtccacaacccaactcgaaccaccggagaagtatgcctacaaaagagaaataaagcttgggatttaggtacccaaacttggcgaagtttgggtcctttaatgttagtcacaattgccttgggcacccacacacaagctcgatactcttcattttaatcaccattaaaacaagcgaccactttgccctcaagattcttttttttttttgagaattacacagtacaacgcagacactcataatgcacgcgcactcacccctatgaacacacgcacgcaaaccctacccctatgagcatcttcgaagactgggccggcgaattctggagagattgacgaagtcaccacaggcgcctcgatgtcgacgggtacgtcgcctaccactgaaagcacaacgccgttaaatcctggaaaattcgctcccatggggagtcgaacccaggacatcaggtgctactgaggctcttgtaaccactaggctacaggccctttcgcggccctcaagattcttgatgattacatatgatacatagtacagaccagctggccggagcttcctagctttttgcccggaacctcctgtcagcctctttgtcttgccagaggtccggaacttccggtccaaatgatcggaacttccggaccgggacctctgtcctgccaggaagttctggacattttgtccggaagctccgagtctctgaccaacaaagggtagagtcacctcacttgcttgtgaagcctttccttctcttacaaacatcaagaaaatcttcccattcaccacaacacgtttggacacaggactttcatcagaaaaaccaagctcatgtccatctttgtttggatttgtagcgatggtcttgtagagagcgtctttggagtggtatgtcgaggtccggaactttcggtccaaatggtcggaacttccgaactgggacctctgtcctgccccacctgtcagcgaatagaagcgcgcgcgagcgggcggtggctcggctgcgggccgacttgggccggggaggagagagagagggttttgggccgactttcggcccaaagccaaaaggaggatttttaaaacttttttcaatttcaattattcatgaaatgcaattccaattattaaaaacacttccttggctcaagtaaatcgaagaaaaatctaggaactatagaatcaagtaaagtatttaataaaattttatattggaatttattatttaaaattagatcttct

SEQ ID NO: 68777 - DNA, 4712 bp, Oryza sativa
aacagggattagcattcttggtgaggtcatccacgtttcgacacgggtgataaccagaggagacgtcgtgttgtgattgtggggctcaagagtgttgacggtcattatcgaccaattttgaccgtcaatattaccaaaatagagaactagtgatgcttgcaatgcatatatatatattagaataataatattccactagtattaggtttactaaccttttttgcagagaatgacaataaagtggaggagaatcgacatcaacatagacgataaattaatcggacaatgtcgagaattagacttatgtatgaatgggccaagaactcagaattgacacgatgaattgggccaaaattcacaagtctgcgaagagaagcaacagagaaggccgccagccgaaccctccttagcacagttggatccaggtttcggctggacggcgtggatcactccccgatgacggttggagggcaattttgaccattccaactgccacaaccgtcattggcagcctatttaaggagttcctctcctcacttcactcacacacctcaagcaagctttctcatactctcaaagtttagtttagtagtatctagctggtggaataggaatagagtagaaatcaggagtccagaagtcttcggaaaagttcgggtatggctctagtagcttttctcttatcttttgtaagctttgtacttttattagaatactcttctatatacatttatggtattgaaatactttccaagtatatgaatgcctactttacattatgttcatgttatactgaatatacggctagcttatctgggacatgctttggtgcgggtataatgtttgcttctgcaattactctatgtcttgacaatgatatcagagtggtatctggtagtttagacgtggtgtctagattacgggatatcattatttggtgttatatgctgcggatgagaggtgggccgctgatggtaacagctcagtatgggtattcctccgcgcctgtatataattctaagttaattccctagggagggtattcctccgtatttagccccggttgtatggccatgacgggctgtcgtaaggaactcggcagtcaggggtgacttctcgaagtaccaggagggcatcggatagagggtattagctagtatatcggttaactagaatgtatgtatactatgtatattagaagtaaaggaatagattatctttctcttttctttcttttctttccacttagcttagataatatagtatgagaatgagtagctaatgcttgtgtgtcactctacccttggattatcttaacccctgcttagaatatgattatcacaagtaatatataaattattagtcatgttctctctatatgatcttcccacgggataaaataaatacgatacccttggaatactctcgggtgaaatgctacaatggtatatttgtgcgcttgcagatgaactctataaccataatataccaggagtatttttgcgccattgctgggaattatatttctagtaatgtcattaagaaataccaacaaagagcgtattcgttcagaagtcggatcgatttgtttatcataaccttttgaaagatcgggaaccctagtccacatcagaagatcctgaatcgttttggctacattgatagtaagccttctccaacaccttatgatcctagcttgttgcttcgcaagaacaagagaattgctaggaatcaattggaatactcccaaatcatcggctcacttatttacctagctagtgcaactaggcctgacatctcctttgctgtgagcaagttgattcggtttacctctaatccgagagatgatcactggcgtgcgcttgagcgagtgatgcgctatctgaaaggtactatggaattggggttcactatactgtgtatcctgcggtactggagggacatagtgattctaattggatctctgatgtagatgagatcaaagccattagtggatatgttttcacactaggtggttgtgctttttcatggaattcttgcaaacagaccatttagacgaggtcaaccatgaaagcagagctgatggcactagatacaactattgttgaggtagaatggtggtgtgatcttttgatggatctgcctggggttgaaaaaccggtgccggttattcgtataaactgtgacaatcaaaaggtaaagccgttgcccacgctggcttgtggttggcacggttaatgtttcacaaccgaagctcgcgaaccggtctttaattgtcatgagcacgaccatcaaaaccatgtgctcataatccaccattatcaagtagttggcaattaattaattaaccaatcatgattgaccattgtgagctaccattaaatatccatcattaagtaatagtgaaacattagttatcccaatcatgtgctaatatttctaagcatggctaagcaattatatctaatatctagctaaactaatatataagtccaactagacaaattataacccaaggtatcaaagaatagagtaattaatgcaaagtggccataacaaaggaataggttcacaccagccggtgacattcgaaaataaatgcgcatttgaaataaatagaaaatttaaatataagatcagcatgctgaaaggattgtgtttgggatatgtgtgacttgccttgcaataatcggtcatcaattaatcttctagaacacttccaacacactcgcaaaccttcgcaatgacggaaacaacaagctaacaggcaaaacgaggaaaaagactaagaaactccaaataaacagtacatataaagtaaacaaacatgtagacggaaacgacaagttaacatgaaaaacgagtaaaaagactaagaaactccaaataaatagtacatataaagtaaacaaacatttagagcatgaatttagatgaatttagagactcgaacgacctcattccgacttcatatgaattaattacgaattttacaagatttaattaatttaaacctattaaggaaaatactattccaaattaattaaataatttacaaataatttataactgacataaaagattaagaacatcttcagaaaagattagataaaatttggtagatgacatatagtaaaaaggaacaatatgtcattgaaaagacggaaagagatttaggctaagtttagatccaggggtgtaagttttggtgtgtcacatcggatatacagacacacatttgaagtattaaatgtagactaataataaaacaaattacataatccgtctataaattacgagacgaatttattaagcctaattaatccgtcattagtaaatgattactgtagcaccacactatcagatcatggagcaattaggcttaaaagattcgactcacaattcacgcccaatctgtgtaattagtttttttttatatttagggactgtctatggggcaaacagctgaaaatttgttgttttcagtcattttttttagccgtatgatgaaaacacgtgtctcccatcctgctccgctactcgcgcactacgtgaactaccgtgcgcgcaagtcgatttggggtgtgtttagttgaggaaatgaaaatttttgggtgtcacatcggatgtttgaccggatatcggaaggggttttcggacacgaatgaaaaaactaattttataactcgcctgtaaaccgcgagatgaatcttttaagcctaattaacccgtcattagcacatgtgggttactgtagcacttatagctaatcatggagtaattagactcaaaagattcgtctcgcgatttcctccctaactatgtaatttgttttttcatttatctacatctaatgcttcatgcatatgtccaaagattcgatgtgatgtttttgggaaaaatttttgggaactaaacggggcctcgtttggtcggattgctgattttttttggcaacaaaaaaaaagcccatggctcatgagtgggagaaaaaaagcccaagagaaaaaggcccacagcaggcgggaagaagaaaattttctggaaaagtacaccgaaggtccctcaacttgtcatcaagttacaaaatcatcccccaactgcaaagagtaaatcccttgtgtacacatgaaaactcacctaatcccttctataccctcgaattttacacgatcctctctgtacccctgaaattttgctttgatcccttccatgcccctcccgttaggtttccttcattttcacgttatgtgtggttccaaatgtctaaaacacccttgtagatggaagagtgccagctagagtggcatcaggagggagatggccggcaaagcccgcgcggcaagaggagcggcgaccggcggcccgcacggtgggaggggcggtggccggtggcccgtgcggcgggggcgcggtggccggcgacacccacgcggcgggaggggcggtggcggcgtgacggcggctggacgacggcgcgcgcggccggaaagcgggacgacggcgcgcgcggcgggagggcggtggccggcgacgcccacgcggcgggagggcggctggacgacggcgtcccgcgcggcgtgacggcggctggaaggcggtgcgcgcggccggaagggcggtggccggcggcccgggcggttggaggacggtggccggcccgcccacggcgcggcgtgacggcggctggacgacggtgataagctactgta

SEQ ID NO: 68778 - DNA, 745 bp, Oryza sativa
aatccaatagcttctagttgtttaaggaagtactccattctacggaatggatcagtagcgcaaaccccagcaagaaccggaactcctttaaccacctaaataaacagtatgtcattaacatctactaatagtaaaaaaatcaattgacaggcacagtgccgaaggtatctgatgacttacaggcaacacttcattggccatctcaagtacaatagcgtttgcatctgcaaatggcaatagtcctgccaatgaacccctcccagccatgcgaaaccgcccggagttgtacagaactataagatcaactccaccagcttcttcaaacttggctgatatgccagtgccagcaccagctccaatgacaggagtaccctcaacaatttgttgctttagtttatgtaatactgactttgtcttttgcaaagtttctgtaagaatataagagcaaaccatcattgcatgtcattgtagcaagaaataccaggagtaaaatataatgaatgaagcatgccttggaacatgcagccaattttgagataataattttaaaacattaatgattgaattattccgctcatgcataaactgataatattttctgctatggttggcctcagccaatttcattgcaaggcaagccacttattagattatttatgtatttaaaggacttggcaatttatttggaacacaaaacattaaaaactcctcccttagcttctaatcttctgatttcactacagat

SEQ ID NO: 68779 - DNA, 5643 bp, Oryza sativa
gcgccggagcgcggagtgtggaggagcgccggcgcgcgaagtgaggaggcttctggcactatcacggcggctgctccgtcctagccctctcaccgccgccggcctcgcctgccgccgtcgtcgttgacacatgagatgagagataggagagctgatatgtgggcccaaggacatttttgatattcacacgatttctctctcctcttcaaccggaaattattattttaatgggtgcggtgtccaccagcaaatatcctttttcccccaaaagtcatttcgtgtcgtacgctacagctaaaaccgtgaagtcacggtgtcctgtagcaaaattttcctagtagtattatgtatggatgtttggttgtatttaatacctcctccgtttctcctccgtttcatattataagttgtttgacttttctcctagtcaaacttggttaaatttgatttaagtttatagaaaaatttagcaacatctaaaatattaaattagttttattaaatctcacattgaatatatttttgataatatgtttgttttgtgttgaaaatactaatatatttttctataaacttagtcaaaagtttgactaggaaaaattcaaacgacttataatataaaacagagggagtatttttattttcatttttttccttttagattaagatgccaatgtgtaagatagtagaaattaagatagtgtttgaccattgcatacgcacacgtatgaatgcataatgtacgtatacgagtactctagctaataaatttggccttcactattgcttactctagctcatatatttgaccttcagtattgctttgctcacgagtgttccacctacgacctaacgaccttgaacaaagtgtgaacgcctatatatgatgattaatctttgggatattatgcatcagctactttcagcagcttattctttacttcagactattatttactcccaataacgttttaaggaatatattttcaaaacaaatattctattgacttaagctatttgttaggtttgttttcatttacagttacagacaagtagatattttttgatgtttaataatcctgctgaataatctaaattaattaacaatacatatgttgtttggaacgaaatcgaggagaggacaggacactacccaacagcagatccacctcccaaacagatcaggcggtcacctggactccgtcattgccatcacttttataccgaatagctacctataaaaaaaataatcgattattaattcctccgtcccaaaataagtgtagttttgcactattcactttcaacgtttgaccgttcgtcttatttgaaatttttttatgattagtatttttattgctattagacgataaaacatgaatagtactttatgtgtgactaaatattttcaattttttcacaaaatttttaaataagacggacggtcaaacgttaggcacgaatatccacggctgcacttattttaggacggatatagtattagtcgtccagatttaatggtgatgttggctctgtcacttacacttacctagtacaccctgtgtgtgtgagagagagagagagggggggggggggggcgtgcaactgcaacggcatgcgtgtgcatggctctgcgccgcgttggatcgaatcggatcctaagctagctaggcagaagcttcctgatcttgacggatcaattagcctaggtaaaagcaaggataataataaagtcagctgcttacttatagcctatctatcagctcactcatataatggttaattctttactataaatatatgatctatatgtctgtctcatagatttttttagtttctgtgcctaagccggctgtaaacttacagcccgcttctcatctctctcctcttttctatacttgctctaagtcaggccgcccacgccttcttcactgcatgccgatcgatgccgtccatcatatccatccatcgggcttaattttggtcgaaggtgcagattaaggctgtgttaatctgtgtttagatccaaaagttgaatccaaacttatgtttaaattcaaaagttaaatctaaacttagtacttttctatcgtatcaatctgtcatacacaaataatttttcagtcacatcattctcaatttcaaccaaaatttaaactttacgctgaagtaaacacaacctaattatccactcgccgaccctagctagctactcactcgcgcgaggtgtactacgtacgtacagcctacatggagtagccagctagtaactcataaatacatactgtacgtgcataatcatacatactccctccgtcccaaaaaagacaaacactggtttccgtgtctaacatttgactgtccgtcttatttgaaaaaaatataaaaaaaataaaaagataaatcacgcataaagtattaattatgttttatcatctaacaacaatgaaaatattaattataaaaaaatttcatataagacggacagtcaaatgttggcacggaaacacagggtttgcttttttttttacggagggagtacttgtatatggccgagtttggatctaaagtttttcttcaaactttcaacttttccatcacattaaaacttccctacacacataaaattttaactttttcatcatatcgttttaattttaaccaaacttctaattttggcgtgaactaaccacacccgtagctatatgtgtatgttagcatgtatacaaatataaaatcgaatgttgtgttctaggctttctagccagcttactagcagctagatatgtaggagtatacgtcatcctatacatacgtactccggtatatatatatatatatatatatatatatttatagtaaaaaggatatagaaaaaattgttcaaagattagaggatatccaaattataggagaaattcctatgaaatattgggagaaaaatgctatcgagtgtaaaattaatataataaacccagaatatattattaagaccagcccaatagaagcaactccgaaagatatagaagaatttaagatgcatatagaagaactgctgaaactaggagcaataagagagagtagaagtccacataggtctgcagcatttatttgggcgtggaagaagaaaaaaacgaagatttcagaagactactcaaggaggaatccagaagaaggaatccagaaggacaccctataagcataaaggaacaatatagggtgcggtgaatgacatatcactgtgaagagtaaaactttcggtggaaaggcctcgactttagccagctcccgtgaagatacagtagcgaagagataagcaggaggcacaggcgacgccatccctggcctctataaaaggagacgttggccttcactccggagacacacaacaacaacaacgaagacaccattcagagcaaagcttccaagcgcgctctcaccctccattccaccgttcttagtagtagtgactttagcctaccttgcatagtatattgaagcaaggagttgtgtaataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaattggtatccgaagagaagtgttccctttgggtggaactgcctggggagacgataaactcttagctagaacaagtgtgacttggaatatcttgttaagttgcttctaaaaagatagataggtgaggcatacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtatattgtctgaagcataggtttgtctgaagcataggtgtggtgtatattgtctgaagcataagtgtggtatcagagcctggtaatcatagagaagctaaatttagaagctaatattggaaagttaataaataccaaagataatatcgacataaggtgtagactaagccatactgaagaacatagttggcactctaataatagccaactaaatttaattgtagatttaatatataatttctatataaattggagtaagagacaagaagatttagagcaaaagttagaagatatatataaagaacaaaagcaatttgtagaacaatattcttttcttaataataagctaaatactacattagaattattagaagattataagataaggcaaaataaaatttcacagaatagtgattatattaaagaattactagacaaaatcaactctagtaaaggtaaggaaatagttttggcttcatctggcatagtctcatcttcacaagccattaattctgaaaaatggacatatctaggagtctctttagaagaatagcaagcagagatgataactgttctgataaacaaaaaggcaaatatgatgacatagatgagctgaaagatgttgcacaagtagataagcagctcgaaagatatcaacgagatactttaagggcaataaggcctcaacaagtatactgcatgggattttttgagaataagaatgggctttatagaatatctagagaagtagaattaagtgttctaacaaagccagtagaattaaaaatagtagctaaagaatttgaaaatagtttaaaatattcaggatataagtatattcaccaaggtatgtacataataggaatcaaaggaatgacaagaaagaaattaggagctaaagtgctaataaccttattagataaaagatgggacacaataaacaaagcatctttaggctatctagaaggagatatgaatgaaaatatgttgataacctatatagcgcctgatttaatgatgcctgtaaatgaattcatagataaaatgagttttggtttccaaacaaaaggatacgaagagtttaagggaacaaatttattaataagtatagaatttataggaagattgactaatagaagtgcctccaaatacaaaatcaatgtaaatgatgtgatagaaaaaatgcattctaaaggaataaaattcatgagccctttaataatagactctgaagaaagagcaggagaaaaatggccaattagtgaatttataaaaaataaaaccttgagtcagcctgaaaacttcataagttaccaagacagcaaagggaatgttagtattagatttacaaattataaaaccagagcttcggatgatttggatgcagaatcatctgacagagatattatagataacagaagacatagtatatctgaattgatggaaaaattagaccatgaaagtgaaataaaatattatgaagataaattaagagatatagcagatgaatataataactctatgaaaagtgagtggcctaaaattagagacaaggaa

SEQ ID NO: 68780 - DNA, 29739 bp, Oryza sativa
aggtactaaagatcatatctcttcaaactggttaggaagcttacttaatgaagacacaattggattgattttagtggccaaaccaagccaacatacagactgtgcgcatatggctactcgcattcctggtactgtagcagctagcggggtgtactacaatgatcaatacagaatgccatgtaagctgaaaggaattcattgcatggcattgaattgtataccgcaaaaagcgaaggtaaggaagtgcatgaatggatatcaatcaacattcaggttttgtgtaaatgagaaaaatggacaaaccaccgggcagtcaaatggttccttgatccaacaaggccagaatttccggtgtcattcttatggttctcataacagcagtgaaactaaagagtgcagccttgaagatggcactgattcatacaggtaatatttgtactacattacaggataatgagcctactttttccccagatgaccaatgtttattgaatttgtgtatctggacatgcaaattcattatcatcctaattcctatctttctactgtctttaaatgacacgtcctatgtacaaagctgaacacagtcatttttaagatggacataacccatccaacattttttattttgtttttatggttgacataacctgtttgtctttttaaatttctaaatctattgttgcagggattttgaagaacattcaagaggagcctcccaattttcagataatcaagttgcagcaaagaaaaaatcagtcaaatctagtcaagggttggctgaagcttgcaaatttgtttacaacgatgcaaaatttgtgaatgaaagagctcaaaatgatattctcttgctttcacggtattcctttcataataatctttaaaaaatatatcccttggtaaaaacaagagatttgtacataacaaaattatgtgtctcatttctaatcctagtggcataacaaggctgaacaaacgtgcgtgccaggatgttgctgttttagggtcaggatttctcaagcttgatggtacatgatttcccttttagctgacaagctcttagtttctttggtatgatttaactatccatctaaagctattatttactgaaagctcgtgcaaggaaggacactaaaaaaattgaccacagtgtgaaggaaagggcagcgcggcttacccattttgcgagagtatgatttttcaatatgtttagataattgaaccatccatgtgctttactttttgttcctttctacctctatgtactttagcctgttacctctgtatgcatattcagatattaaaggaacaggctcagtcagacttgaagaaagcagcagatcagcattggagcgatggtgctttggaggtctgtgctagttctctgtccttcacttcattttgctggaactagttgaaaatactgagcgatatatagctgccaaatgtttctggagtaccgatgttgttttattaccggtgttaaccttctttgtgtgtgttactatcaaattcatgggattatgcttatataatacactatttatttgcaatgcaggcagatctgcgacgagctgactcggttgttagacgacgtgccatggaagatgctttcatggctttaaaggtagcccaacttgttcttttccatctctactgtctttaaatgcagcaagttggtttagttttcattacaatttacaagctaagatatgcaagattttaggatgaaaacataatcagttattttgatttatgaaagcaagatttataactcaaactcgtaacaattcttgattatttatttgcttaacatcatgccccatacatcatatttccaacaaattttgtttgttttatgagcctgctgtcatgaccggtttgctgttatgcattacattaatagctaaggtttagtttgattggcttagcagaaaataaataatcatatatctagacatgaataactagcctcagacttaatcatactctatctacaccttgccatatcgacatttttttggtatttgttgctgcacaaaaggaaaagtttatggatcacatactagatgttttgatcaatttgacccttcccaattcttggtatttctcatacagcatcttgattattaaatattacacttgtatgtaattctgtaatatttagtgcagtttgttcgggatatccatgacatgatggcaaacagattacaagagcagtaagttcatttcaaatgctcatttcttagagaaattcaatgtttaattaaggagggtatgattttacttcgctggttcatattcattgttagaacaatctgatttgtactaaaataaatatactttagattcgcaaaggatggttcctcttctcctgctaattcaagaagtttcatcacccttgagaaaaatggaaataccttcgagctgtttcctcatgaagtttcaacggaccagattaccgccatagaggttatatctagattaacttatttagcagaaaactcccatcatatggctaattttggttaaatttgttatccatagcaagcatactggagtatggcatctgcgttgtctgaggctgatggtatcgactacacagatcctgaggaggtgaaacattttttacccacattataaagatgaaccttcctatgtccatctttctaaccttctcttttctgtttctgaagcttgagttgttagtagcaactctcattgacctggacgccatggatgggaaaaagagtgtttccttacttgctgaatgttcaagctctccagatgttaataccaggtatatcacagcattattgagtacagttacctgcaatgtatgttgcttctgcgttgttagcaagatcgaatccatcttcaagtacagaaaatgagaatatacagaaaatgagagaatgttaatataaagaatgcagatttgatatgtcctgtctctatacatcatggctatgtgccaaaatagctaattagcgacaaaaaataatttatggataaaactattatgtatatgtccttagtgacttaaaagccaattcaaaaaaggaactatgttgaaaataccgtagaattaactcaaaaattaagtcttaaataaattttggcggtggctgattcgttgtagggcaaacgatgaggctctatgttatatttctgaattacatcgcattcgtattgaccattattatgtatgtataccccttgtaggaaagctttagctaatgcactggctgcagctccatccatgtggattcttggaaatgctgggatgggtgcattacaggtgaacataaatctctcctatagctcctcctattgacaatttctgattaccttcatatcagaattttttgtatgagaaatttctaagcctctcagagccaggaatcatgcttgccccacagttcaaatttgatcttcatattcatttgtaaccatgatttccaagctgtacaaactgaagctcatttctcccttgtgatcaattatctaaaaaaggttaaaatccatagtacaacgcagcctgtttctgcataataatcagttattgttgaatgaacttgctagttgctacttgctacatgaactagtttctttgaagttacttgggtaactattgatgtttcatcaatctttgcttgctctttcaattgcagagattggctcaagattccaattatgctgtagccagggctgcaacaagagccatcaatgaactcacaaagcaatgggagcttgaagaaggtgacagcctgaggtttgtactgaatcaaaatatggtttctaaagagacagccgatgacagtgcagcagcagatgacaccaggtgatcatgtgcaaataagaaggaaaaaattacactaggattaacagaaacttatacaaacatcacgtttcagagcatatatatggataaggtgaatgtctatctctgtcacagtttcagagcataatgtgctgcttggtatcaaaccagatcaccagaatcatcagaatgacagaatgcatgtaactgacacatcttttcagtgccaaactgccaaagaaattaggaactggtgtaaagataaatgtattccttcagtaagacatagtcaatagtgttagaataattgggctaggcccaacttatcctattaaatctcaaaggcccataataagtgttaaggataataataccacatcaggatttaagcgaggaatatcttaacctaaatagggagttattggaggccccctgttgactggttgaggtggggttcggaatgccacgcgcgcgcgcgcgccgggccgaggccgtgggcgtgggcgaggctggctggcggcgtgcgtgcgtcacgtcgctattcttttgcagccactaaccacgttccaacaactgcctctctctcctgatagataaggaggccgcgagtccgatctgtaacggacgcttgcttctttcccggtgttagttcctcctccgcaccagtgctgttctcgcttcctcgcttctgatctcttgcgcgcacgagagattggaaggagcagtgcctccaaaaccacatcttcgcctgagatctgcaccgggtaggcgggtgatcaggtttttgggtagtgcctctcgcacgattgctcgccatgtctggagatgccgccgccgctactggaggagatggcagaggtggtgcgccaggagctggagccggtgccgcgaacgacaacatcaacggaggcaattctgcctcataatccaacggagggccattctcgaggtatatccttctcctgttccctttgttagcgctatcgctttactgttatgtgcgctgtgttcctgttcctgacattcatgatgcctctagcatgttattgcgttactgtaatgtttctgttcctgacattcatgatgcgcatagtatgctactggttatgttaagatcactctacactgtttatgccatggttattgctttaacattttggattaaaatatgccgattcatgactatatttccaacaaatagatgaagcaaaagagcatggttgaagaaattatgttcctcagatgttttttgctattcgattgggaaatggataatagtgccacctcctgagtatttctttgagaaaaaaagtctattttacaaccctaaaaactttcactcgcaccgagttgttaaatcctgaactttagccaagtggcatactccccttttttttacatggcatactaaaatttgatacaaatatgcaaaattattagtcgtgcttaaagcacctaatgataaaacaagtcatgtcgaaataaatgatactccctccgtttcaagttataagacgttttgattttggtcaaagtcaaactattttaagtttgactaattttatggaaaaaaattgtaatatttttaatccaagactaatatattatgaaagtttattcaattatatatttaatgaaactatgctgatgttgtaaatattactatatttttctatagagttagtcaaatttagagtaacctaaaacggagcgagtatttacatagttcttttaataaaataaatgaccaaatgtgaggtttaaaagtcaacaactttatatttttcaaaaccgagctagtaagtagcccaacaatgtcacacaatccgtgtacagtacaatggcacttgtttagaaggtaatccaacaatcggaaacgatttagtaccatgaggtactggtaccttgaggtacttcttgttggaccggagcaaatctcgttgcataaaccaccctaattgtcactctagttttgatattctaccctataacctatttcgttgcaaaagcccacccaccgtacacacgtgagtagcttatttgctccatttcttctgacatggattcgcagtgaactgtataagccatgttgtgttcatctaatatggctatgaggtgagtttgacttgagctcgttcttaggtcctgtttgggagagcttaagattctgagaatctactggttgatagacagcttatgagaatatggagaagctactaaacatagcttctgaattttagtttattttttaagtagaataatagattctcaaaatctatgtgacaatctcgattgtttggggagagtttttgattctgggagaaactgcacctactagaaactccccaaaacagatccttatactagttcgaagtggcaagaagggtggaatgacaatcaatggcgttgatcggcagcgaatccatattgaaagaaatgggccaaatcaactaataatgtgtatggagggagtaattttggcctttggttgcctgagcttttgcaacaaaatgggttacggagtagaatgtttaaaacgagagtgacaacggaggaggtggtttatacgatttggtcagtttaaaaaggacccaagacatgttttgcacgaggacaaaaacatccatataactaacttatcatcgaagagattagtacaaggtaatactataccatttctagtttgaaatcggcagagatggttaagctagctttcgtgagcaggagtgtacatcaccattcaccacaccaagccgtttcactgaagcttccgccttctcgccgataaattaaacggaagcagagctgctgctgcaagaaggctttcagctcacacgggagagaagagagatgggagtgagggtgaccgggccggcgggatcgccgctcgtggcggcggtgctggcgagcctggaggaggccgccgccggcggcgggtacgagctcgtcggcacggcggcggcgcgcgaacagagtacccggccgcaccttgcccggaacgtaagccgcccaccctttctgagaatttcttttaaaaacctttttaattttaaaaataaatctacaaaacttatttttaacatatgaacaattttgccacgctaacttgcatggcaaaaatatattgtcacgctaatctaactgacgtagctgttatttactcataccatcctcgctgatatgataggataaaaccgtcacacctattgcaggtgatgtgtcaatgtttttttttcctaatgctagatgtggtcaaagagttaagattttggaaataagttttgaaatgattcattcttaaaattaaaaattttaaaagtattttgaaaaaaatccctttctaacgcagatttgcatctcttaatgtgtttgaaacttttttaatcactcgagtggacatctagtcgtgtagtatcatagatttgcatacgttgttctgttcttgcagccgtttggtaagatcgccgcctttgctgaggacggcgagctcgcgctcgtcgacgccgtcggtggccatgttgatggtagccgctctcatgcccgcgtgacgtcttgagccatcggcttggagaaggccccactgtacaggctacgtactgacagttgggccccaccgtgctgttatactacttaggagttgattattatggtgggggccatgtgtcagtctcgatttgatagcaatgtgtcatgcggtgaagatagaaatgtttgtgtgcgagcgccagtaattaagaacaacacagaggaggtaggggggcaaaggagttcttttgtgtcgattcctattgcatcaagataagactatttctttactattgattttacaaagaaaattactatccatacgactagtgtgtacgacttgcgtatgactagtacttagctactgcttgccgtgacttacatggaaaaaaactgacttgtatgaagtgaattgattggctgatgaggcagggtcgaataggggtcggatgtatagcggtactcctttacaaataaagttcatcgtaaaacatctcgagaaggtacgtatatgtgatcactaatgttgttgatgggatgtttttcgtaccgtgcttaaaatctgatgtacaagttgtttttggcttgttgcatcacttgtgcattactcctctaaaagaacttgtctaatgtggcgtcaagaactaacaattaagttacagttgagtcaatcaggaatatgaggccgcgccatctgtaaggtctccttctatgtccacgtcagtgtaatttgtttctatcgttcgatatatcatatacggttcggatgcattttgccagattatgcatgcactagaatgcacaggtactagtgcttgacaatgacctatcatattacaagtgtacataatgcaaaatgtatgaggctataatcctgcactgatttttatctgagggtgcatgcatggataagaatggatgctattggccatccatgtaacaagtttgcagggtgcacgaatgcacgatggcctcactccctcgtgtgttattgtgttaggtctgctattttcttttttaaaaaaatatagtccaaaagagagacgaggtggggaagacttgattatattgttctcttttttttttcagaacacgcaatacgattacgcatcttttcaccgaaagacggggaaaagaaaagaaaaactcaaatcacccatacaaactgattgattgaaataggatcacatcaaggtggaagggaaaaaaattaaaacaacatatatctattatatgaactctagatgacaacaacattaacagtcagatttaggataagtgtgtacattaacatctactccctccgtcctaaaaaaaaagaagacaaaccctggtttccgtgtctaacgtttgaccatccgtcttatttgaaaaaaatatgaaaaaaattaaaaagacaagtcacgcataaaatattaatcatgttttatcatttaacaacaatgaaaatacgaattataaaaaaattttatataagacggacagtcaaagttggacacggaaacctggggtttgtctttttttttttggacggagggagtatctgtattgtaatgtgtttttttttaaaaaaagaaaaagcttgcatgcatgatttctatgctagtttaaaaagagcagtgatggtgatgaggggttaatctgtcatcaccaactacttactcttttgtaataaagaaataatatgtggggtcaaaaggttcacatgttaaccaccccatcgtctctaattttactgggaaagacaaatgatattataacgtcatatggatcatatattaattacaaatatatatagaatttaagagatgatatatacagaaaataatgataatagcaagttaatcattatttttcgtcaattaaaattctgttgccacaaaatgtttcatccgattctaatttcttatattttttactcagcagcagtagtaataccattatcatcaagcctatggtcacatcattcacgccaagtgtccaagcacctactccgaagcttcttgctgattaaattagacggaaatggagctgctaactgatgcctaaattataaatgtcagcatgtgtagaacgaggaagaactcacatcaagctttctcaagagagatagagacagagacagagtttagagagagacatcggagatggtcgcgaaggtgtacggagtggcggcgtcgccgtacgtggcgacggtgctggtgtgcctggaggaggccggcgccagctacgagctcgtcgccgtcgacatggccgccggcgagaacaggtcccgccaccacctcgcccggagcgtacgcccctctttgccctctccaactctaagattcgcttcactttcatacatgatgcatctcgatctcttcttgcacaaaatcaattaattgctcgctagaaaccttttcatctctgaattaattaaccaatcaatcaaatcaaattcggctatatcgttcaaaaaaaaatcaaattcggctatatttcgttcaaatttgcacgtgtttctcgcagccctttggcaagatccctgcctttgaggacggagaagtcactctctttggtatgaggaacaccacacctcacccgaattactgtgatatgctccatctcaattacttatatattggaaatgaataatgagtattcactttttttgaaaggaatattcacatattattattattattattattattattattattattattattattattattattattattattattattattattattaccagagtcgcgtgcaattcaacgctacgtgcttcgcaattacaacaaaccggatctcttaagagaaggcaaccttgaggagtcggcaatggtggacatgtggatggaggtggaggcgcaccactacgaccctgccatcttccacattatccgggagtgcgtcatcaagccgatgatcggcggcggcgcccgtgaccaggccatcgtcgacgagaacgtcgagaagctgaggaaggtgctggaggtgtacgagcggaggttgtcggagtcggagtacctcgccggagatttcgtcagcgtcgccgacctgaaccacttcccctacacctactacctcatgaccaccgagtacgccacgctggtggagtcgtgcacgaacgtcaaagctgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaatttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgcaggtgcacgccggcgagcgggatggagtagtctacgagcgacggcgcagtacagagtaggaggcaaaccctagattgattttcgcatgtattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgctgccctgccctgccctgccaggccaggccaggccaggccaggcgaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagtggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttggtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtccctttgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaattctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcttcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcttcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccaaggtgacgaaaagaccggctgcttggtcgaaatttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgcaggtgcacgccggcgagcgggatggagtagtctacgagcgacggcgcagtacagagtaggaggcaaaccctagactgcatctgcgcaagggtgaggagccaatttttcggaccattcgacgcgtacgtcgtgcacgcgcgccgcctgccctgccctgccctgccctgccaggccaggccaggcgaggcgaggcgagcgagcgcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaaagcatggtgggagcggctgctcgcgaggccggcggtgaggaaggtggccgctctttccccccctgtgacatcaacctgaagaagctccacctcttggcgttaatgacaatgacagttgggccccattgtattgttaacttaggttatggttgggacccacttgtcagtgtcagttcgctagcatatagaattactatatgaagtactatgcattattgtgcgtctatcaatagaagaataaaacagaggagataccactatacagtgtacacggcattggcaatgtgtcaatgtacatgacacctattatttttttatcacaaagcagtataactaccattgttcatgtcattattgaaattcgttgtgaacaggctaggatcatatgtcctaattactggatgttgtggaggaaactagaaacagaggcagtgcgaggtacaagcacaaagtagaacaactgtttgctgagccgcacacttgtttggaccctaccactttcatgcaaaattcatgcatatatataaatatatttacacctgatgcattttagcttaattaaattcatttccaaagaagtagtagcaaatcaagcgaaacaaaagcaataaagatgaaggcttcctcgttggccgccgtcgccgccgcggtgctcgtcgccgcggcgtgctccgggcgcgcgccggtggcggaggcgacgatcgagagcacgtgcggggcggcggcgaagggcgaccggcgcgtggacgtcggcttctgcgcgcggcagttcgcgtcgtaccacggcgcggcggaggcggacgcgtgggggctcgccaagatcgcggcgctcatcggcgtcaacctcgccgacgacgccgtgttcgacatcggcgccggcaagatccgcccctcccccggcggcggcgccaagggggacaaggccatggacgcgtgcgccaaggcgtacgacgccgtcggggtcgccttcgcggaggctgccgacgagctgggctcgcgccggtacgccgcggcgaggcaggagctggcgcgcgtggcggcgctcgtgcagcggtgcgacggcggcctctcccgggccggcgccaggtcgccgctgcccaggtacagcgccgactgccagcaggtggccatcatgggcatcgccattactaacctcctcaagtgacacgtcgccgcgtcgaacacctttggtggtgtggcttggttcttggctgcttacctacaaagtgaataaattttgtatctgtagtttataaaatccaataaattaagacaattcattgggtgtttgtttggtttaggaggttgattttcattgtgttagattatatttggtcgagtgatataaatattttgggactatctatatttatggcgccatatttttcaacaaaaaatagtcggcatgtatttatgttgtagcttcctaaattacatatgtaattttagtgtatttacaatgtaaatcccaaaaatacatatataagtcctaaaattacatatgtaaatcccaaatttacatattaattacatatataagtgatgtgtaagtgaggtgtaactactgtgtaaattcgtataaatatataaataattattaattttataacggaggtgaagtgctaatgagcttagagcttgattaggtgcagctggttctttcacaaaaggtgtaagatgggtgcatgtgcttgaaacgaatcttatcggaggatctcacggttaaaacatccgactgtaaattatcctaaaatatgtcgacacaaatttagcaatatcgaatatttttgtgtaatgtgaccaaagttctagatcaatgggttgagaaacaacatcgagaaacgtgggatgctatttctgaatggttttaaattttaacaaggaaaagatgagattgtacctatgttattaggatgggaacaatggttcagaacgagggatgcggcatgattccacgttcttggtgacttagattttgtaatgttggatttgaaaattcatgttatttgcccacttccttttaccaaattttggccaagaccatagataccatgttactgccaaataacaaaccttttgtgtattcaaaatttaaaaacctgtttcaaaaaaaaatcgcataactgtcagtgggaagttccatgcgttgtaatccaaatgaacaactcatatttcgttttcaccatgtaactgaattctagtccaatatgagtttggtccaacaaattgtaggatcaagctgatggcaaatgaacaagggggaattcagatcaaccctcgataaattaaatcaataaatacgaataaaagttactcaggtttatgtcaaaccgtatggttcaacatatggataaagttaagcgataaattcaaggcgagatcatagcatttcatatccttatcggactaaaacaaacaaacaaattgataatagtagtcattttgacatagatctttgttccaaattcatatgtgcaaattagaaagggataaaaacttccatgatatattcatgtcactgccaaacagtgcaatgcccattgtgacacctgattattattaattacatcaagagtcgtgcagcacgtacggatggatcagcagctcatgccggcgtccaagggcgtgtccatctcgccgtcggcgagcatgtcggcgagcaccatccctgcgaccgcgccgccgacgacccccatgccgagccccgcccccatccccatccctcctccaccgccgtgactcgccgcgccatggccgtacggcgctgggccatagccgtacccgtaatggtggtggtggtgatggtggtgctgcgcgtgcgcgccgccgccgccgccgccgtagggcgagccgtggtggtacgccagcgttggcgactgcgccgcgccgcggcggccgccgctgtggcgcccggccgacgggtacgcggtgatcgcgctgagctggaggcccttcccgctgacatgccgcgtcgacgacgcgccgcgggcgccggcggcggacgccggctcggcggcttcgtcggtgatctggtacgatatgtggagcacgccgcacttccggccgctgacggggcggcgcacgtggtagctgaggtgcctgtgctcgccgccctcgggcgccgcggcgacgaggtccttgaccgggacgaacacctccccgacgtcgctgtcgccgaagacgcgctcggcgcggagcagcacgtgcagcgcgatggcgcgcatgtcggcgccggcgtcggggatggggaagcggagcggcgcgtgccacatggggctccggccgccctcccggtcggcgtgcgtccggtgcgtcggcacccgcgggtcgccgccggagatggacgccacggcgtacacgcgcatcttggagaacatcgtcaccttcttgaggttcttggccgagaccagcgtcacctccagcacccggcgcgccatcgccgccgcggcgaacagccggccggtcactgacggcgaccgatcaaatgaagccgcaaatgattttttctctcgcaagtgttcacgttcttggattaaggaaggacgatgcacgcagggtggttaattgcaaacaaggttaattaagatttgagggcttaatttgtgtttacgaggtgtaattaatttgtgcggcgagccgttcatgtcggtggcatatagtgtcatgggtatttttagtagtagaggtttggagagcacaaaggtcatttctctgttggtttcacctccattgctgtggcaatgtgactggatttgaattctacttgaggatatgtgttcaatctttttaaaacataggcagaatttttgcctcattttgtttgatagagaagagatacacaacaccaacaaagaaagggctccctctcaaacactaatctatttaaaactcaaaagcacctcaagcacaccacataaactacaatgatatatgatatatgttcatgtttcacttttaggtcatgtttggaacagaggaatggaaaacacataaataggaaaaaagaacataggaaaacaatggaattcaaaacacaggaagatacattttggactgtttggatcacatgaaaaaattgacagagaaacacagatgcaagcatgaagcaaaggaaattttcctttagatcaaagtagatgttttttatttcctatgaaaatggaggaattactacctttccaaaggaaaccaacaaccccattcatttgttccaactaacttcataggaaaaatttccaaagtattataaacgtaaaaaaaaatccttcaaaaatcgttcctaacatggacttagaggttgcgattatttagaatttttttcctattttgagcctaacgcacgctcccagtttaccccatgggccccctttatcggcaagtgaccgacaggtgggtccgtagacaattgggatgaaaatttcggttgtaatgctccacatgtcggctgacaggtgagcccgttacatccggttgatgagttgatctgtttggagggacaacgacaagatcaagcatatcaacccatatgggttgggccccactttcgtatacatacatgtgtactgttgacggagcgcggcgctcctcaccgggagaccgcacaggcccccctttgccggttcggccgggggctcagggtgagatctcaagctctctctgtagatgacggaaagatcgcgacctctcaagagaacatgaaacacaagcgatgtatacaggttcgggccgctgagaagcataataccctactcctgtgttttggtggatctgtgtatgaaggagctataaagtgtgagccgacctctccctcgttctaggctctgaatctggaaagaatcaacccctttctctatgggcaaggtcctccttttatacttcaaggggataccacatgcacccctccctttccaaactggacttttcttcttttcataaatggacggagatttgcatggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccacacgtcggctcagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtctagacaggatggggcgaagcatgcgtctgaccgcctgtcgccacctaacccgcgatttgaccggtctgtgactggtcacagaccggataatcgagtgcactgcactgcacttcgtgcggcgtgacacgcttagccgaggcgcaataaatgcggtaggtgagccctgctgtgctcacctaacccatacacgtggagtagaaaacgcgaggggtcggggcgcctcggccctcgggggcgaggctggagtggtccgacccccccctcggggagaccaagaggtgggcgcacacattaccctcgggcccgacgtcccccgagggtgccaggccacgtgggcgattgtgtctgcctcaagcctctagtcatgatactcccggtcccatgtcaccgacaactgtgaaagtgtgaactccccttaacgtacaaaatgaggaactatgtcacaaagaaggaggttcgactagctaaaataggctaagttagattcacatctcagactcaacaaaggagggttcatcatgtccctgcaagaaaaaggattcatcctctctcacttagatcatcccaacatcatctgccataaacttgatcatcatcacttagagtgagtttgaggagaagtggattaagaagattggaaagatacgtaaaacgaggtgagctattagcgcataattagttacgtattaactattttaaatttcaaaaatggactaatatgattttttaaagcaactttcctatagaattttttttacaaaaaacacatcgtttagtagtttgggaagcatgcgcgggaatacgatgtcctttctcaccctatgtcacctaaacaaacgctcccttagtgcaagaacgtaggagtagggcattatgatttcgagcaatctaaacctgtataaaccatctgtcttcattctctaatatcccctcgttctcatgcacgacctaagcacgagctcgaacctgcaccatgaccgaactatcaaacgagggtactttgccttcctgcttggggagttccttgctctaatagtattgaacacttggcacattaaacatgaaaaaaaatatactatcatggacaccatatcaacaagaaacacacgtcgttgatatatattttgttctttttatacttaaattgcactgatgagttttaggataaactcaaacaatcaatttctaccaaaataataggtgactaattgataaataagtaacaaatgacatatatgtatataaaacggatatatcaggcccacattaacatcacgcggataaccatctatgctacgcgcccactgtttcgacgaaaccgctcctgcgtctattcgtaaaataccccgatacaccattacaattatgcgcaaatgccacactactttgtctcactttataaaaactttgctacccctatatgtcatttcgcattatcgttcgactatataacataggtcccgcatctggcttgcctgacatagaaaccatttctctcatttcttttttctcctctcttcccaatttcccatcatgcccccgatcccctcccgttcggggcccaagctcccgaaatcccccatccccaaaagtcccaaacccaagcccaaatcgagagaccccgcaaccaaatctagggtttcgcctcctctccgcaggatgtccgatcccgcccccgccgccgccgcctccaccgccacggccacggccgccgccggctccggcgccgcggcgtccggctccggcgccatcgtgcaccccggaggcggcggcgcgtggccgcgcggcgtccggttcggcgacatggtctggggcaaggtcaagtcccacccgtggtggcccggccacgtctacagcatcaccctcaccagcgacggggaggttcgccggggctaccgcgacggcctcgtcctcgtcgccttcttcggcgactcgagctacggctggttcgagccgcacgagctcctccccttcgaggagcacttccgggagaagttcgcccagccgggtggccgcaacttccccaccgccatcgacgaggccgccgacgaggtcgcccgccgcgccgccctcgcgttcctctgcccctgccaccgccccaacgccgctcgcccccacgagctcgacccgaggtacctcctcgtcgacgtgcctggattcgacaccgacgccgagtaccaccccgagcaggttgccgcggagcgggagaagatcgatccgcgggcgctgctggactacctgaagggtgccgccgtggagcagctggacgccgccgagctgatcggcaagcccaagcggcacatcccggcggtccagatgagctccatgcttgaggcctaccgcctatccagatacgcgctgaaggatcccacctacgcccaagctttcgggatggactacgacgaggcgcaagcggcgaaaacagcgttggagaagaaagctcgagaaggtatactcactcgcatgcccaatcctattaatccttttagctgcgctgtatgctactatgctattgtttctgctgctatgtactcaaacatgctcgttaagctaaccgtaataccattgctgagatatagattgaagtttgattcctttgttctgaatagaagtgtagatctggttcaattagttttctgtttcatatttttgttgatctgtctgttgcatgattgttgtttcattggggttgatgtggtttgtcacacgattattatagaattgattcaaaatgaagtaaaatttgacagatgcattgcagcaaccaatcttgagttgtcgtagattcatgggtattgccatgatctccaatttgatatcttattttttccaaacaattactaagggtacaatgagaacttatttccccactaccttgtaggaatatttttttataaaaaagattagggcctgttattattcgattgtgattttgttttgtcatgcttttattcatatatctcaattagagatttacgtgctacttagtacttgctgcagtttataggccaggcctcagttcctaacttgctatatgtttggaaatcgtgaggtcctctcttttcctaacatttatgcatcatttttctgttcattgcccatgcacttcagattgtatgcttgctgtttgttttttttttcatccctatagtttggcatttagacatgtgcaagcagtgcacaacacaacatttgttggttaagcgtaactaaagtcatgcatcataaaggactactataaatattggttaatgtacctgataaaacagagttatgagaagtgaatgtgattgggtttctcatctgcataacatgttttgttctggatgcactattccttgttcattgatgaagcaggctctgaggtaaggtggttgagttcacctttacattgtgaaggaaggcaccaagttaagatacgtatgactacaacatttgttagccgtgcttgttggttattatatttattaaacatgtataaaatgtatgaacattaactacgtataagtttctttgctgttattttagatgcatctagctgaaccattcggaagcggtaaatatgattaggatttctgttctttatgaaaaagggtaattctcaagatttgcgcataacataacaatcacaagaaaggaaatcatataattatgtatcgtcaacctaaaaaatatataaacgaagcattctttgcagactccaagtttataagtctgagagatccatgcctggagtaaagcaaggtgcatctagcttgcactaggatcagaggttccaacaccatcaaatagtgagggtactgaaagggggatcaatcttttgcctctcctgtccatgttcttgaccaccactagtgtgtttaagttgctccttcggttagaagcccccctccattcttcccgtgatcacaaatccttcatattggaattgtctcttcatattaccttctgctgctgctgtcctgttccagtgatttacttcccttctcgtccttttcttaactcgactagttcctttcttaagatgatgccttcagctattgctgctgctgctgctgctgctgctgctgtccaattcctggaattaacttctcttctcgttcttttgttaacaaaacttgttcctagaatcaatgctagttcctttctgaaaatgatgcctccagcaactttgctttgccttcagagttcgtagcggttatcataggttccttttgcacagaacagaatgattagggaaacactagagccttcagttcagtttagtttagtttattactctttccatccgaaaatataagatgttaggactggatgggagacatcctattactatgaatttgaacatgatgtttagattcacagtgctatgatgtgctccatctgatcctagtaccttatattttgggacgggggagtactacactagagccttttagtttagtttatttttgaaaagctaatcacagtgcacaaaaaaactgaacctctccggttgccaccaagaaatagctccccgcggttttgcttgttctaggcgatgcttcttcctgcccggacaaattctcctctttcctaggaaaaagcaaagattccatgaattgaatatatagacaccccttaggttgaaattcatccgaaattcgaaacgaatccacataagattatttcagtaaatggacatgaataacattaaattacaaattccacctgaattctccatcactctcttttggcgagatggtgataccgagtcacatggaagcttggaaagacgtggagagccaatgggggttggagaggcatcacagaatatgctcctcctccgttagatatttggtggccgatgagcgagacagacgccagcatttgtgccgtccaggagcaaagcactggtgaattttgtcctgccgtgtcagtcggactgtcaccctgtcttggcttaaataaaaaagctcttgaagcattaaacccccaaaatggatcaaccaatccttgcctctctactctttagcctttccaattttctgcgttagataatgatcaattgacaaagaagaaagttaaaggagctcattggctctctctggagctatttttcaactagacataataattcatggaagggaatgaagggatttcccttcaagaagaagatctcactttgcatggcaaatgagaccaaaggcgaatctcttcctgccacaaacaaatcccaagaccaagaatataggtgacggtcacgtagtagtagcagcattggtagtggtcgtacgtcattacttgcaatttgcatgtgcgtccacgtatgtaggcacattttcttttttttaaaaaaaaaattctgatacattgtgttcgctcgagagagaaagagaagccactacatactcaattcgtttcaaaataagttaacctagcacattatgtgactatcctatttaaattttaaaataaattaacctaatacagtatgtgacatattctatttaaatttatagtattaggatatgtcacattctgtattattgttttgggatagagggagtataatatttttcttttcgccatagaaaaaaaatcactgtttctttggttggatattaacctggcccaaagagagaatcccaggagaagcagagtcgccagcactcaccttttgcatccaccgacacggatggacggctaggatggatctaccgacggtctggattgcgcgctggaagagtcacccatctatcctcgccagtcgctgattctttttttaatttttggcattgctacactttctttctttctttctttctttttgcaaggtcttttttgtgtgtcatacacattgatttgtcaaggagatgagtaacaaataaatataaataaaaagaaaaaaaatcaggatgcatttccctttactactctccagctcgtgctttctcatcattcttcttttttcccccaagagtgaattgcacttgcacgtgttctgttacacagtatcagtgaaaggcttaatttttttttctttttgttgagacatgtggcagtcaaagccttcataaacgaacgaaatgtcatgatgtttttttaaatctctctaggcaagagacgtgtttggtgggaccggaaaacacaggaggaaccccaggatgatcagggcgagtcttcaaatacaactcctgcaggtattgtactgtacagtatatatacgactgtacatattcttctcatttttattatacttgtattattttgtattttacatttttcttccttccaaaaatccaatttctttcaaaacaaaaaaaaaccccgactattttaactcaatcacaatatcattagttaaattagtttattgttgttttatatatttcaaatacaacttctgcaggattgtaatgtacagtatatacgagtacatatattcttttcatttttattatactagtatagtactttgcattttcttccaaaaatcctatttctttcaaatccaaaaacactcgtctattttaatgttgatataatttccactagctcaatcacaatatttaaattagtttattgttgttttatatttcatatatataaaaatggaaaaccatttgcgttgacttggtcttgatgtgtggctacgatgcgtttgcaggtcgtccggcgaagggccgcaagaaggcggcggagaatcccggcggccgccgccggaagggcagcgcggccagcacggcggcgaggctcatggagaagatcatgcccagcgcggcggcgatgaagcccagggccaagaagaaggaccagtacctgctcaagcgccgcgacgacgcgcgcgccccgccgccgccgtccatgccggacgccttcccggcggcgcccatggcccccgctctcgacgacgtcccgccggggttcccttccgatcccccgacgccgccgctccccagcagcaccctcgccgccgacgaggagttcttgctgcagaggcgcactccaccgccgctgctgtccgcgccacccaccccgctcgcgcttcctcccgccgccgccgggcaggtcggcgacggcggcgcgcccacggacgccgccaccgccgccgcggcgccgaagaaggcgaccaagccgaagaaggcagccgcccgcaagcgcgagcgcgaggaacccgctgacgccgccgccgctgccgccgcaggcggcgttgccggcgagcctaagaagaagaaaaagaagaagctcgccgagctcaacggcgtggcggtcgccgccgccggcaagccggggttattgcctgctaaggtagaccatgatctgaagcaggtaatatccgagcttcaaagccttcctctcgttgcctcctatgtcgccggccgccgcagcatctctgacgaagctcgctccttcctcctcgccttccgctccaagtctttcaagaagagccatgagaacgatccacccgaggacaacaaggcctctaagcccaatgccgccaccgccgccgacggccagaagccgccggcgaagaagaagccggccgcgaggcccggcgacaccaccgccgcctccgccaaggttgccggcgtcaagcgcgccccgtctgatcgccaggaggagcttgccaccaagaagaaagccaagctcaacaagatcaagacgctcgccactgacaagaaggccgccggtctggagctcgccgccgcggcgcctgcggcggcgaggaagaatgatgcgatcgctgccaggaagaaggagaagg

SEQ ID NO: 68781 - DNA, 1519 bp, Oryza sativa
aaccataattatttttgtcactaagattcaaaccctgacgaatgaagctgtacgtgcccgattccacgccgcatgaatggtgcttcacataaactgataaattcaagttgcgttttgtttgtttccagagaaaagaaataatcaaatgccactgtcagccacgtattgttttgttcttaattagcaaagcgtgtaaaacacatcccccgctaactaaatgccatcgaaatttctgttcatgtgtttgactgccgtatagtccatgagctttaatctagttattcgatttatcagataggcaagtggtttaaaagacatagttattcaatggtgagtcgaccgaaactaaactcgatttatcatgacataatagacacggttgccacttgccacagaaagaataagagcgctgctacacgtacttaaaagtgaaatacttgcaaaatccttacaaacaataatctgaactgtttgatttaactagacgagagttacagaaaatctatatatactcacagtttgataagagtttagtagaaagaatttcatatttatagcctttttccagaagaaatgatcaaatcaagaagtgaaaccggccggagaaagtctacaccggcaggcccggctcatgcagcccacgttaggaagcctggctgcactgggtggcccaacggtggggtgggccacctcgggccagccgcagcagaatgcatgggccggcccataaatgggccactccaaagcagaccggcgctcagaggtccatcctgatgaatgaacattcatgcaggtgaccggcccaaaataattacagaaacccaaaaattacagaaaaactacgggttgttcatgttataccatttcagaacataccatttttttaaagttgataaatatacgtatccattaagttttttactaataaatacgtaagaaatcctgtcaaaacttggcaatattgctaaattgttgccaaaactttataaggtttattttagctacaatctaaacagaccttatgtatttgctaaaaacttaaaaaaaagtgcagaaaattaggaatttgctcaaaaatatggtaacagtttggaccattagataagcttaatgatttattctagcgagagattcttgctggatgtatgcatgtaaatatattgtaattacaccgtaattatgctatagttatatttgaaatatttttatcttaaagaactgatatgttatatagctacttccgaaaactagcacggaaatgcttttttgaaaaaagaaacatatgttctcctttctgtgtgaataaagcacgagcagttccagttgtatatatatgcgtccaaatatactgtcccgtggtttattcatccaaacgacaaatccttttttctaaaaaaaaattccaacgcattactttcttcccttttctctagcgaaaaaaagaaagcaccgaccaaagtggctcaaaaatggacgcgtccaaagatcgcgctgccacatgacaacggacttcgatgaa

SEQ ID NO: 68782 - DNA, 21048 bp, Oryza sativa
aattgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttagaaaacagaataaataaactagaagtggaactagagaatctaaaaattaactatgatattaaggcattaccagaaaataaggatatacaaaataccgaatttaaagagcaagtgataacattaaaagacagtaatactgctaaaataattcaactaaaagatgccataactaattttggaaataaatatatagtaaaactgcctttcaaagaaattttgggaataagaataccggtaaaagtaaaactatcacccaaggtatcatataaaattctagcactagtagacactgggtgtacaaaaaatattattcatgataagtacttcataaaatgtccagaaatagttcatacaattgatgataataaggcagaagtctctacagacatgtccggaataaagaaaattcataatcagctagctcataatgttgaagtatacattaatggaactaaatatataatagatgagattacaataagaaacttatccatgataagtgatgacatgataattggcctaaggtttttacaacaatcggtacaaaccacagtaatacatgagcaaggaattacttttatcccatatcaaaacaatgtgccatatatctcagaggtacgaaagcgtggtggagccagaatcaaacccgacaaccttgaagcacttaatcttgagtctgaagaaagaattaatgaatatgagcttagtgagaatatagacaactattctttctcatcatatcttccaaaatctatggaattgccaggtaagacatcatgggaagatagatatttattaaaagctactaaagattttgaatatatatgcagggaaatggcttcacagaagtctgaatggctcacaaatatgagttcatggagactgccccaactgcctagaggccatggagaacgatttaatcacaatttcagaataacagagctacaacaagggttattaaacctcttgtggcaaacaaaaaacaaaaaagaaaaagctcatgccttaaatggcctggcatattatttcaaaaatttcgtgccctcagatcaaaagataacagaaaaaagggctaaaatacaagatatccctcatcatgaggaaaggttactagattatcgcgaggagaaatcccgtgatggccaagataaacttcccatggaagttgaacaatctatggcaacagataagaataccaaggtattctcagataagattttgatctcagcagatcctgcttcgagcatggttgctttccacataaatatcaataacctattgcaatcttttccacataataaaccatcatcatccacaaaaaggcatgataccattccccaaacaccatacatactgcataatcatcctaatttattccttccacaatatatactccggacccagccaaaagcaccatgtagatcttgtgcctacaaagattcttgcaaaaagaaacttaaaagccaaaatcccatgagtactacatacgaaaatctccaacccagattaagcttcaaaacggaacaaactttatcctgctttgggcaagacatcctcgatcttgtttggcaaaagtttaaggagagacaaatgaaaatattccttggactccaagattatttctttgatctcttagaagggagagaaagaaacccagccatacgagtaatcatatatatgctccctctcttaagactagatgatcaggcaatttctgacccatcctatagattcctggttctcaaagctgagataaatcttcaaagattccggaacctacccacatacaaccatgaagaaatatctctccaaaccattatagatcatggtcttgtgaattccatatatgcaaccctcgatcagatccttcatctgatttaggaaacgctgtgaaagatgtatgcaggagacttggacatggaagatacaggattatcttctcctcaataccaccaaaattcacaccacctgttcgtccagcaattcattatatatatatcatgaagggacaatttaattttcaagaagacggtcctagcaaactatcggatgaagaggaagaaatatatacaacagttgctaatcatgaaaattggagattattttctgaagctgcagaaattgaagaagctatcaccacagattatgaatatcagctggttttccaaaacaagatcacaaggatttttatcagcaaattctacaaccaaagttatgaatacttcaagggagcagggcgcataattaaaccggattttggaaatgaatgctccaagaaaagttactacagaagcctggctcagtggtttcagaaaacagagccatcagagattgacacggtgcaatcagcaccaatgataatcaacgaagataatgaataaagatcttgtcatccccgacaaagatcactattcaagataaggaatctacactattccagataagtatggatcttggtggtcatgggcagccagatgaatagaattctttaagctaaatatgtttttcaatatatattgataatagaatatcaataatttgggcgtggaagaagaaaaaaaacgaagatttcagaagactactcaaggaggaatccagaagaaggaatccagaaggacaccctataagcataaaggaacaatatagggtgcggtgaatgacatatcactgtgaagagtaaaactttcggtgaaaaggcctcgactttagccagctcccgtgaagatacagtagcgaagagataagcaggaggcacaggcgacgccatccctggcctctataaaaggagacgttggccttcactccggagacacacaacaacaacgaagacaccattcagagcaaagcttccaagcgcgctctcaccctccattccaccgttcttagtagtagtgactttagcctaccttgcatagtatattgaagcaaggagttgtgtaataacgctgtgtaaggtaagaacagcttgcttgtacctaccttcgggtttcccgaaagggaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatccgtagagaagtgttccctttgggtggaactgcctggggagacgataaactcttagctagaacaagtgtgacttggaatatcttgttaagttgcttctaaaaagatagataggtgaggcatacggtgagtaccgagtaggactttacatcatccgaagcaagcttctaaggctgtctaaataggattcgccaccctgcaaagatcctaaagttaaaatatctctcgaagtgaacagtaatttaaacagtaaactgaatagtgtttttgaatagtaatcagccgaataaacagtaaactgaatagtattcagccgaataaatagtgttttgaacagtgtatattgtctgaagcatatatatatatatatatatatatatatatatatatatatatatatatatatatatttatttatttatttatttatttatttatatataggacactcatatggggcaccatggtatctaatgcacaaaatcactcaaattttttaaaatttttaaattgtgagtatataactagttataataatttgattcatacctatacttatcaacaaaacaactcaaatttaactttatttcacaatccatgattacatacctaactaattatatgtatggatgctatatacctagaatcaaaatctaacaaaaataagttcaaattcagttcaaacttgctttaaactagttagtaaagtagttaatgttaatacctaagtaattgaaaaagtttcatactcatttgaattgggtatatactcaatttcaataatggtgcccgggcaccatggagcaccaaacaaatttatatatatatatatatatatatgtatatatatacatgtatacatgtatatatgtatatacatgtatatatatgtatacatgtataaatgtgtgtgtgtgtgtgtgtgacgcgaacaataaatctgacctttcgaggcagctatacatagccatatagcaatgactcatatacgcatgcatggattcaattcatggcacgcttccacactttgagctaggttagttatacaccaagtgcatttgtcaccggaagtattttggttgcgtttagatccaaagtttggatccaaacttcagtccttttccatcacatcaacctgtcatacacatacaatttttcagttacattatctccaatttcaaccaaaatccaaactttagatccaactaaacacagcctttgtacgggacgaattaatagtagcttcattgattagattacttgtggtagaacctatatatttaggttcaattattacttgtggtaggcgaccacgatggcggccttgggcgtgccaccgccccaccccccccccacacgtgcctgagggtccagcccactgggtgacaacgacacagcggcggcggcgacatgggaagcagccgggccgccattgtcctcgggggtgggaggggagggagatcgaagggtaagacgagatggccgctgcctacctctccgccacggctgccgcctacataccaagttgagtgtgtgtgtctatatatatatatatatatatatatatatatatatatatatatatatatatatatatggggcaccatggtgcccgggcacatggtatctaatgcacaaaatcactcaaatttttcaaaatttttaaattgtgagtatatacctagttataataatttgattcatacctatacttatcaacaaaacaactcaaatctaactttatttcacaatccatgattacatacctaactaattatatgtatggatgctatatacctagaatcaaaatctaacaaaaacaagttcaaattcagttcgaacttgctttaaactagttagtaaagtagttaatgttaatacctaagtaattgaaaaagtttcatactcatttgaattgggtatatactcaatttcaacaatggtgcccaggcaccatggagcaccaaacaaatttactatatatatatatatatatatatatatatacacacacacacaaagtgcatttgtcattggaagtatttttacaaggcgagcttgatttgattaggttaattgtggtagaacctataacctgggttcaattattaaacttcacacggttgtttatatttatagctaactatttttttaatgacaggtcagtgcatgtcgataggtagagatacatgctttgattttgtcaattttaaaatatgtatatgtgtttatatgggtgagtgtgcatatatacagtacacaaaagtgtttacatttggacgtagcatgttattataacaccagtataataccagtgttgaagtagtaatcatacagtaagagtattgattagtagtagtactactagtatcaattggtagtagtaggagactagggctctgttcgttctggggaggtaggggagattgtttctcttttttcgcgtgcacggttttcaaactactaaacggtgtgttttttgtaaaaaaattttatagaaaagttgctttaaaaaattatattaatccatttttaaaatttaaaatagttaatactcaattaatcatgagctaatggctcacctcgttttgcgtatctccccttctcctcaaacaaacactaggggtgcgtttgaggagaaggggattgaggagattgggaagatacgcaaaacgaggtggtgtgtttgaggagaaggggattgaggagattgggaagatacgcaaaacgaggtgagccattaattcatgattaattgagtattaactattttaaatttcaaaaatagaataatatgtttttttaagcaacttttatatagaaagtttttgcaaaaaatacaccgtttagtagtttgaaaagcgtgcgcgcgaaaaacgagacacaatctcctctgtctccccgaacgaacagagcctaggagtacatgatattgcagtcgcgtgcacgcagcttttaagcagcggcaaccgaagtactccaccgccccatcaaatatctcgtgggagagtgcatcacaaccggccacgtgtcataccacctcgagatctccatcgcaattcctagcttgtcaaacacgtagagctatcccccaccctgtcctgtccccccttctactactagcagtattttacgcggattaccaagctactcagtcagtcagcctgtctgatcacactcagaccagtcttttgcaactgcagctgacatgtgggcccacgcgcactgtggggccacactatcatcgagagagtacggctcgggagctgtacgtacgtgtttatattatgcacttcgtcctaaatcagtcgtcgttttcactttctccatgtaacatttaaccatttattttatttaaaaaatagtacaaatataaaaaaataaattatatctaaaatacttttaataataaaaaagttataaataaaataaataataattttttaatcttttgactaatatgaatgaatggttaaacgttataaattaaaaactcaagacgaaaagtattttgagacggagatattatatgttgaatattagtagtattaccgtagtagtagtactaatatacttcttcgtcccaaaaaaataaatctatagctggatgtgacatattatagcataattaatgaatgtggatagaggtatgtctagattcttaataaaaggatgtattacatcctccagtactaggttgtttttttatgggacggaaggagtactctattaatcgaaagtgtcgcgtctaaagaaaagcacttcactatttgctaaatgaggtatgtcgtgcgcgagagaaaagcatcggatttctacaaacttttcgccatagatatgcatgagataaacaatgaattcgtgattgtttagtactagtaagaaagaagagaaaaaggaaaaagatgaatgcgatggagtgtgctttggaaggataggatggcgacgaaagatgccttctccttgttgcaacatcgatcgatcagggtatagctagcttaattagatagatgtggcagtaaagtctcactagatagatagatagacacacgttcaccgatcgagtagtagtttcgtgtcacgtgtaccgtttcacgtgacatggaatcactttcaccaagctaccaacactttaatttgtttcttttttattttgggaaacactttaatttgttcatgcgtgcatgcatatatgccttcttacatatgcgtacttacgtcgtcggtctgttcggttcagaccgatgtacactccgtctcctaaaagatcattcataacatcccaagatgaaagaaaataatcaaaataccctttaattactatatattgaaagaaaaaaaagtaattgtaatatgtaggtaaagagtattgaatagataaaacttctcgtttattcccgcgtctgtactatgtttttttaacgatggaatcacattattttctgtaagattaatcacattgctaatttgtaagaatgagatatatactagggcaatttttaacgatcacgttcaatcgatccgtccatgcacatatacgcatgcatcagtaactaattgaatgcatgtcacaccagtttgtttcgtacgtatacgtatgtatgtggcttcgtatacatagacgtgtagagggatcgatacacgtatatatagctagcttctaggtccaactaatcaagtacgtacgtacgtactcgatgacaccaacatttgtttgaccttaaacattcaccacaaattaatgtctacgtatgtacgtacgtacgtatttatgtggaccatgtataaacgataaatcaatcacatcgcgcgcgcatgcatgaactacaggaaaaagattaacactagtattacgatcgagctagctagcaagagaacaaattaaaaatcgtctcgtgtcacgcacaacaagacaagttaattggtacgcaaacgtttgcttttgattttccttcgccatccatcgagagatgatcgttcgttcgtcaacttttaattgctgtccattattacgtatcgtgttgaaaaaaagagtttacatggactaattaaatacttaatctctctaagtgcctccagaaatttaaccaaattaactaaaatcaatatatatactaagctggtgtccttttcttctgaagatgaagataatgaagaagttttttacgtaaaacgaagtggtattaacgtatgattggttaagttataattattataaacttgaaaaatagattaatatgatattttagagcaactttcatataaaaaagttttcgcacgaaacgcaccgtttaacagtttgaaaagtgtgtcacacaaatcttaatcttcatcaaactcttgttggagaaaagaacggggcctaactagaagtcactataccgatgtgtggtggcacacacttgacacgcaaaaatagaaaaaaaaagaaaaaagaaccgtacgtacgtgcaggcttgacccaaccgattatgtaagcgtcatatctcgatcgttcaaaggcatagatagatgcagctagctaattgcttggagtattaacaaaatatataattaagaaattccaaaaagagatgtataaaaatggaaatcgtcatcagatggatcggacagtgaagaagcaaatcgcagcaaggaaaaggcaggattaatacgatgcgatgcatatgaatgaattccaattaattggatgcatatccacgaccaagttttaatgaggtaccaaattaaacaaggcaagcaaatcaggaagagattaaacccccccattaaccacacactatatcagtattattattaacgcgtagtaccagccgcccgcctgcctgcctgcctgcattccatttactatttaccacgtacgtgtgcaccggaattacagccgtgggccatccctgtcagcgagaaagaaaaaatcactccacgcgccgttccgttccgttccgttatgggtggctgtgctgtggctgggccgtggcgtcaccgtcacgccctgccccccgagtcgaaaaatttctaaagcaaagcagccatactactactctacctctcgggctctgctcttctcgtcttcctcttcctctccgctacgcagccgcggcgcaagtgcttcctctccacgccatcaccgacccaccaccgcgcgcatccgttcccgtccctatccgccgccggagccctagatagataccgcgtcgcggccatgctggaggagccgctcgccgccgtgctccgcggagacgggaggtaataagggaggggagggggaggggttcccgatcggcggggagctggggtgggggcatgagggcgccgcaggagcgcaccgtcagggatctctacgatcgcacgcgacacaaggatctcgcgctccccgaggtacgtcacgctcacgcgcgcaccaacccctcctccctctactgttgattcattcattcgttcatgggttgattgatgatacctcctccggttcgctggtgttgttgctggtgatgtgggtttcgtcttcccttacccgcggattagggattagggattggggattgggattggtgggggtaggctaggctatgccgattcgaggtttcgttgcgcgtgtaccgtacgaattgtttgtttggccgattagttttttttttttttcatcagggaggcgttggacgcggttttgcgataggtcaatcagaaattgatcgaatcctttgatttcatgcctcctgctatttgttttcgcatccaattaggagccaatcgcagggatttggtgggggtgtcgatgcgattttgcggctggagtttttcgagggttgcctgattgacgcgcgccttcttctgtttgtgccgttcaggaatcagtggaggggcgtggcagtggacgacgggtggaggggccggggcatcgggaagtggtcgccaagatggaggtgagcatttccagggtgtggttttctctgtatatgctgacaatattctgctgggctcagaattttgcgcctgtttgcctcatcatctcatgcccacatgagagaaaaatacgatttcaatctagattattcgtctattctaatgcgctcttggactgcatgcagtttagctgttgtgttgtggtatagatgcttggaggtgattctgatcccacaatgctgtctacaataagggtatattaatatgtcagtagtgcaactcctgcttttggcatgacttattctcgcttggaaaatggcttggcagtacttgaatgctttggcgatctttctttccttggtggattgatgtgacgctttattcatctttacttacttgatgaatgactctgatcatggttttgtgtgctgtaagagagcactggcaattatctttccttgttgtctttataacagtccattttctcgttaagtgcttgtggattgtcattcgtcgatttactttaatagctctgagtagtctaattctccaggattagcaatgtttctgataaatagtttaatcttttcattgaaaatccataaaatacctgaggtctcattgtatgcttgttatgtttatgcagttctggcagggattttttttttgattgtttatgtttcttttttttttcctaggacaagcttacagcaagaaaaagaccagtaccactcgacagtcctaatgtgaagacagaatctggcacttgtaatgtctgttgtgctccttgctcctcgtgcctacaccgaaatattgcactcacggattcaaatatggactgtggatcatctcaaacatgctttgcaaggtcagaaacaaaaaacagttcgtttgttcgtgttgataaagggctccgtaccaaggctaaggggggagaaaatgacgatgaattcagtgctacttcaagccctgcttcctattctgaaaatggtgaaaataaagtcatcgcaagatcatctgttgcagcagattccgaggttgacaagccagcaaaacgtagaaggctagtaaatcacggttctagatcacctatagtagaatgccatgatgatagcaactcatgtgttactggagtatcagcagcaagcaagcttctgttagacaagaaaaaggataaactatctacatcagcatcaagtcgtgaccttactgttaactataaggacaatggcattaacagactaagaaactactgcgccgaagaatctacaggaaagaagagatctgatgttcatgccatgcaccgaagttcatctgatagatcattgcctgccgagtctccttttgcaaccaagaggttgctgcgtacccaatcctctctcagtgcatcacatggattatctcctaagagaccaacacatgaatttgggaatgcacaaaataatttagctcaccaaccttgtgagaaagcttcttcaaacaagaccgtagagcgttcactgggaggaaaatcagatccttctgtgcttggtggtgagaggcacagcatgatgactagttgtggtaccagtaatagggataaaatcaaggctggatctttaacaaagaatctggaaaatggcacctcatgctcaagaaatggaagtctagaacatgctgacatccaatctaatgatgctgtcaataggaatgacaatgataaacaagaacgtaatcaaggttgttcaatggatacaggtagtggtagaaagttgaatacacagaatgatgtgatgacggactctgggaattcagagggcttaatagatgtaagtagtttcctgatccattctgttcattcgtgagtatactgtatactccttcaaaatgtagttcttttatactgtgtttctatgcaaaacaacgttagtttacactaggtttgatatctgtccatacaaaaaaagaattttgggtcacacttggggttgattgattgaaagtgtaacatgtaactgggatttggttggtcttggacacattttcttatcatgacacttaacatggagaggaactgtgcatatcatttgcccttttagagtatgagatgttccttatttcatttgcttcttggctggttatgccactttttcatgtgaaagatagcttgaactggtgaagtttaatgatgaagctttcacttaaaatagtcttccgtgcaatacctgaaataactaattactagcacctagcacatcccactgggtagaaaaagttcgtacatgaaggctaattcctgttcttttattgatcgaaatatggtggtaggaaattggtgttttgtttcttcactacatacaaatgttcttgtgctttcctgcatataccatcatctgattaaaatcaagactaattaaaagtttgctgcatatctgaacatatttggataataggatttatttggctctttgatttacaatgcttccctcaatctgtacagtgatgtttccattgtttcatattatttacctgtctcttttgtgttgtaccccaggttaatgtttgtgatatatgtggagatgttggaagggaatatcttctggctacatgcactaggtgccttgaaggggcagagcatacgtaagttactaaccattttctttgtattactttctaagaaatatgatgtattattatatttaacagctatttcttcacactggaacatcatgcacatattaaactagtttaccaaggatggatattattcacaccaccactcttttaagtcttgtctggcaatgacgcttgtagcctataaatgatcgaatctaggtgtatttgtatcaaatgatctattagggtgcaattctcatgatgcgttaaactaatgcttttaagctgaatgcaagtcctttccatggttttgtttgatattaatttcactggagtatataataaagaggaaaagcaagttatttgggctagcatgctggtttcattcctttgtgttttgtgcggaaaatgtatatgctgcaatatgctagcttttgaatttctgtttattgttgactagttattgcatgcgagtgaagttagagaaagttccagatggtgaatggttatgcgaagaatgctgtcttaaagaagatgaaaaccaaacaagaagcaacggtggcacatcaaggaataaggttttggacgggaagaaccaaaattcagaaagtacaaacaactctaagacattgaaggttgttgtgactgatttggacagtcaacaaatcacttgtggcactccagtaaatgatcccttggctggtagcaatcaaaagttgcatcttgcgtcatctgatctggaagcacggcaagtgaagtgtgccaccccaactgctgaaagactggatgtgaagaacaaaaattcaggaattatgggaaatcgcaagaagttgcaagttgttacatctagcttggaagcacgacaatcctcttgtaggacaccaacgtctggaagcttggataagaagaatcaaagcttagacaagaggagtcaaagttcagaagtgttgttaaaacgtaagaagttgcgagttgccactgatatggaatcacctctatcaaatgatggtgtacggagtccacctaaatcatgcaagagatatgcagaaaatactttatcctctactcccaggctcctgaaggcggacagccctaggaatcatgatgtgttctccagggagaactcatttaaaagctctaacaaaggaagtataaagtcgcctgataatgctccaatgaggtctcaagcagttaatagttccgtgaccttacctcggtcatattccttggggaacttggcaaatgttaaaacaccaggtccttcaccacgaggtttggccaaagtttattggtatataacctgaaattatttctttatttaatttgttttgtacttccgctaaccccttagcttgatcttctaggccttttatcaaagcaaccatctttcaacaactccagtaatgaaccaaaggtcaagcaattagctgaacctgtgttgagcaagttgaagccttcaaaacattcaccaagagatcctagagagtccatccggaaagttatgaaatctgggcctcttaagcatgaggcttcaatttgcaaaggctcaagttcatcaaagcaaaagcaatcagttcattcatctcaaaatgaacaaccgagaatattgaagcccgtgaaaccaacaattttgttagaaaggggggcttcatttaatcttcaaaaaccaaacatttcttcatctccaaggcctgatagttcaataaaatcaggggatccaagaaatgaccaagacagcccgaggcctggaccaagcatacttaaaagtagcaaaaaaccaggtatgttcatcattcctttagtaattattataaagaaaaatgccgtagttcggattttgacaaacttcctttatggcttatcaaaattaggaattgttgaaaataagcatagctccattttatctaaaagtgatgagcaagggattacttcaacaggagttgtttgttctaaagacacctgtgtggtgaaggcatcagatccactaatcccaatggataaaataaaaaatgatagcacagatggtgcatgtgaaagtccactaattttggtgaataacgataatgaaatgtcaactaaacctgaggtgctttccattccacgtgcttcaaagacttgtggatctgatttccaagatattgcgccaacaagttcctcagaagatttgcctccagaagaggtacagtatgaacagaaagttgtggaaagtgatgggaacatctcctgtaaaagtgcagcggcgattcaggcttccgaagaccttttgccggagagcccacaaggctgtctagtggcacaaaatccgtacagccctgacactaaatcgaatgacctgaacttaaagcagcaagctttggttgatcaatcttctactgttggaagttctttgggggctttagttattccagagcagtcttacatctggcagtatgtcctctcttattttcctctctttacccccatgtaccaatttgtgaaatgtttatgtatatattgttttatttcagaggtacctttgaggtttcaagacctggaagctctcctgaaatgtacgatgggtttcaggctcacttatctacctgtgcatcgctgaaagtacttgaaatagtgaaacaattacctcagagaattcagttggtagaagttccacggcattcctcatggccactgcaatttaaggaagtaaagccgaatgaagataacattgctctttatttctttgctaaagatgttgaaaggtaatgctcactgtttcactgatttaaattcctttaccataaataaacaagctgattcttttctgttcttcgtgcagttatgaaagagcatatgggaaactgttggaaaacatgcttgctggagatttgtccctcacagcaaatatttgtggcattgaacttctcatttttacgtctgataagctgcctgagaggactcaacgtaaggcttatcttagctaatatagtcatgttattgtttgaaaaatggctagattactaattcaatttattcaatgattatagggtggaatggcttacttttcttttggggtgtcctttatgccagaaaggcaagtagttcaactgagctgcttgtcaaagggatgaatcatagtccattagaacaaattaatggacctgttaatcaacttgtctgttcccctaagatgcctcagtctttgggcatagatttgaatgagtgccctgttgatgaattgtatgatccagctgtatcagttcaaacggagatggagaatcgtggtgcatctgtaaaccatgagactttgttgaggtccaaccatgaggctgaaaggctgaatttatgtgaaatacatttcccagaaactgcagggactgggaaaattttgttaggaactcctactgcagttccctatggagttcatgttcacacaagttcaaaacgtgaatgcctcaacattaaaccagaatatccaagtgatataataggtgcttacatcttttaattaaatgtagttactgatagagcccaatattttcttttcttgttttacatgtgtattttgttcatttcaggtagcgaaggaacagcgggcagggacaacatggaggaggaagagagctttaccaagaatggagttccatgctttactaagcagcatacaggtgcaaccaccagatcagtatctgatgagatattggcaaatacacaggcacgcgtatcctttcaagaagtatccccacagcattctgtcaggccaaagctttctgatgatccaagtgattcagttttaaaggactttgttttgcctgattctagttccatctacaaacggcaaaagacctctgagggaaaatactctacttgcagttttggagatggtcaactgactagcaaatgcttgtccaagatacccttgccagctgatcagcatacttcattagatgatgtgcaatatattggtagggttccagcagatccctgttctccaactaaaccaatcttggatcatgtgatccatgtcctatcttcagatgatgaagactccccagaacctcgtaataatctgaataagacatcactgaaggaagaagagggcccttctcctctactgtcactgtccctttctatggcctcaaagaagcataatcttaccggttctgatacaggagatgatggaccgctgtctctgtctcttgggctccctggtgtagtgactagcaaccaggctcttgagatgaagcagtttctgccagagaaacctggcatgaacacttcattgcttctctagatatttgagtgtacagttttgtgctgtgttttactttatggggtttagacagggtagtagtatggtatagctgttaaattatggaaacctttggtttatttcactgttctatgcatctggttgttgctagagatgctggtctggtgatggtattaggcttctgcattttgtgtgattatggtgttttagttcccaaacgaactggtatgacataaaggatagatcagaatgtgaagtttgataaatgcaagttttttccatgcttaaattggcacttcctctagcagggaaatccttaagaataaccgaatcagcatatctgttcaatcatctcaacaaatgtacacatctactagtctctcatcgataacagatttattcaacttattcggttaccagttctggttttgtatttttgcttatcagcttgagatgcagagatttagaaattattaaccagcttcatcttgatgtgcccgaagctctttcattttgtggtacttctctttatcctttgacatcttatagaatgcttgcatactgttggcagctcatttgtcctttttttcctgttatgtatttggaaggtgttgactgaagtcacagcatttggtatgagaagggactcgaagattcacccctaaaactttattcaagtataaggtaggtattgaaaagttcattaatgactgctaattgttatctgaccacatctttttagaggttttactttccttctaactatatagcagataataactgatttttgctactatagtggttgaaaaactcagtttgccacctggccaattgtccgtttatgtttctttcctgccattttctctgtctagcacaatttaatacgtagattctcctccctctttttcccgtatgctatatagatttcaccgttagtatttactagtttcagtttcagctgtccaggtttcccccaagcatttttcccaaactatttacgtgcaacatattaaatgtttcctctgttttgcgtttatgtcatcttaggtccctctttttcaaattagaccacagtatctaatgatgttctattcgagaatgaacagcttgtaatcacaacttcaaacgaacttgatcctcttgtgtcctttattctttgaatttcttggtcattgctgcttatagttcctatggatttttattgaagttcctgaaaatgatgagatttattgaagtactcgtttctatgtatatttcgcatgtggacatgttgggcttttgttcaaggtggtcaagcactgaagctgctggatgtcagtaggtcatggtatggactctctatacactttattgaatagcttcatgcctgtatatccattggtttctattcatcatatgtcaatactctagctgctgaaggccatgtgtggtcctgatatcttgtatatgcaagtgaatgttctcactattagcttattttttattcttattgtaatccaatctgcagtagtgtggcacagcatagctgggtgaattatgtataggaagttcgcatgttatgagatgtccttctgttatctgggcccatgatattggttcagaatagggcccccaaaattctgggtattttattttcaagctaggtgcgctgttgtttgttttcaagcattgtgcgtatgcactatgcactcttgctgtactgtttacgacagcagcttttaacgtgttgaaattacacattataaggtcttggttggttagttgatcagtttgttagagtacctatatggaccttttcagctagactatatcatgcttaggcacaaacccaagcaaaacaaatatgcaccgtttgtctaatatatgttgtataatagttggtacgaggtaccttgtcctagtgcttattgtttttgggtagtaggatgaacacgattgattttcatcagctcataaaatatgtccgtgtcccaatgcttcaacgattcatcccaacgatttgtttatttgtcttgtttctaggcttttatgcttttattcttgtatatatatatatatatatatatatatatatatatatatatatatatatatatatatataactttcagctatgatttctgattggctgcaagcagctggcaatgatttgctcgagaaaagaagagtttgcaactgtgtatacatctgtgagtatattagcatggaaagacacggacgcatattagtcggtaaggatggttcaatccttttttttcccgcgttcaactcgtacttggtggttcactagagaatctccgtttgctatacatggaataggatacctgttatatctatgtatttccaaggattattgtgttgaggctctgcgacaatattatcagatgaataccagtagccctgtgctcgtttgttaacgtatgacgcatcagtcatcctttttactttcaattttcgatgagctcttgcttgaagttggggcatcggctgcattgcactcttgctgtactgtttacgacagcagcttttaacgtgttgaaattacacattataaagttagtcggggcatcggctgcattcccccctctcccgcgcgcgcttttactctttgttgttgatgcatcatggggcagagcctgatagactctcaacaaatttgcagtcttcaaaaaaaaaaacaaatttgcaagaagcaccatttaccaccggagcgatcgtttgcatcttgacctgcctgatcggtcttcgattccctcaatatccatttaagtttcattgcgatagttccatcaaatcgaagtgtgcagacaaaattaatcattgcgaaagtgttgaaaaccttgttcggttaatccctctcgattcctttcacatggtgggattaataaccgaataagtcataaagaaaatttagcccgctaatggctcaaagaagatgaacggtccttctaacatcaactaacggcccaaagtcaataaatcatggcccacctaccccaaaatcgaaaaaaacgactactaacggtacgattcaaaatattcaggcccataaaagcccatagtcataaggttaatattttcgaatttgaggacaacgatctcaaagctaatgtttcaaatattaatggttttttattaaagggtaatacccatcaattttcaatgaacgctaacacgtaaaactaatattcacgaatattctgcccaacgataccaatgctaaattgctaatacttgtgaattttgaaaaaaaaatattgaagcttttttttctaaaggtatactcatgaattgtagagagctatagttcatgaaaatttggactgaaagctaaaaattacggatttttttatgcacaatgattccaaggctaatactcataaaattttaggttggaatagaaatattcgtgccttttttttgccaacctttcatactcaagaaagtttggtccgaggcacggaaatatagactgaaggctagaaaatcacgtaattggttttaaggttaatattaatgaattttgtacccaaagatcccatgctaatactcatgaaattttgaaaaggagaaaaatattgaagtttattttctccaaaagttgatacaaacgatttttggctgaagactataactcatgaaattttaggccaaaagttaaaaaacatggagtttttattcataaggttaatattcacaaatttgtgcacattgatcccaaggctagtactcataaattttttggaccagggaaaaggttagtagtcatgaaagtttgttcgaggctatgctcacaaaattacaagccaaaggctaaaatcacgaaatttttggtcatactgttaatactcaggaattctgttccgaatgatcccaaagctaatactcttgcaattttgggctggaga

SEQ ID NO: 68783 - DNA, 693 bp, Oryza sativa
tatacaagctcctagcttatacatgaaaatctctctatatatatctctctgtctccctctcattcattcatttttatggcagttgaggggaatgttgtctggtccgagacctaacaccgggcggaatggcggattcagctgcagctaagcaagctaggtggggggtttcggaccaggcttcattccccccaactcaactgtttagttcttcggcttcggcacaaatcggcgggcgacactgccagcgtgaagcttctgcaggtaggacgatgtttggccgtgcagccagccgtccgtgctccatccaccatcaccatgcatcgatatatatcttccatctcgctcactggtaagtgctctccatttcctataactctatcccagactcggttggatgtgtacatatgcaccgagaccaagcgatcaacttatgtgtagtgccagttgatgttgttccatggttgtgtttgagtaccagtgaattgtctcatggccttccgtcatcttcgtcttggtagactaatttctggtggttaagttcttggttgcttggagtttgaaaaaggttcagaaactcagcgtattggtgtcccagtgtatatacattaattgggcagttgttcacccgttaaggaattaatgaagcttcactagatagtctatccgatccctcattatttgcggctgcaggaa

SEQ ID NO: 68784 - DNA, 6993 bp, Oryza sativa
ttgtgtacatctgtttggatgtggaggctggtttaatccattatctaaaaaaaatgtactttcattcacggcacgggggttcagagaaatttcagaaatcttgggaattttcagaacgaaacaatttgaaatttaaacaattttgactaaatttggaccaaattcacaaaaaatgaaaaaaaaaagggaagaaattttccgaccaaattggaaatatcagacctatgttatgtgatcttaaacgtctgatcgtgccaatacgtgtttgtactgtatttcgttaaggattaggatgctttcttgcaagttgcaacaaggaatcgatggtcagaggtcaacagtggcaggtaatacggagtagcaattaacataggatcaatcagttgctgtcagttgtcatcgacttctgaactaatatccttgcgtcttagcatgttgacatcttcaaacttcaaatagcagaaaattattagatgctgactagttcagtttggcaacctcttacaaatagcacatcttacataggatcttggatgacatactcgctcagatactaggtaaaaacatttcacaaatgatcagttttacattacagcataagataattacattatatacaacacatggtcagcaggagcacagcttcagaaaacaaccagattgtcagctgcaaagttccagagatctcttctttttggcgaccacatgatgtttcctctgtacctcacagttgaacatgtggttgtagtaaggcggaaggtgagacttccacgcaagaaccttgaattttccttgaggtctaacacttccaaagagaaaatcttgcatgctcaacatgggaacttcagcttcactccgagtaaagtttgtgcgacaaagaaccatgttctgaacagaacatgtgtgatactcatcatgaatcacaaggtattcggaggaaattttgtttactgtcctaacatatggaggttcagacgcctgccatggattctcaaaatatgtaccgtatactaggagattcgtctgcttgtattctctgatgcttgccagagccatgttccaaaaccgagcattgaaatttgctttcaaaagtccactgtagatgcttgcacccatgaagcacccttgcaactccctggccatttccatggccattgatgccatctttgggtgctcctgtgcatccatgcttccgaatgtgcgcaccttgaaaaagtaccagtatgcttcttcagtaaataattctactctaagagcttgtgttgttccaaatcttgcaatcttatcagattggcttgcgacgataattttactgccatttggaacataactcttggaagctgagtacaatcttgtccatacaacctcatcgatgtctctgattagctcagataacgatcaatattctttctccaccagtgcattggtttccattcttgattgaaccacaatgtctaagagttaccatgtctgcatctttaagatcatcgtcactgaaacacacaatttgagagaagtggttacgcaccctttcatcgttacaggcatgctcgatcaaggtgctcttcccagctttccgtcgaccaatgatcggcaggacacccggattttcagaacctggagaatccactttgagcaggaagttcatgatgcgctcgatctccatttggcgaccaaacaaacatttgtctagaagcaagtgcatgctatatggctgacggcacaaatggggacaactgttcaagaacatgacaaaaacgctcatatcttcaagggtgacttctatgctgccaacaacttgctgcaactgctcttgtaaactatggccactgatcctgaagaaccggacactcttagcaggattgaacttggattgcgcgaaagagttactcacctggtgatcttttgcatcatcttcttcatggccacggcatctgaatctgtcaagagcgtaataccctctgaacatctccttcctcagtatattcagttgcagcagcatgcgttggtttgtgatgagccggtcctctgcctcctccacgatgatctgggcacggagcagcagccgttgcagtctctcctccatgtttgatgctgtcggtttcgagcacttgttgatcaggaaagatatggatttagtggcaagatcactcagaatcacagacaaaaatgtctccataagtgaagtatgtaatctgaagttctgtagatcactcaatggatcaacaagaactgggagctgagagaaaactatgtagcctggaaatttttcagtgtgaactgttttgagttcaaagtgtcagtttctctctacagtttgcattaatataacggtacgaggctgaccacgtggtggagacaacgaaagcaagagaattgtacagattcagttgatcagtcagcaccatctacaatggagacaaacaaaaatctgatgatcttgttgtcgcttgtagcacactagcaccatgttatcactctgccaagctatttgctgatttaggccccctttgattcaaaagaaattcatagcaattttagaggatcccattcctataggaatttttcctatatagtcctttgaatcaaagaaatggatcttatagaatcctatgaaattcctatgaaatgcctaataccatgcaagttttggaggaattttcatggaaacttttctttgagtatttatctctcctctaattcctgtgttttgcctgtggtccaatcaaacggccatttatgtgttttgcaatcatctgttttgcacttacattcctatcaaaatcctatgtttttcctattcctacattttctcaatcctgcgattcaaagaggccggaaaagtgacattcagcaaattgtttttccaactccggttgttatctccttaaacagtttactaggtactacatttcttcaacaatagatttatggctaaccatttgagcggaagccaacttttctgaaattcaattcgttgatcaatacacttatctgggacaataaaaagttcatgttatgctacatatccttgaaaaataagtacctggatcaagagcagacacagacagcaaggaggcatcgccatccggtgccaacattgttggaagaaccctagctgacgttgccaccaacgtgttatccatagctggtatagcttctgatactgctacaaagtgtttgcattgtcttctattaaggattaggatactttgtgtatcttgcaaattacaacaagcactgaatggtcagaagtcaacaagcaattaatttatatcctacttaatataacaccagcaaatgcagtcttcggtttcaaaaaaaaaaaaaaaaggtcagaagtcaacagcagcacttgatactttgtgtatcttttattaagataggagcagttagttcatgccagaagcaatgaatgtattttcatctcacgaatgttgacatgttcagatttcaaatatagaatgttagtagatgctgatagacttcagtttgacaatctcttacaaatagcacattttacatacgagtttggactacgcatttgctcagacagtaggtcaaactatttcacaaatgctcagatttatattaaaatttaagataattacattatgcatcagtttcagagaacaatgagatggtcaggtacagagcttctgagatctcttctttctggtgaccatatgatgtaacctctttacctcacagttgaacacgtaactgtagtgaggtggaaggtgagatctccaggcgagaaccttgaattttccttgaggtttaacatttccaaatagaaaatctttcacattcaccatgggaacttcatcttcactgtgagcagagtttttgtgacaatgaatcatgttcggagcagaacatatttgatagtcgtcaagaacaagaagatattccgagttaattttgtttacggtcctaatatatgatggttcaactgcctgccaaggatcatcaaaaaaatatgcaccgtagagtaagagattgagcttcttgaattctctgattatggccagagccctcctccaaaactgaaagttgatatttgctttcagaagtccactgtagatgcttgcacccatgaagcaaccattcaattccctggcaatatccatggctactgatgccagctttgggtgctccactgcgtttatgctcccaaatgtgcgaaccttgaaaaagtaccagtaagcttcttgagtaaagaattttactctaagagcttgtgtggttccaaagcttgcaatcttttcagatcggcttgcgactataattttgctaccacttgcaacatgactttttgaagctgagtacaatcttctccatgcaccctcattgatatctctggttagttcaataatgattagtatcctttttccaccagtggcatggttttgatgcttgattacaccagaatctctaagagtcaatatgtttgcatcttcaagatcgtcgtcattgaaaagcacaatttgagagaagtggttacgcaccctttcgtcgtcacaggcatgttcaatcagggtgctcttcccaacttttcctggacctatgatcggcaggacacctggattttcagtaccggtggtatcctctttcagcaggaagttcatgatgtgctccatctccatttggcgactgaacaagcactcgtctaaaagcaagtgcatgctatatggctgacggcaaaagcgtggataactattcaggaacataacaaattcactcatatcttcaatggtgacttcaagtctgccaaaaacttgttgcagcagatgctcttgtacactctggccagtgaccctgcagaaccggacacgcttggcaggattgaacatcgatggtgcaaaagagctactcacctcaagatctttgggattatattcttgatgaccatggcatctgaagctgtcgagggtataataacctctgtacatctccttccttagtatgttcagttgctgcagcatggcttggtttatgatgagccgttcatctgactcctccacgatgaaacatgcctggagcagcagccgttgcagtttctcctccacggttagcactgtcggtttcgagcacttgttgatcaggaatgatatggatctactggcaagatcacccagaatggcagacagaaatatctccatgtgaaactgtgtagtctctaactttgtggattactcaacggatcaacaagatctgggacctgagagaaactttgtagtctgaaaatctgtaataggaatagagattaaggcagcgtcaaactcgagtagctccacgtctccataaagagagatgcatttcagaacatagatataccgtataccttttaatgtgtctgaacctagatatgcttttgaatgtaaactgtttgaattcaagtttgtatttttccctgcggtttggattaatataaccgtcgaagattgaccacatagctgagacgacgacagcagcaaaggaaattctacaagtttagttcagcaccatagatctctggtcaagtttcacaagcacgtgtatttttagttgaacagtctgcatactagacaaaatgacctgacaaacatgaggaaaatacatgtttaaaccattttattatgaaagccagcatgttaaaactgataaaaatggaaactgctgatagcacagctggcaaagatagcagtagtgatgcctattggtctgcatttgagtattgccagaagcagtcatattccttcattgttttgacgtaataggaacgaatatattgatgcttcttcttaaaaccattggtaccaaccaattttcccaactgttgaaaatttcccatcctattccaagccaggatcatcagataatgttgtctagtagtagtagcacaactgttatgcccaaatacaaaatacatttttgttttgttggcttgaccaatagtttttcgaactgcggttgctgtctcatccttaatcagctgattagctacattttttttttgactgaaaaaggtagagagcttttttttttttagctacatttcttcaacgaattatggtagccgcaattctgaaattccttttggagatcaatagttgactgctatgggaaaaataaaatattcagaatatgctataaatccttgaaaattaagtaacctttggatcgccaattagacgagcaggacggaggagtggcatcgccgtccggcgccgccattgttgccgacgtctccagatccagccagggctattgcggccacttgccaccgccggccgagctcggcttcatggcggacggcatcaatcgctgccaaatcaggggagttggaggcagagcactagcctactagggcgcccaccaccggagcgccgccgccgtccgccgcccgccgacgagcagctcgccaacgccggcgaagtgggaaggagggcccgctggtagatgggctggtccgaacggagtttgcgcgtggtccttttcctatgagaaagtccattgctcatccctcatcgatgggccgagtcttattatctctctctttttttttttttttgccgggtcagccaaagaccggtgaccgaatttcattaagatttgaggggagaaaaagaaaagccgagtcggggggcatcggacggcacgggcttgtcgcggaggacgtgatgagtcttattctcatctctctcaactacaaaactaggtatataacctctctttaacatttaaaattggctcgtttttccttcctagacgatttcagtgacggttttattgtacgtgatgcctacatggcacgttggcatggtattgatacatatgttaactcagggtaatcttcaggatttgaggttccgaatgcaagcaccttgaagaagtaccaataagcctctcgtgacagaaacttcacatgaagagatcgagtttgttccaagctttgcgatcttgtctgatgggcttgtgattatgattttgcttccagctgaaatgcaa

SEQ ID NO: 68785 - DNA, 1012 bp, Oryza sativa
aaaaaacccacgaggggtcggggtgcctcggccctcggggccgaggggggtccggcccgaccccctcggggggactaagaggagggcgaacgcatcaccctcgggcccgacgtccctcggggccacgtgtgcgattgtgtctgcctcaaacctctagtcatgatactcctgatcccatgtcaccgacagaccccatgtccgatagtcgatttatttgtgttgcaataacatctatttctttgttgattttattgggggtggattagagttctccctatgctgattttatttggatggatttgagtccgatttgactaattgaagttccccctcttccagtggcgtgttcgagttggcagtttggaatttggagatgaccaagatacgagctcgatcaggaggtgattcggtggaatacatgcaacgaaccaagatggacgataggatatgcgcgctacagcaatgaattaggcaaacgtcggacaaaaacgtattgtgacgatcgtagaattatgaatttttaaaaaattttaagtaggttagattagagtagatttacatcttttaaagagcctttatcctggtaagagtaggactcgcatttaatgcagctacattttttcatccattttagctggattccatgtcgacacggtctatgcccaacttatgactgattctgggcctaaaacaggtgtataataccgccccgtaattttttccatttgggctgaaaatgtgcgtttggatgggctgtgatcggattacaatccgtcggaaaaggcccattactaccagggaaaaaaactgcccaggagtctcgccttgccctctcgccgtccgtgccgccgccgccgccgcctgcatctccccttcctaatctgtgacgacggccggagacaccgtacgttctggctggctgcagaggagagatcagaggagagggatatggtccaaggcgacaacagcaacaacatcaattgccactggggacatatcctctcgtctctcg

SEQ ID NO: 68786 - DNA, 618 bp, Oryza sativa
tttttaccaaaatccaaactttgcgctgaactaaacatcaagccttacactactactacatccaccaatggtaggtactgtaaaataccctaatagctaggcacacctttacagctgtggtgttgacatctcctgcttagatttttggaagccctcgaaaagggacctctcgtattggtagttggcatatcttcctccaagtttgcagctgaagaaggtgataacggctaaaccgaataatctacccctgaaacaaataaacaaacaaataaataaataaagagcaaagtagttagataggggactttaagggtaaggacttatgtgttacccctaaaagtgtcacattaaattagatgatgaggtggagatcgaagggaagtgaaaagagaacataacccaactctcatgcaagaggcaaaaagaaagtggaatagtgtgagagtggaccaattcaagaaaatgttaggatttgtgtactaaaagtaacataatatgcatgttacatcttaataaatttatagatgacatagctaaaattagatgtggtaatcacatccgctgtaaaacttgtcgtcttgccctaatgtagcagtaacagggaattactggtggttg

SEQ ID NO: 68787 - DNA, 19717 bp, Oryza sativa
gtgaagtgagtgcctcggtctgacacaatcttcttgggacagccaaatctacacacgacatgggtcatgtagagttctgctagtttctttccatcaaaggtggttttcattggcacgaaatgagctgatttcgtgagtcggtccacgattacccagatggagtcgtacccgctaggggttcttggcaaaccggtgatgaaatccattccgatctcttcccatttccactcggggatcggtaggggttgcagcagaccagctggcctctgatgttctgccttgactctttggcaaatgtcacacaaggctacgtattctgcgacatctcgcttcattccagcccaccaaaagtatgccttgatgtcttggtacatcttcgtacttcctggatgaatggagtaggcggactcatgagcttcctttaggatgagatctcttaactccttcttggccggtacacagatgcgtggaccataccaaactgtgccttgatcgtctatggagaaatcggtgtctttcttctcctgtattctttttattaactcttttatcccttcgtcgtctttctgagctttccggatttgcgattctagggtaggctgtactgtcaagctggcagcgacacctgactgtactacggtcagccttaacttttccagatctctgcacaggcgatcttggtcgggccgtatttgatctacattacaataggtcttgcgacttagcgcatcagcgaccacattagccttaccggggtggtaatggattccaagatcgtaatccttgattagttccaaccatcttctctgcctcatatttaactcggtctgtgtgaagatatacttaagacttttgtgatcggtgtatacttcacatctgttcccgattaaatagtgcctccagatcttaagagcatgaaccacggctgccaactcgagatcatgggtgggatagttgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgtagaccattgaaatttcttttctttctttaacagctcggtcataggtctggctagcttagagaatccttcaatgaatcttcgataatatccagctaagccaaggaagctgcgaatctctgacacattcttgggcgggttccaagcaagtacagcctcaaccttgctgggatctacttcgacaccgttgggggagatcacgtgtccaagaaatgctactcggtctaaccagaattcgtatttcgagaatttagcgaatagttgatgatccctgagcttttccattatcagcctcaggtgttcagcatgttcttcctcattcttggagtatatcaggatgtcattgatgaacaccacgacaaactggtccaggtattccatgaagattttgttcattaagttcatgaagaatgctggagcattggtgagtccgaaggacatcactgtgaactcatatagaccataacgcgttgagaaagcggtcttcgggatatcttctgatctgattttcaattggtggtaacctgatctcaagtcaatttttgagaaaactcttgctcctttaagttgatcgaacaaatcgtcaatccgtggcaacgggtacttgttctttatagttacttcattcagggctctatagtcgattaccattctctcagagccatcctttttcttaaccaggagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatactcgttaattcttctggaaatacgttgggatattcacagactatgggcaccgactccaaggaggtgacttgtaaacaggttaggatagaccgactcgcggtaggggtgttagaggtaaagcggacttgctttcctccaggtccttgcaaggtgatggacttttcggcacaatctatctgccctttgtgcttagccaaccaatccatccctaggatgatgtccaagctttgcgagtctaggactatcggtttggctaggaagtcaacttcctcaattctaaggttaacttccgggcatatttgagttgcccttatattcctcccagggaaatgtactatcattggtacacgtaaattttgggttttccaaccatttcttttcacaaaagcttgtgatatgaaagaatgggaagctcctgaatcaaacagaactattgcgggtacggagttgacagagaacatacccatcacaacgtctggagcatcctgagcggtctcagcttgaatgtggttcacccggcctcgaccaaagttgttggaaacacgagaaccttgtccacttgcctgagagctaggacgagactgagctgccgctggagtaggagttctggcagtgctgccattagcatgccctgagttggtgttggtaggattctgagggcactgtcgggcatagtggcccatctggttgcaccggaaacactgaactgctgacggtcctagcgatgacttgaaagaggtaacattgtttggcgcagtattgccactaggggcacgctgctgtggctgaggtgcctgacggttcatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgatccctttcaagaacttcctgatcttctacttgtctgtgtccacttcctcaggggcgtaccgagccaacttgttgaacagacttaggtactcattgacactattattgccttgcttaagtttgttgaattcctctttcttcatatcaatggcgctttcaggcacatgagctgcacggaaagccgtagcaaactcagcccaagcaatgttagtgggttcagggtgtgcattgcagtaattctcccaccaatctgcagcaggtcctcttagctggtgagaggcgtagagcgtcttctcaacaggagtacactgcactaagttgagttttctatcaacatctttcagccaatcgtcagcctcgacgggctcgacggtctgagagaactctggcggacgagacctcagaaagtctgtcagcttggatctattgttgcccatgtgagggtggccatttccatgcgcactatgctgaaaaccggctatggctgcggctaatccttgcaagatttgtgtctgaactgccattaagtgctgcatgttgttttccacatgaggtggggaagggaggcgttcttctccagaattgtgactagcagtgcggtgagagcggtgagactgttccatctctgcattacgggaagctgtgtgatgcgagcggttgctgcggcggggttgctcaacttctgcgttgcgggaagcagtacggtgcgaacggttgctgtggtgagaccgctcattagctgactcatgattttcttctggctcaactctaccttcttcaaaaccgaagcgggctggcgcacgagcagcacggcgggggcggctagccatctaaactcccagaagagggcggggtaagaatcagataagcacttaggagggcaaggagcaaagtaaatagcaactcagatagcacacactaggcataagctggatttttcaatcataaaaacacctaatacaacgggtgtggacaagtcacagagctacgccgagcttgactgtacgcacaccacctaggagaaccagactaccaaacaacacccacaacaaacacacgcacgcactacctcgccacgactccaaaagagttggcggcgaaacaaaagggcctaacacacggacggctgctgaagactgcctcctctactcctcgtccgtctggctgcctcctgtagtcggctcctcagtcgaagaaacgtcaatcggctgacgcgaagggaccggcggaacctgtcgagggccgatagcagcacgggccgctggcggtgggggagctgggtagtcgaatcggaacacggtggaagaaccaacaacacgcttccgcgcagtgcggataaagtgtgggccacggtgggaggaagcaactggggtgtgtccgggggtgtaggaggggctaactgggtgtgggtagggggagtacactggtgagtacggcgcacgtgagctgggggagcgcgggccactaggagtgcgagcagagccgcgggagctgtgggaggacaggtggctggcgtggcagaggcggcctgagtcccaagagacagtgtcaactgaggtgacaccctcctcggccagacgggcctccagagcggcgtagcggcgggcaagggagcggtaagtctcaaggagtaggtagtgctgagtggcctgagcctccgaaagctcaaccatgcgagtcagcactggctaagactcgctgtacggacaagggtacctggcgtctgcatggccagaaggaaggcgtggaagctgccggaaggcagagcccccgagacggtggctgtagtcgtgggccaagcgacgaagcgcagtccaggagaggtcctggtacgcgatctggagagtgggcctggccacagtaaagtggtgtgggcgaaggccggctccgtgtatacctccacgagggtaaaggtacacagagagctcacagcgagggggaacacggtccacggagtaccccgtgtactcgggacacgagaagccaaggaagcgggcgaggtcacgaagctgagcgacgtggtgaccctcaccaaaaccgtgggaactgaagctggcgttcactgccatctacaattttgaaagagggagaaaagatcagtaaccattttagaaacaaactattaaaaataaggaaaccaaaagaagccttagcttttcgcaagtagttttgaacttagtatccttagggtcgtcctaaacgtcgggtttcgccctagggccaagcctgtgctctgataccatcccttgtcacgccccgaactagtcccgaccggaactagcccgtgacgctccaaattaacctgttaatcgataccagtcccaggaaacagtgctggtatcacaggaagacagaatatcacagcaacagaggtctctttaatatagagaaggagtacagtcatgttgggctgcggacagatcccgagctcacaactgcattacaaaagggaagcggaagccaagacttggaccaaacaacacagacgcgacttgggaactaggccgaaaccctaaaactcaacgtagccggcttgctcctggaagaactcctcgtcagcgggatccgcttcatcttcttcagcaactggggggtagttatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttctcaaacgacacggatgagacagtgcgtctcgtccggtcggagtatgtgcaaatatatcattctttagaattgatcaagattggcacccggccaacaactttcaaacagccacccgggcctagctgatcccatcagctgcagattttccaaacatcgatcccctttccacaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcacctagcccgtggggatcagccacgtcgggagacctccaagctttcatgataaggcatttccaaagccgacacaggtttaccatatgccgacgagaggggtcccagaccaacaacaggttaggtcccagaccatactgtgccaggaagcccaggggtcctccccgacaccaccccgatgaattcacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggttttccaagtcttttataaaacccaagttttacccaagatgtttttcagattttaagtttgaaggcggccgtcgatactcgtgcagagtgcatgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttgaaatataggctcaagatattcaaaggtggcttgccttgctcgagatctagagcttgatcctcgaaatcctcgcactgcgggtcttcgggctccgaaactatacgcaaaacgggacaactcaacaaacggcgaaaataaagccctattaatgacctctaagcgtgccattaaatagatctcgagatttgaggaattttggaagttgaatggagtcaaatggacttacggttgggaagatattgaatttctaagattattggatttttggtctaaaggaaaaggatttacttaaatcctttttttgaaaaagaaaagaaaagaaaaggagggggaaaattagacttccctcgggaggctagggcgcggcccgagagaaaaggggcggctcggccgagctaaatgggtcggtcggcccaacaaggcggcccagagcgcgcgcgcgggcggggaggagagagggagccggtggaccgggctcacctcgcgtggtcctgagtgggacccgcttgtcggtgacacggttcaccgtgcggaacgcgcacgcggcgcgcgctagggtttgggggagggacgcggtgcacgcgcgcggttcgcggaggacgcggatgcggcgggcccacgcgcagcctcacggctcgcggtggaccgcgcccgcgagcggggccgaggggagcggctgaccggggtcggctcgacccggtcttggccgagctggcgccgacgtggcgcctacgtggctgccacgcaggccggcgggaggtagacgacgacgccggccggaacggacggcggacgacagcggcgagcggcgagcggcggagcgaaccgcggcgatacaggcgaaaacgagcacaccgggtggttgcacgggacgaggggagtcgagccaacggctcggattcgccggagggagctcgacggcggcggattgcggcggcggcaaccggcggagagaaaaggggaaaacggcgacgaggtcacgaggggccgattcccggcggcgagagcatctacgcggctacgggaatccgtcccttgcgccggattaggaggaaacgcatcgagggaggccggcgacgagaggcgcttccgagctcgggcggcgacggcggcgagcacacggcgagcggcggcaacggtcggggcggcgccggctagctacggggaggctactcgtgctactacccgagtctaaggggaggaggtggaacgaggaggaagaacggagggaggcactaccgtgcgggcgggcgcagtgacgagagccgacggcgcgaaacgtgatcgtttcggcctcgggccgaggaagaggagggggagggcgcgcccggagtccccttccgcgtccttgctcgtgccggctcctccgacacacgcaacgactaacggcgacggcgaatagagcacgggaggcggcgacaatggcgtggcggcgagagacgaaaacgagggagattggaggagggaggtgcttgggtttataggggcgacaatgtcggtttaggagaggggaaccgacattggacggtcaagccggcgagctagcgcccggctagcggccaaaacgacgacaggaggtgacgccggcgagaggaggaaaaagaagaaaggaagagggaaagggggcttgcctccttgccgctttgggaaaaggaggagggagcggggggctgacgcggcagagggaggaggagctctgcctcctctccttggaagctagcgcgtggaggggcggggccgagtcgatgacaacggcgatgacggtggggcggtttggagcggggcgacgacatgggcggcaggcacgggcaggcgcggcagaggctgacggcggcggcgaccaggcggtcggccaccaccgcacgcgcgcgcggaaagcaacgggcggcgcggcggtttgagcggcacggctcgggcacgcgtgctgactcgcggggccgagcggctgcgcggctacaggcgcggcagggcatcggggccgggcggcgcatacggcgcaggcgcggcacgggcggcgaccacgcgggcgcgcgcacgcgagcaacggcacgcgggggccgattttggggcagggagctcgctagggatggaggcggggagagggagagcgaggggggagggcgctcggcgcggcttacgcgcacgcgcgcgtggcgcgcgggcagagcgagggagagagggagagagagagagagagagagagagccggggagggaggggaagatgggccgagagagattcggcccatcgaacccgagggaggaaaaatagacttttgcggaggaattgatttgggaaggatttggattcgggattgaactcgacgatagatcggggatttgagatctgagaaggcactgacactagacaacaagcaaagaaacagatttcgcaaataggatttttaagagataatttttcccgataggcgccacgacggaacgtgcgctacacttagctcaactagtatacaatgggggaaatcacattaatgcatagacttcaggttctagtgttgttgttggttcaatgccaccgctctggtgatgattaattaaaatatattaaatggtgggctgtgggtgcatggtttggatggtcgcgcccatggcatttaaggaccggttcgcgggaaacccgtacttaccacaagctagcgtgggcaacggctgggcttgtagtgtagctttcctctagctgacgcatccaggcaagggtgagcgtgatggagttcggatgggccctgcgacggcctatgcgacttttggattcacctaggcacgagaggggactgcccactgccttgcgatgagtgggggtaaaacctgaggtgtggtatgtttggttagaggtggttatgcgaagggtcctgacacggcctctttccggtatgtcgtggtggcatatcggcacacgggaacgtgttgtggggctgtgtcttgtgggtacaattgtacacctctgatcagagtaaaactattcgaatagctgtgcccgcggttatgggcgatcgaccagattcaccgtgattagtctcaccctagtttagtctaatggaattgattagttcagatggatgtttgggcctgttgcaacgtggtgtagcattggacagtggatagttaatattgattaattactataaccgttttactgctttcaactactgtttataaatgccagcttgatgcaaaggatcccctttagccttcctttggttatattgcatcataccctccgttccggtatgacttgctgagtacagtgggaagtactcagtcttgctctatctcccaatcctcagagttcgagtatgcgtccgatggtggtttctccgaggagtaggcttcgtccgtgccatcaaggatgcctgtggagtggtgttcccgctgcaatccaagtcaagacttagctccagttatcttttatatttccgctgcatttatataagacttttataatgtttgtaagacgtggatctgtatgtcaactttgtcgtttgtgtaccctggccggtcctggacatggattttaatgcacattctgcttggaattctattcgggaatttctgggcgtgacacccttgatggctacaaggtaacatttacttgtcgctgtgctttgagaagtgcaagagcacaactccactataggaagtacaaatgttgtttatatatcttggttttctcttttctagtgcatagttgtatacaaattaagggcaaaagagacattttctaaccgaattattgactataaatagccatatggcatattaagtgggcccaaggataattttaagcaaaaacaaattcttagaggacctatatggacaaaatgaaacttgaaggattaaattgagctttcgatgaaacttaaaggactaaattagctatttactctaaacttatacttatcagctaaaatctaaattttcaaccttaaatttaattcaagagctgattttgaggttttatcatcgaagtttatttttcagcctttacttttagatcgcaaagaacacgtatataaaggttttgttcataaattacttttcgtttataaacatgccgtttcgcttacgcgtgctccgtaaatagggtactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccctttgtgggttttgcgccgcgtatatgtggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctaacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacgacaaccatacaagtctccgtctgttgatgaaaagataggataagtccccacaaaaaagagagagatggtgcatgtggtatccccttgaggtataaaaggaggacattgcccacttagaagggggatttttcggatccagaacgatcagagagggagagagtaagagctctctggttctccagctcttttgtagcttcttcatacatagatccaccaaaacacaggagtagggtatgacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctcccggtgaggagcctcacgctccgtcaggtacactagccggttttgacaagtcttagcttagatcaccgcaataatctttaagggatgactccctatgttaaccgatcccgcctcagatccgcgctcgtcaccaccggcacaacattcatatccggccgatatggcgatttaatatatgctactatcttccttccaaaatataaggaatataaggagttatattttgagatggagaaagtactagtgatgatgaggaagatacactagtgcttgaaggcttagttgttttgttctttttcccaactcacctatctcgtttttcacatgcacacttttcaaactaataaaggtatgtttttttttacaaaattttattaattcatttttttaaaaaaataactgtaaattaattaatcatgcgctaactggtagtatgtttcattttgctaaattaattaaaattcccaaccctgcaggagccaaacacagcctaagtaaataaagggattaaaattgaaagcgtatctaacagccacagctactagtggcttggtggattacgagtcacgtcagtaggcgatccccggcgtgtgcgatgcgaggttagcttaattagctggtctgtccatgtcgtgccgtcgcggcgtcgccttcttcgccttggcaacggcatgcatgcctccgatcatccgtaaacctcacggcggccaccataccacacgtgcgtacgtacgtccacaccacgcccaacaccgacgacgtcgatcgagctccaatccatccacccccacccatggccgcgcgcttctcttagctggagtaattaaattaagtcgatctccccagcgcgcccccatgcaccaatggccgctcccacgcgccgcctcctcctcctcaaccacgaacccaccaccacccccgcttcgtcttcttcgagttcgaggcaatccttccccacgctgctccccgtttttatcctcttcgtcctcctcctctgcttcctctccatcttcctcgtccgcgacctcctccacttcctctccctctgcctccgccgccgccgcctcctccttcgccacggggaggatcatgactcctcctccgtctccatgcagtcctcagcctcgccgattaatgcccaggcgccgcgcaagccgccgggcttggaccccgccatcctcgcgtccttccccacgctgcgcttcaaggcctccgccgccgcgccggagtgcgccgtgtgcctctccgacttcgccgccggcgacgccctccgcctgctcaccgtctgccgccacgccttccacacgccctgcattgactcctggctccgcgcccacaccacgtgccccgtctgccgctccgacctcgacgccgcgcccgcgccggcgcctcgccacgaggaccccgccgccgttgccgtcgacgtggaatgcgaccggaggggcggcgccggctgaccggtgaacgaccgccgccgtgctggatgacatgcaggatttcctttaattttgttcgcgccaaaattgattttgatttgttttgttttgtttgtggctgcctgcattaccgtgtaaatactcaacgacttgtatcgtccttgtgcattgtactgtcagtatttccaaattgttggaaatgataatgtagagtattccaggtagaattatgagctagtcaccacagcttcagctagctgtttaattcaattgcaagtctgcaatacctgtcaagaaaataaatcaactgtatcaatgtatcagttggaagcttttgcaatgttatttttagccacagaaatgggcggttgccggttggtaccaacaagggcattctaaagtaaggatgccactaattttagagtaatctctctcggtgcatgatttgatacatgagtctatgagaaaaatgctaaccagaaagaggaaacacaatatatatatatatatatatatacaggcatataacagttttgctactaattgtcgcacacgcataccacacagggcaatatacgggtctgctttacaggatttatggaagcaagtacataaaagcaccatagcacgcctcaggtgctttgattcaaagacacaacgacgctgcttatttaataaacaacagcgtgtgagaaactgcttgcgtatcagcaagggacggtaaattatttatagaacacctcctctattcatgttctttgcttttaaagatctgtagaagcccatgaacctcacagtgaactctgaaataattagagtgtttatagttagtagttggtaagatccgttcattctcataagaaaacatagaagactatttcagttcagaactatactgaattggcaggtgaattattttctagtaccttcaatctttataaagcattggatagtttcgcgttggtcatggccctccttggcaaaaccttctatatttatgtttctgatttccaaacccgtgtcgccggattcgcactgctctttttgacgcgcgcaatctttgatctgattacgccgagaagcaagaaaaagaacaaagaataacggttagtatacagcaattagatcatgaattgaaacaactgttactgaagatgcagtagtcatgctaacatggttcaactccgatgctagttgatcaatgctattttggaactcctcatccctgtcccttttcagttcagcaaccagattctgcatttggaaggagacaaacattggtgacaaatactgaaaacaacgaaccctgtttcagagcatggaaacattaggcaaagtggagcttacagagaaaatgaagtaaggtgacacattatgttcaatcagttttctgatcttacccctaatgacatacagcctgcacaagtcgaagtaacaacatttgtatgttttctttcttgagattaaagacgctcaaatatactgaattatggggaaaaaacacatgaaagggatatcctactgttttgggcttggttcctccaagatttttttggctacattggagatttcctcttcccatcctgtcaaaatggcatggccttctaggaaggcatagctgcagttgtgaggggttatttatcgccttgagaaacccaattatagtgcttcttaacaacagaatgaacacagtaccagcaatctactacggagtaacatattctcaatacgaatgatacatgcaccttgattgagcagttatatgcattttttgtcaaaagagaacataccaattgcaattgtttctttagaaaatgaaggaggaacatttttttttttgggaatacgcgaggggcgcatctttgtattaagaaggaataaaagtatttacagagcgggccgaaaaataaaaaacacgaaggggacaagatacaggagtggggaggaggaagaaaataaaagcctaatctcccaacgaatgtggcgaccttccacccgacataggagtcaccatggccggtatcgcggctctagccaaccgccaaaggtccgcttcgcccgtgaggaacatagtatgttataaagacatttctccagtaacgaaccatctactttaaccacagtcaaaacgttgtaacatcccgatattatatttcaagaagcaggaaaggagaggagaagcaatgtttgatgttcttttatctaaaaacaagggagggatattcttatgtgcttactttgctttccaagtagcttcaaaagaacgtattgcctgtcggagattattgcctgagctcattgttattctcctagcaatatcacgaggcagatctatgctctcttgcactgcaatgtactctaggaccttgattatctaagatcaaagacatttttcagtaaactgtccagcattgcaaatgcgaagataaaatatccatataaaaagtacctcatcagatgaaggtggcttaagtgtcacaaccttgcagagatgcctgacagcctcaaggtttgaagcatcagaacagcagaacatgattttattgcatcctacatacctccccagaaaccatccaatataatgttgaagatcagatgagagtttatcagcgtcgtggacgacgatcactgcatatatatgaattttaaagtattaccttggtgtaatggtttgagatcaataaagcttcatttattataaaaatatatatgtatatgatacactagtacatcaatgtaacacatataaataccagaaaataaatgaagaacatgcagttgtgtcaagaaagatcactgtttcatcattttaacaaggtaaaatagtgtcctcatgtacctctgcagttggcatgactgcaaatggagtttggtgatgggatggattcattcaacaaagtagtaatgacatgcttctcatagccgtgtatgtcagccaaatttacctccacatgatgacttgaaatcttcactctgatatcaatgtgttttgcaatttctccctacagtgcgagaatggtcagtagtgtttcattttacactttcctctgaaggagtagtagagatttgtaatggcgacaatgtgcaaaagaataacaagtcattctcatgcaacgcgtaccttcagctcgaatctctttgtctgttcctctatctgtgaaacggcaatatgaagcaagaacaattgtgagcttaaaggtttagataattaggttggttaaaccttgtgcaaaagtgagtagcatcaaccttgagattatcagtagcaaaagcatcccatatgagtgccgacaccatgctcctctttccgacggaggtcgggccttcaaatatgatatggttgcattcttgtgcggtaacctggggggtaaaccccttatcagaatgtcaagacggtagtagtatcactcaatgtagtgaaatatttgactgtaaatgggtagtaaggagtgtgtgtgatgaccatcacctggttgtagagctcaagggcaacgtccttgttgcagatgaaatcgttgaggaaattggggcgatacttgtctgcccagatgtacttgtcctctgccgtgggtgtggattcttcagaagtctgtggcgaatccaccatggcgaccgatttgggcaaaacccggacccagatgctccctcctctcccgacggcgacggcggaggcgctgtggtcggagctctgcgtgctgtggtcgccggcggacacttgtggctcagaagcagcttcagctttggattcagccggcgtgtggtggtcgtggatgcgtttggcggcggcggcggcggcggcggcggcttcctctctctccctcaaaggcctcctctcggcgacggcggcattggctacctgcggctggggcgcctcccggcgcggcggcggttggtggggcacggagctaggggcggtgcgggggcgggtgaggggggcgccgcttctggggatgcaagcgaagcccaagcggtggagaccgagcacgagctgcgacggcggcaggaaggtacggtagcgtcgggcgtcgcggcggcggtcatggtcgagcgcgtcggagagggtggtggccgggggagccatgtgggcggcgcgcagggtagtggcagtggcagcggcatgggactgggggtggacatgagatgagagcggagatgaaaccaatgcggcgcggcggtgtggacgaggggagcgagaggaaggaggtaggcgtggcgatcaacgcggcagcggccggccaggtggtgaggtggcggtggcggtggcggtggcggtggatggtgaccggagaagcattttttgccgggatcattcccatcctgcctcctctcctggcgccggcaacgcctaccatcgccatctgatctcggcccaagctctccatttccatcctattggcccacttcgttatttgggccgcctctggttgcatattcagagaggatttaggccggccttctttcgctgttacttccactagttatttaattattttttagagaagttattttattttattttatttagaggagtttcttaattttatttttttagaagagccttttaaataaggaacttccctgtaaccttcgcattacttccactattattctactgagttgcttgatagaccgtttggtaaggaataagtttatgtctctcgctcttgattgagtcacatccctcaatcataaaactaggtataatgtcgcctctaatattaaaaaaccagtgtagataaactatttcagaggtttagaaagtgttttttcgctgacgtggcaggttgaccacaattgacttgctgagtcaaaaggagggacccacatgtcattgattgttctctctttgagagggctaatgtcgcaaaggggatccatgactaacgagtagtgacgtgaccggggaggagttccgcgatgggcggcgacgaagatgggtgttgtgactggcagcgaagactgcagcagctcgcgtgaactaggggatgacaacccatagcggaggacgataggcgataaaacagcgagacccgaaggtagaagggcggcagtgcaacaatgacggggtagcacacacatctctcgctccgacgtgaccctctgccgccgccaccagtctctacgaatgccatcctatcaggtagctctattaccctctttctttttcctatggagatggcggtgtcccaccctgtcccagcttgatggcctacctccccctgtggggcctccgatgccgccatcgatgctggaaggaagccacgtggaaggaagtggcatggaggtggagttccaggctcaaggtgagaggacaacagccaccgctaccatgagcaccactatgcgcgtgctccttgaacggacgatgacagtaactcaatctgcccccgacgatgttggccacctcggtgtcgccaagctcctaccaccgcatggggtctctacatgctccacctagcttctctgcttccatcaccctcggggagacgaccccctccccatcggccgcctccacccgtgagctcccctttccactaaaggaatcaatgccgatttttaaagttgtttggagagggtattatacatgtttttttgttgaggaaggctattcaggaagtagcaatatacgagaaagacaaacaagaggttgtgttcgggcacgcatgtattattgcaagattaattaagtattaactatttttttgaaaaatggtttaatatgattttttaaaacaacattcatatagaatattttttaaaaaaaacacaccgtttagcagtttaaaaaacgtgcgcatgaaaaacgagagatgtgagttgagaaaactgggataagaactcagcctaaaccgtttggcaatgaccggaaaatttgaagttgggcgatgattttacaggccgattaaccgagggcagtagttccctcagcagtgtccggccttggacttgtgccgcacgcacacttccatttccatttggaaaaagtacaccgaaggtccctcaacttgtaatcgggataaaaaacatcctcgaagtgcaaaaccagatatacgaggtctcttaactatacaaaaccttaactatacaaaaccagtcactcgaagttcttcgatggttttgaccccggttttagtctacgtggcggctgagtcagcgtagaacctacgggccctacatgtcaggtgtccacctcaccctatctctttccccttttctctttctctgttcatctctctctctagcggatgggagcggcggagcggcaaacttggctagcgcgcggcggtcggcggaagagcgcgcggcggccagtacacggtggtggaagcc

SEQ ID NO: 68788 - DNA, 57600 bp, Oryza sativa
  unsure (1)..(57600): unsure at all n locations
agagaaaccaaagggtgacaagaagagcaagaagaagaaaactttggggaagggtacttctgctgtactgatgttgcttagggaccttgtgaccaacggaaaggaggttctttcggtgaattctgcactacttgcagagtggggaaccgagctctcactgttgtttgatccaaagtgtcccagattggtgtcccttgtggacaaggtgaaggagattgttgagaccaatgaagtgaggagattgcctaaaattcccaaggtaagaattatgtaatttgcataaggtgttccatttacatttccttgtttggcttaatctctatgctccaattgcttgaaataaggtttcagaagcatctttttagccagagtgccagactggtatgatttcacccttttacgatgcctgatgcttttctttaatcttgttagggaacacgtgactttgggaaagagcaaatggccataagggagcatgccttctcaataataacaggtgtattcaagatgcacggtgccgtttcacttgatacacctgtatttgagctgagagaaacacttatgggcaaatatggtgaagactcaaagttgatttatgaccttgctgatcaggtattattttcagtcccgctgtacactttaggtcggtaggtgggttaaattttgcactgagcctcaatttatgctggtttttgacttattttcataacattcttgatttgatcagtatttgtgggcatgctacattcagctgctcgattattcatttctttgcattattttccatagcttgtgtgctcacagtcatgatttgatctttacaccaaataatctgcagggtggagagctttgctctttgcggtatgatctgactgttccatttgcccgatatgttgctatgaataacataagttcattgaagagataccagatagctaaagtatacaggagagataacccgtccaagggaagatatcgagaattctaccaatgcgactttgacatagctggagtatatgaaacaatggaaccagattttgaagttatcaaagttttaactgagttgttggatcagttggatataggcacgtatgagataaaactaaaccacagaaagttgcttgatggaatgttagagatctgtggtgtgcctcctgaaaagttcagaacggtttgctcaagcattgacaagctagacaagcaaacatttgaacaagtgaaaaaggaactggtaagtatccaaactaacatgttatggttcgtttatttgatgttactgacttgatcatggccctaactgtttgtcgtgttgacttaggtggacgagaagggcatatctaatgaaactgcggataagattggtgatttagtgaaaactaggggaccaccgctggaagttttgctggaattgagaaaggaaggtagcaagtttatggggaacgctgggtctgttactgcactaaatgagctggagatactattcaaagctctagataaagcaaatgcaataggcaagattgtttttgatttaagccttgctagaggccttgattactacactggtgtgatatatgaagctgtgttcaagggcaccactcaggttagataatttttattcatctctgcacctcatttttaaactggttagtgttttcagttagcccatcattttgtttattcaattgcacacttgataaactggaaatcgttctatatcccttctgttcttatcattcttataattggaaaggatgtcctcgattaccttttttttttctaattgcgtagtctttagtagttgattacaatttaccaggcactggtttatatctgaaaatcttccactttatttgtcatctgaacttatttaacacctttctctgaccgattgaattatagttgcttcctgcttcctgaactaaccctatttcccaacaggttggctccattgctgctggaggcaggtatgacaaccttgttggtatgtttagtgggaagcaagtccctgccgttggtgttagccttggaatagaaagagttttcgcaatcatggagcaacaggagatggaaaagaatcaggtacctaatgctcctatcacctattcattctttgaatgagttgcaataacataacaaaatcgttcctgagttgcagatccgggccaccgagacggaggtattggtgtcgattatcggcaaggacctcatattggccgctgagcttgttagtgaactgtggaatgctgggataaaggcagagttcaaactcactactaggatacagaaccacttgaagtacgcgacgcaatctggcattccgtggatggtgctggttggtgagtctgaaataagcagtggaaaggtgaagctgaagaacttggcagccagccaggaagaggaggttgacaggacagagtttgctcaggtgttgaaacagaaattgagaaacccatagagaagatttttagaatataattttgtagttcatgtttcaacttgtgatgcatcatacttgcctgtgtgagttcctggaaaattccgttcggcgttttgatttatactggctgtttgaattggtttacatgttaaagcgcttggtgtaattgaatcaaattaccaaattcaaaacattactctactgattggtgaccaactcatagtgaccatgcacattattttcgcatttatcagacaaacatcagctactacctactgattgatgacagacaaacttattcttattattctcgaaataaccgtcacacaacaaaaatgagaacgaatttgtccagaaatgcactcaattacaacatcatccttgcagttacagcatacaagatggaaactttactgaactataccacgtttcgctccatccaccgtgttcttcagcaacatcgccaccgtcatggggccaacgccacctgggactggagtcaggtgaccagcaaccttgctcacctctgcgaaatccacatcgccgacgagtctgtaccccgatttcctggttgggtcactgatggagttcgtcccaacgtcgatgacagcagcgcctggtttgatccagtctcctttgatctggcaaccaagaaatctgcagttagaactgggcagtggattgtgatgaaccatgtcataatttggtggtagaacaatgtaccatcatagcctggccagccgctgcaatgacaatgtctgcttcacggacaatactttcagggtttggggtccgggagtgaacaatggatacggtcgcatccgccttcagaagaagcagggatacaggtagcccgacaatgttgctgcggccaaccacgaccgctcgcttcccattgatggtaactccgctccgtgttaggagctccatgcatcccttcaatgaaaatcaaaacatcaaaactgcaaacgaaaactgcagcagcagtcatattctagcattctgttgtagtgtttccataccttcggcgtgcatggtaggaacagtgggtctctgcctttcattgcaagcttgccaatattcagaggatggaacccatcaacatctttctctaagctgatctcgttcaatatcttttcctcattaatatgctttggcaatggaagctggacaagtatgcctgttatgacagcacaagttcattgtcaaatacttgtgattgcatcagaattcagatccatatagatgtagtcatatacctccaatcaatacctcaacattaggcagaggcaaaatctgaagttacagtgctgtttcagactaactctagcttgtacattattaaatggacattaaatctagagttaattgtgtttacctgacatccacgtggttaggaaaatataaatcacactttttgtagacaagctaatagattatatctaagccacttctaagccccaatttttttactacaacatccatcttgcatatgaaacagataaagtcagtccttaagcatgagcaagaaaaataggaactactttgtcgaatagcatgaggagataattacaagtttagcagatatagatcaaaaggacaagctcctgtaatcaactaggcaacatatcttatgtaatctttcaacttcaaatgcctgtatcccgatatccattcaagagcagacttcaaaagatcacacaaatttttcagtccagatgtcaagcaacagaggactggaattgcagtgtgaatctcacgattaagtaccaaccccacattgtagagattggagatatccttaaatagccttttcagtttcagatccaaatagtgaatataaacacataccttaaatccttcaataacccccaaacacatatcaccctgactaccgatgttccgattcgaagacaagatcaagtcaactccaccgtagagctcatgccaaggtaccccaaatcattacagcatcactatgattaccttagattccacctaagcctaatctaaaatcatctccacatctatcccactaaccaggtagtactaattacactagaatgaatggggattattgttcttgtagtaagaacggatggattagatataccatggacggctgggtcggcgttgaggcggtggacctcggcgacgagcgccgcctcggagatgtcctcggcgaggtcgacgtcgacggagcggatgccgacctcggcgcacgccttgcgcttcatctgcacgtacgtctgcgagtccttcctgctccccacgatcaccaccgccagcccgggcacctgccaagaaacactcaagctctcatcatctccaacctatccgccgccgcagccggcgagtgagtgagtgagtgggtgacttacgaggttgtgggcggaggagagggcggcgacgtcggcggcgacctcgcggcggatgtcggcggcgaccgccttcccgtcgatgatctgcgccattgggggtgagacgagattctttttttttttttcttttcgtcgtcgcgattgttggtgagaggtgagtggcggcgacgaggcgacggcgacgggcggcgaggtgggtggattggaggggaagcggcggatgtgggttaggtgactgggctcatgggccccacttgggtggggacggggagcgttttgggccttgggccggacgggccctacttagggaatggggtgggggagcgtttgggacttgggcctgatgggccctacttgggtggggatgggaagggtgtaagccttgggccgtatgggtcccacttgggtgggggacggaaaggttttgggccttgggctggatgggatttgtggaggaatagccgaataggtggatgaatttatgggccggaccgcttttccgatagttttggtttacagctgatgtaaaagctttacttctgacaatgtatttaggcataatctatatttagattcgtagtcaagattctggaatttagtttgttttttcatgctttcaaattggagaattttttttcaaagacctttgataaaatttggagggttgagttccattgaatataagtttgtgagccttttgttttcttttcaccaaatttgtgaatcttttttattatacccggtccttaataactcggtgagtaatccctaagttctatatataagttattttggatttgttctaagttaaaaaaaaaataggtttgattaagtttgtagaaaaatgtagtgacatttacaacattaaataagcttttgaatatatttttatagtatatatatatatatatatatatatatatatatatatatatatatatatatattgtgttggatatattgtagccctttggtttaaaatatttgatgctgttgacttttggtcatccaatttattagaaattctatgcaagcaaatatatatgtcatgcttaaagtgtctttaatgataaaagaaatcaataagtcccaaagtcagtgacaccaaacattaaaattagagggaatactttttcctacagagttagttgaacttagataagtttgacttagtacaaatctaaaataactagagagagtgtatgaaagaataaagttattcttttcttgtggataagaagccttcgtaccttaattgaggaaaaattggaatttttttctttagatatttgaccaaataggatcgtccaatttctatagagcttatcactaaaatacccgataaggctaagcggaatgaaaaggattttatctgagattgtagatgaaaacgagtagccccatacgaggtttgggaataagtgatgaacaaggaatatacatctttctactaaagaggttttattaaactcataactcattagatcattcttatcaatgttaactaggtagttgcgctgccgggctatgtatatccattgtggatgtagaggccggattttaatccattttcttaaaaaaaaaaaaaaggtagttgcgttgccacagctgacagctacaaataatggacagagtgtttaattggtatcaactttttcaagttttggtcagacatttccctactgagcactagcattgagcagtgaacagaagcaactgaacacttggccattgttgatgaccatggatttcttgtctcgagcaaccggccactgccggcttaaaccggcctgcaacccactggtcccggctatatgcttaatcttgcactagcagctggatttcttttacatagttctaggctcttatgtacatccttttgaggtcaggtttttaatccattatctgaaaaataagacttatgttggatgcatgtgtgatgatataattaatcaatggtgggtctgcaacctgttaagaacctaaaattcccttcccttgaaactttttttttaaaaaaaaaggatacatgagaacactaactcttaacttaacctgtagaatagaagcccttctatatctaaagtggatgtacacaaccaaagaaacctaattcctatgtatagttaatccatctatattttggtatattttttgtcactttgttgcaagatgacacaacaacaattcagaaagaattattcggttcccctacgtcgaccagcacctaaccaatttgatccaacatttcagagcatcattaccacagttcattatattgtgatacgatatgtatcgatgttgattgatatcaagaagtagagttatatcgctgtttgggatgaggtacagaaaaataacttctgattaacactaaaatatacctttatatcttgtacctcccaagatcgtaaaagaagtcatgttacttattgctagccaatgcttttttatcttaaaaaaggtgagtggaagctatatcccaattgtgtagatctcaagtctcaactctttttcatcatgttgtcacatcagatggctagcaatagtgtatcttcttggcatatcacagtggtccatggatggagctatccctctgcaatctccattgctgaagaggcaatgatacaatggatattttggaatgtaccaatccaattgatcattctagagagagaaatagagagagggggatgtgattctctctcattcttctatgtggttgatgggtagagggagagaagatgctacaaaaatgtaccaaaattcagtgagactgcctagggagggatcgatttttcggcatcaccagtgttaggggggaataatagcatggagaatcaagccacccaatgtatatatcttcaccatatgccttttagttttttttcactttctagatagtgctagagggatcacatggagatctaacacaagatttggacctgtatgaagatcagattaggtacacttctttttcattatgataatcaactactgcagggaaaaccggaggagggtccatcagggttttcaattttgaaatttctttattttctgaggggggccgaaattttggattttttggctgaaattatttgaaattttgactgattttgaatgaatttgaataaaatttgaccaaatttgcaaaaaaaaaaggggaaaattttgggtgagatatgagcttgccagtgggagacgaaatttcagaaatttcaaaacgaaatttcaaaccctagggtccatcaatgattattactaccttgttagacgttccacactcaaaataaagtgatgggggtagtatttctttaaagtggagatcatgaaaggggttaataattatttcatttccttattacccgaatattgagctaaaatttctgcagaggaatatcgctgaagaactgaagatgatctagctcgctcatgaataaatttgcatatttttttagaggacagcgcaatacctaatatatcacccacacatatactccttttttttttctctcttttgtatttttgtttaacttgagaatatgtcgataattgaaccttgagatgccgcagttttcagataaaagagaagaggaggcatgaaaagggtctctcctatcagaatcagcctatggagataagtttgagagggaaagaaagaaataaaggttccctttgcttgtattgacatcaaagaggctgaggtcaactaggcatcaaaaaaattggccaggaacaaaaacaaggtacatccatgtatctggccatgtaaaacacccaatgcattgcatgaaagaatgcacggtgagagcatttgtggcaatgtgcatgacatatgattgaaagcaaattgctagctgcaggattattcagataagtctttgcaatctcaggctatagctgctccatccataacctcactgaaaaaaagttactagagaagcaaagagaaaagggggagcaaaagaggggagataagtgacatcaaatcatgccttgttctgatcagtgagtgatccaaggagacggcataagtttgtttcctcatcagataatattgctctgtgcatggctttccctgcagtgcattgtttgagcacagttatgcttgtcatggtgtcatgttacatacattgtatcaatcaggggattctctacttttgcagggaagcatttcggtgtgccgtgccctggctacaatgccgacatttaattataaacatgcatggtacaaacgcacccatatacatcctattcctatgagcatctccgaaaaattggaccgatatatcttgagattgacgaagtcactacgggtgcctcgctgctgacggatacgtcacctaccactgaaagaataattagccgtaaatacgagcacccgtgtcaagtctgaacttgaacctgggtggattggttacaccactaaaaaactaactagttgagttatgcttactccgcacattcttgacggtttgatcaaatctaggtatttttttacctatttggaatatataaattctacaaaataatttatttatcgtgatatttttttaaaaaaaataagttgcaaaggatagattaacatgatcaagcttttctcttggtccaaaacccatggcactgatgcatacccaatgtttttgcattgtgttcccttttttaaaaaataaatccctgtcttgtggtatgtttgtgcatggaaggtttatacctagtgttcctttttgcagatataaatccctatgttgaggtatgtttctgcagggaaaggtttatgtcttgtgttcctttttgcggatatgaatcccgatgttgatttgtaacagtaaggtttgctctctccgtttatttttccaaagaatattaggaaatgcaatcatatttacatggaatcactggccaactaatcattttatttcctcctttttggggcaatgagctttgctaattgttataatgccatgttcctctacttgtcttgtgtttggtcaaatggctagtcaagttcaagcatacaatatttagtaggtggttagagaacaattaaagttaagaatcctttcaaaggaaagcaagaaacaaaggacaaagagagtgtaccctctcatggagaagtgttccattctttggtataaaaatttgagatctccagtgtaccaccatggcattatattgtgatcttcctctgttgtttgttactggtgttgctcttgtggaagaacattggtaactgatgtggacaaatcttctccttgttgctttctcttctaaaggaatcttaccaactttctcaacgttgggttgtgcagttaaagctagctggactcaaagtagagcccattgaaatttaatttttctctgaaaaaaagagaggcatttattatgctggtatgtttgctaaacatgaaaactactcccaccgtttcaaaatgtagaaacttctagcatttaaatcttgttccagaatataagaatttctagtaatattcgtagtattacttatcaaatcaattacctcccactcaaagttgctcttattttacccacaattattctcaccttcacacatccttatttattgagtactaaagtattttcttttcaaccttaatctgtactaaacaatttaatctctactccctccgtctcagaatgtaaaactttctagcattgtcatatttatatagatgttaatgaatctagactcacatgatttataccattgtctacattcatatagatattaatggatcgcattgtctacattcatatagatattaatgaatctagacacacatgatttctagcattgcccatattcatatatatagatgttaatgaatctagacacacatgtctagatttattaacatctatatgaatgtgggtaatgctaaaaagtcttacatcgtaaaacggagggagtactaaacaacctataagtactaatattttggaacggagttacccctttcacagaaattaaatagaaaaacaacatataatttgctttaaccatatttagaccctagctataatacgatgtatttttttatataaaagaatattatacaaaaaattctcgcattccaaacagggacggagggccgctatctcgaactgtggtatatcaataattcagctttcttccccagcttagttccatgaagatcttatgggctttgattttgattaaacaagtgaagttggagttaggtcctacctgttgattctgcattagcgttcctctcacattgtttaatttgcatctccaatcaatccattcttttaaggtttatttatagtgtccgttctaatcacgtagattgagcccgtacaaatgttgtttatttttctcttctcaaagtaatccatgcatatctttaaaaggtttgtattggtttctctgtccaaattaaaaatggtgattttgattagctgctcgaagtccattagtggttgcaaaagttcctttccaagccaccacttttatgctaatataattaaaatctaagttgatgattttttttattgcacggtagacgtgcaagcatacccctcattttactaaattcattttgaaaacttatttatgtatggataatattcatgagtatctagatttgaaacccggtgagtggagtcatacatcatgactccaccaccaccatatcaatagtgcttcacaaattatgatgatttattattctttcatgttctccaactttactgaaatattgcaacatgaaaagaattttgcagtttgactgaaatattgagccccaaaatatagttcaaattgagatcatttaggcttgtgctcaaggttaggtcaaatacccctctttgagttgccctcaagttgagacatggcacacatatttacatcaaaattcttgtgtcctctgattgcaatgacattctattttagaggaatataatgtaatattatttcttggggctgctctcagtagagcagacggcagcagttgacattcttgttgtatctatcaaaatatattctagaaaatagaatataccattttttcccttcaatttaaggcagttattcttacaagttgccaataattgaaacagcataaattgcatatccattcaatggtaaaatctcttaggccctgtttgattcagcttaggattattataatctggattattagaagtaaactgaaacaaacaaatagattattatgatagattattataatctataagccagattactataatctaataatcttctctagaggagcttttttcagattattgggtggctaaagacccactacccttagatatctccaataatccagagaaacaaatagctcgcagcttattctatttcaacttattataatacagcttagagtaatctgatttaataatctagtttataataattttaagctgaaacaaacaaaaccttagttttttttttctcatttggagtttatacatttcctttccttggcaaaacaaggtttctgaaacataaagcaaagtgatcaattaagcatggtttcttaattatatcgaaatttgatggtgcaatgaaggttgacactcttagttccacttactatgaccactcaattattttcagctacattatcactacaatatatacatcaggacatccaaattaatttttttttgtccaatacaaaaaaggctccagcttataaatataagtccctggatggatggctacaatgtgagaatatttgtagcaaatgctgcttaattaacacaattaagcactccattaattaactcagtaattaattaactaattaatcaactaatcgatccccctctcacatgacgctgcatgcgttggcgttctcctcgctgaacatgtagtacgacgacgccggcggcggcgccgccgccgccgtcgagtagaggtagccgccaccgccgccgccgccgaaaccgccggccatcgggtagtagtaggcgctgctccggagcgggtgcgccgtgctgtagctcatgacgtacggcggcatgtgcccgccgccgccgccgccgtagtaggacgccgggtagctcatcggcgtcgccggcgggtagaagacgccgccgtcgacgacggcgagaggacccgcgttgccgggggacggtttcgtcggcgcgtcctgcgggcttgcctccactactgcaccggcgccgtctccggtggcattggcggcggcggcggcggcattgccgttgccgttgccattgccgccaccgccaccgccaccgcctttctttcctttcttttcgccaccgccgccgcctcctcctccaccgccattgccattgccgggaggtgcaacgggctgcttaccgtgcggcgtcatggcgaacggcggcgccaccgcaccggcgccgccgccttgcccgtctccggccaccatcgtcttcggggatccaccaccaccgccctgcttgttgccctcgtcatcggacgcctcatcacacgagcccccatggtcgtcattctccggagggacagagccacctccaccgccgccgccggcggccacctccgccgtcgcagcaggcggcgccggctcgccgggctggccgttcgcaggattcttgttcttgttcttattctttttcttcttcttgccgccgccgccaccgccgggagagttggccgccgctgctgccgccggcggcggcggagcgggctccggccatggctcggcgtgcttacccgtcttgacgagcttcttgacgagcgtgtcgacggagacattgccgatgaccaccaccttctgatgctgcacgtctatgtccgtcttgtacacccctgaaaatgttgacgatcaaatgtacaagtgcaaccaaatcagtacatatttgtttcaaatcagtataaatttcactggtttttttaatataaatttgctcaaaaagcattgtgctaacatttcgattcagataatgtaagcattgtatgaccattatgttgcagctaaatttgagacagggagcagagttttgtggtgagtttcagagtatggttgtaataggaaacaggggatgaacataaaagaaattaattttctgaagataaacagtgcaggtctgcaggattgcaaataaaatgatatccttgatgagattcttcttccgtacatgtatcattagcttgatagtaaccgaactgtttgaaatttaataggagtactgtccatgggtaaaagtaaacatgcaaaaataattgtaagaactgaaacacttctctataataggaacatcaggagctatatatgcttatcaaggagcataaatgaaagttttgaaggtgtaattttctcacttcagttctgtgatttcctcacttcaaaaaaaaaagagagagagaggaatctttcatgattttttttttgttgctacaactctaaaatagagaacatttttttgacgatcaacaaaaaaaatgcagttgtatgaagtcattctcttatgtccttcaaaatgttctgataagatgtggtaataactaaaagatttcttcaaagttgtgttttgtttttactccatctataccttctatgctatgtagcaccttcttgaccttcttcttgcagccctcacagtggatgctaaccttcaaagccaaagtctggaggagaaaaaaaggaggaaaaagagcacaaaccaaagacaaaaagaacaccatcagcatcttcctacaagcagaagaatgaccagtagctctgcatatctgccaacaagattgcaagaaccctaaactgcttacctgatacttgagtggctctggaccttcttcagcagctgccatggctggagacagagagagaaagagaagtctgagagagatgatgacagaagtgaggagaagagagaatataatgttgtgctagtgtctagtattggtgcaagtatttgagggagtgaaaggggtcaccaagaagagagagagagagagagagagagagagagagagagagagagagagagagaggggggggcagaacaaagtggcaatgtttggccctgaggagggacatgactaaatagcatcagagagcaaaagggaacaattctattggttttcttttgtattcttttctttttctctttttgttttttgggaggagggaatggtattgatgaggtatttattccccacatctccagatgcccaagaaaatgcattcacaacaataactagccttttatcttctcactctcctggttttgtttgaatgttcaaggtactcgcattttcttttttgcgaccctgtttggaacgcatgaattttcgcaggaaacagttctcaattcatgtgtttcaaatagatctgaaggacacatcttactccaaccggtcgtaaatatttgatgcttagcaaaagattcaatcaaccttttaaaattctgaccatcaatagtttctcaaatatgcttagtttgaaaacaaaagaaatgatttatgtagatttacctcgaaaagtactatttaaatatcataaatttattctaatataaaattaatggtcggaattctaaaatatatatgatcagagggaaactatgagtacacagctacatgcagcgaccattttatctattgtctaaaaatgtattccctccggattgataatacttgtcgttatagataaggacacaatctccaaaaagtaactttaacaactattgtctattataatttatatagaaatattaacaaatatatgattttgttgaagtactttttaagactaatctatacatatggttttcatatttctaagataaatattttaaatatttatagttaaaaattctaaagtttgcttcacccttgtccaaaacgactaatattatcagtccgaagggagtaatcaaacggaatttctacatgcttttcatcgagaaaaagcacagaagatgtatatgcatgggggttgcacttgcaacccagcagcatcacatgcaaagtccataatttgccacacctacatgagaaaaaaggggatgtactatgaactgctatcgcctcgggaattgagggcaatgataagacagacagcagaggaaggccctcccctgtcttctatgctagtactccactccagtatgcaaacctggaagagaatcatattcatcaccttcacatcctcctgctatctatacggatatgcaattatgcacaaaccatgtcagtgaatgattctctcaagatagctgatgtaaacaagcgcgcaaacacacacatttctttgcattgtgaagattcttttttcttacctgctgaagcatggctcgttccagtggattggatgcatcctagagctcttcagattgtgcctgaatgttgatgacaaactgaatttttctctctgtcaagaagatccatacaatgagttttatgaccataatactcaatcttcagaatgcagctgagaggtgatgaactgttcaaagctcacttttgcagttctgaagaatcagaagttcagaacccaatcgtcaagagtgtgcctgaatgttcaaggcacactgagcttttctctgtttttttttcaggaagatccatacaaaccatacacattgtgaccatgacactcaatcttcaggttgcagctgagatctgatgctgctctgcaaattccaactagatgtgatgcaaaaccatctaccttgcaattctgaagaatcagaaagttcagagtccccaatgctcaatgacaccatcatccccgccgggatttcagcaatgccatgaagcaccggagtttcctatccaagaacggcggtgtctaccttgtctgctcctccggccggaccggagctgccgccgccgccgccgccggctgatcgccaccagcgggagcggcggcggctttgcctctccctgcacctccgaaacgccggagttgggatcgatacgaagcacatagcggaggcgccgcagagaacggcaggccacctcgccgcagctgagcggcggccgcccttctccggcggcggcggcgccgtctacggcggagacgacgtggcacgtcgtccaccgtccgatcaggcgcctacggcccagatgaatccgcgagatccctcgagggcaccctgagccactgacagcgtgggcccacatgtcagcgacagaatcgcggggtttcttcctccttttccctcgcgcgattcgaaaccaaaaacgaaaccctcgccgccggggccatcccaatcctcgcggcgagcggcggcggcggcggcggcggcggagggcaaccgattgtggccggtctatcctcgtcggctcgccattccttctcgccgcgccaggttcgatctgaccaattccccaagaatcgttcgacctgaatcgatcgacgccgcgtgttcctgccatttcggcgtgcttgattccctcaaaatggttttggtctagggatcgtgcttagctattggtggcggtgctcctctagcggcgggttctcgacggcagaatagtgcgttgtgagggagcctcggtttagttggttctggggatggaggacggcgccgcggggggcgatgtgtccgccgaccgtgtcatcgctgagttgctcgacatggggttcgagttcgacgagatcagccgagcgatcggtgcagtcggcacgcgctgcgccgatgtgctggagtttatgctgggtggttcaggcaatgggaaaatgaaaaaggcgagtagggaaacacgaagccgtagttgtgtctcatctaatgcagaagcacgcccgagtgatgatgggaacaaattggttaatcctaggaaaagattaaagcaatcgagcattaccgatcatcttgcatcgaataccggctgcagaaggggatcttgtggtgagaaagctagcacgtcatatccctgtttagcggcttccgatgatcctagagcgccagtggcagtcagtgctgatgtgtgttctgcattgaagcctgaatctcaatttttgcttgctaattcaagaagtgagtctgacctcggacacaaaattagtgctgttctgcggaaacactttggattttcctgtgtgaaaggattccaaaaggaagctttggatgcttggtttgctcacaaggattctcttgttctagcagcaacaggctcaggtattctttaaataaatgctttgctctttatctttttgagtaatttgggggcttcctccattgttatgcaactagcagttttgatgtgatggttgagtggctgtgttgccaggaaaatccctttgttttcagatcccggctcttctgactgcaaaggttgtggtagtgatttcaccattgattagtctaatgcacgatcaatgtctaaaacttgcaaagcatgggatatctgcatgctttcttggttcagggcaacctgatagccgtgttgagggcaaagcaatgtctggcatgtataagattatttatgtttgccctgagacagtattaaggtaatcactctgcttttggactgatgatttcctaattacgtattgctgcacttattttgggaacttatttacatgtaggcttatggaaccattgaagaaacttgcagaaaagccagggattgcactttttgctatcgatgaggttcactgtgtttctaaatggggtcatgattttcgaccggactataggtctgctcttgtgttcgatatcctctactgaaggtgcatgtcattgtttacattgttttttctaccacaattagtaaatttatatgtgcaagccttcactgagatgtttttctcttggtactaaaaaactaacatgtgtctgccatactttttaggagaatgccttatattttcttgcagcatcttaaatctctactttattttccacatacaggagattatctgtgcttcgagaaaatttcagtgcaagcaaattgaagttcttggagcatgatattcctttgatggcattgactgctactgctaccatccccgtaagagcagacattatcaagtcgctgaaaatgtcagaagatacagtggtcgtcttgacatcttttttccggcctaatctcagattcagagtaagtcaaacttgaaacttctgaatttgttctgctggtttccatttttatgttctttctagaggatgtgtaaaagcaagtagagaacattacattataatatgctacattaaattgtaaaaagtttaaattatttggcctttctaacagtttagctacatgtaattatgttgaatgaccaatattttattacattttgtaaatagatgcctccttgcaagtagatgggcacctggggtgtgcatttcacttaaaagatgtactacatcaaagatatgaatggttagctttgctagaattgaatctgtattttggactagtatatcatgtgaatttgaaataatcttgtccggggctacacaaacaagtttccaaactgctctattttgttattgcctgatgaattgccttactaaaaattcatagttagatataatttgagaagttttatagaactacctactgtttatcttatgccactgtattaaactgggcttcttagttcttaccctctcccctccccctccctcatgtttctggttgcaggtaaagcacagtaggacctcagtctcagcttacaaaaaggacttcagagaacttgtagtaacatataatgattcaaggaattttagggggaagggacagaaagctcttagtgagatcaaccctgattctgaaagcagttcatatgagtctccggatgatgctatgtcagatgatgaagatgcaaatgttgattccatgagccatgaagataatagttttggaaaaactaaagtcggcatgcccttgataaatgaaaatgctgaaaatgagttggatgtatatccaggagtagatgattttgatggtaatggactattttatatgacttttttcttttgagtggaaattatctgcttgatcctgaaaagaaatactggttacattattttcgaacataaatgtttcacggccaatgcttatgtaaaaaattatcattcttttggggatttaagatcctttgatggaaatcatatgtaagcttaatatggctattggaaattttggaggatatgtggtagcagtgcttttaatttcgtcattttgtaatttcatgtatgtatctgattgacatgcttctcttgtagttacatgcggagagttccttgagtgctcgtggcctgagaactctgcatcttcttctcaatgcaacaaaactggttccagttcctcagaaattgctgatcaaggtcctaccattatttacgtacccaccaggaaacaaactgtggagttagcaaactatttgtgcaaaactggtctcaaagctgcagcatataatgcgaaggtaaatcttctttgattgatttgtgtggcaaatgatacttgatcagtagggcccatttcctgatatatgctaattctctagaagcaatcagcttttttgtaacttacagtacatttgattatatttatttcttaattgctattcacagtcctgtaacttgttttgagctatttgactcttttttcagatgcctaaatcacatttgagacaggtgcatcaacagtttcattgcaatgccttggaggtaataattacttgtttcacttcctagcttatatcttgccactgctaggtgcaatttccatgtgctcatatgatggtatacaaatttagtttgagaaaacagtatgcatgaaaaagtgataatgttagagcaagttacttctctgtagaggcagtcagatgtacttccacagtaacatatttttgtctaggagatcttgaaaatcttgatgtctggtgttgtactgttccatggttacacaagcttacaggttaaccagtgtatttgagttttgagacacttaaaagtttttcaacaatccaacaaggaaactttccacatttctatttgttaatatgatacaatcttggatggatgactgctatggtgactgattttttagaagaatgttgtagaacaaattcattgtgtaccattcaaattcttggttgtaaaagttctctatattttcttcatatctccgtctctttgtgaacccttcaagcctttatcccaactctaatggccttatcctctttatataggttgtggtggctaccatagcatttggcatgggaattgacaaatcaaatgtcaggagaattattcactatggtttcccacaggttggtttaacctttagtgcttcattcacgaaaatacatagaagcctctctaatgctgccaaagacttgctctgactctgatgatggcagacagatttccacacttgaacctgtaggatgccaagctagaatgtaacagtgatggcaattgaaggagatactgtgtgcagtatgaaaattgtaggagttgattatacattttccttcttcttgttgaatggtggagacaatattcaaaaggcttagtgttgggttgcattactgatctgcaacatgcagaaacaatatggcttttgttctctaagaatccagatacatcccaaattggattaatttatgtttatgcttcttttccgtgagttttactggtcagaacttgattgatgcagagtttggaagcatattatcaagaagctggccgtgctggtagagatgggaagttggcggattgcagtgagttgttatactccatagctcatacttgctataattaggaagcttcaattattttcttactacatccaaaagtaagccacgttgtttcgtattataagaaaataacaacttgcagacaagcataatgttacaagtaaaaacttcaattattttcctactacatccaaaagcttcagttataagaaaataacaacttacatccaaaaggcttcgcatgccttatttttattaggaagctgaccgtgctgttagtttagagttttgctgacatcttatcacccatctattccttttcacgctaaaaatctcctgttgttgtcttcttattcaaagtcatcttacaaaccaaaggttgtattaatgttagtattaatgcactacttttatgaataattattaggccttgctttaattttccattcaacgtgtcacttgtttttattttgagatttctatacattttacatgcagctctatattgtaaccttttgagagcaccgacactccttcctaataaaagaagcaaggaacagacaaaagtagcatacagaatgctacgtgattgctttcagtatgtatcgtaaccatatgttcaaattctggtaatgtcgtaatatgtatatttgctaaaatgtttggcaactaaacttgattaatgtttatttatattttctatgttgcagttatgctttgaacacttcaatttgtagagccaaaatattagtaaagtacttcggggaggaatttggtcctgatggatgccgcatgtacttttctctaatttctccatgtctcctctcctttaatgaaataatacatgctcattccagtttcatgtgatgcgaatttcttaatggtatgacagtagtatcacaaatatttaaaagatgttctgtaatattgacatgaggggctgtgggctcacacgttactgcaaaaaatattggtcgttgtggaacttgcatttttaacggctctatttcaaatttatctcatcaagcattttatgagtctaactgacttgtcacctcaggtgtgacatctgtattaatggccctcctcaaatgcatgatttcaaggaagacgcagttatgtttatgagtgtgctccaagctcaaaacgtgagtttataattataaattaccctaaattgtgctgaactgtgatggatgtgatgcccattacaagttgaagtatttttttttctttacaaccttagttatgtgactttgattggtcattttattttgttgcatcctcaagcatatcttaataaatccagggacaagcaacggaagatatgggttgcagcaatataccccgttatatatctggaaggcaaaggtttggggaggttccgaatttcagaggggtggtcagttatataagggaaaaggtttgtgttctcgtgtatttcccatctcctatttatgaaatcgggagcaataagcagggaatttgccttaaggatgcaaaatagattaataaaggttgcatgataggctgatagcaacacaagtatttgaagtatcttttgctcgaccatagctgctgagtagcaatgctaaacctcaaatctgttgtcttgattaaatattgtttatagtttcctagatttgccacaactgacaaggtatggtgggaaggccttgctcgcatattagaaggcaggggatacatacaagaagctgctgaaattgtaagtgatttacttcagtagtttgttgcagatttatagttctttttgttgtgaagctcgtgatgtacctcacacctcagtttatattgttcagatagttgaatgatgggcatactgagatccaagtagggatagtgaatatttctctgacatgagttggacatatgtaatgttaaataatttccttgattaattaagtgaaaatcaattgtatccatataccattaacatgtttaaaagataacccatgaactacatgatttgctttgataaaagaaaatatagcatgcatctctagggactatttggaggattgcatcttccatcatttttctactttagttcagagattgaaatcctaaaggtagcctgttaactatcatggattattgataatcaccaaaactagcttgttactgacatcaaatggacacaaatatcaaccctgaactacattcagttttcagaaaaccaacttgcatgtgttttgttcatttgtaatggataagcccaatctagatataacggttgtatcacatggtcaacaaattcaattcatcagtggatcatctatgtgtatcacaccggtactgcattattgagtcctcattgctttattaaaaggacagataatcctgaatagagccaggacaaaatgagttgctaagaaaaaaaaactgcttatttgtttccaatattatttccgttttatcccccgactgattaatggatccgctttcagcctcgtgttttaatccagtatcctgaggtgacagaggccggactgaactttttgagtatgcaatcagaagaggaaggtttatatgaataccttaatgctgctatgctattggtaatgaatgacccaaaacctatttctacatcttccgagtggggcaggggttgggcagatcctgcgatacgccgccagcgtctagcaggcaagaaaatggggagaagaaaaggaaagaggcattctcggagccactctacaggtttcaccactgcaagacagagattagctgaaatactctcaaaacgcagaagataatacagaaactattgagatgctgggatagcgggatgaaaattattcatctaagcctgttactacttgtttggttttagcttgatttacacagcttctgtggttatttgctgcaatttcctttgtggcgtatgaattttttttctcaagggaacaatatgaagtaaaaaaatgatggggattattgtatagcactgttttggctacccatctgaacattgacactccatctgaacaagaatttcctgatgtgattttaaggaggtacagttccgttcccagatattattgcccaaggctgattcatctgaacagtgatggcatcacatcagttttcacatcaaatccccgtagggttttgtcaacaatgttcactctcacttgtgatcttttcaaccaacaggtggatctgtgtggatcctggagtgccaaactggaacttgtttttcccaatggatggtccagttaactccaagtgttaggaagatatatctgacaaggtgattgtgttgtatactgttttcatactgttcacttgcctgaaatgaaaaattgtttggcgcagagctgctaaaccctacctcgtggcagtaatgcaattttttaatcctgccgacgagtgacacgagtacgattctggcactgtggtgttttgtttttctctccttttttcgacatggcaattggcactgccacggagtatggtctcacagtgttaaagatgcatacggaatataggagtagagctttgttatagaatctaattaaactaagagtaaattatactcacggtactaggtgggtgcaatgaaaagcctgagaatgaaacagtgtaataacttgacaagtgggtgtgctctgatacaagaacttgagaatgtaacgtctaagtgcaataacctaacaagcgggtgcagttcaatataagaatttgataatttagtattttggtgcaataagttggcataggtatgtactactttgattaagagtgctatgtaagttgtttcacgatatcaatatgtcattacatagcaatgttttggatattatcattgatttaatctgcaagaattatgttcatccatttttagagtcgctcatccaattttcaccatcggttttgaattttttttttaatcttccaccatctcaacttaaaaaatttctacacaataaattttgattgacaaataagcatgcttatacaaatctgtataagtaaattaacaaaacaagtacttagaaactgaatgcgtatagccgaaaaatcttatgttattgtaccaaaattacgcgcacctttcaaattgttttacccatacgttcacttattaagttcttgtatagattgcatccgcttaacaagttgttatacatgctcatttctcaagtttttacattaaattacttccacatgctaagttgattatcgggaatgcaatttatcttgacgtggtagtgttattcttgcatgtaaagttcaaatatgaacttacatgacatatggactttgtttaaaaatagaagtctttaacactgatgtactgtactaaatttatgtgaagaaccaaaaacgtaaagcatttgcttccaccttactacacaataccagttttgatctcgaggtataaaagctttgaccaatactcctactatttttcagagtactcaattgtgaatcatgaaagtagtactcctatcatttgattcccaatcaaaagcacttcactatatccattcgtttagcattttgcttacctttcatggtcgaaatttgatccatagctctcagtcaaatacatttacacaacaattacgaccaaaacttgaattttaaaacttaatgttaaaactgattctgagatccctgcattagcttctaaaatgaaaataatacatatataaagctttattcataaattattattaaatttaaactttttggtaaaaatttatcaatataaaattttactttgttcatttttttttacccaaccaatcagacactaccacatcccctagctgcttggaagcacgttactacacggacgcggaaaaaaaaaggaaaaaaaaaggtgcatgtgcatcagcattattaaattcactgtaccctctccaaactccaaaggccatcacgcatcaccaccttacgtatatcggtaccttttatttaatcgttcccaaaaaaaaattagaaatttagaagaaagaaagtgaaaaaaaaaagctggacaagtcgatgatgttttcgtgaaggcaggcctgaaaaaggagccgggcccacagtgtcagaccaaagagaggagaaaaataaaaaaaagcaagaaacacaagcctggggcagtgacgtcacccaggggtgttttggtaattttaccgtgcaaatgatttggtcaatcggatctggacatccgggcccacctcctacctcccatcatgcactcctctccctttttattttcccctcattttttaaatcttttttaaaatggatagattgcacttggggtgtggagaaaaggggatttaaaatggagaaaaaaaagttggaaaaggagggggttaaaaaaaaggagaaaatgatgggcatcatgagatgggatgatgcattgcagagtgtactaggcctgcctctctgtagccttttgccggccaaaaaaatgggaaaagtgaggggctcccatgaaaagagcagatggcaggatgccatctaggatcatcgatctctgcctacaaaggtcatcagattctactactactccgtatgatttcataatagcatttgggttttatagggtttggatgagattcaaacttttggcatcatggtttctctggatatgatttcttggttagcatttgactaattgctctcttacatccagtgtaagatatccgatccgagctatatagtcaggctaccagatgacggattatcgtggacacacttttaaagcttatgatatgtttttttaaaaaaaactttcaccaaactgatttgggtagagttaccaccccctcacggtttgtggttatcgcgaggtatatcatggttttaaaaactgataaggttaccacacatgataaccatgcgataattgtacggtcttgcaaaccctgtcctgttattagcttaggtgctacataaatattgtaaaaaaaattgggtaggaataaatttttaaccacggtaatattatcattcaaaatataacgcggtaaattattattggagtgaagtgcacgagcggtccttaaacttgtacggatatattatctaactccctagactcttaagatgtattttttgataccaaacttgttatgggtgtcatataggccagacatgacatgccatggtgacgcctatgtgttagtgggatccacatgtcaatcgcatagaaaaagtaaaaattaaaaagagaggagagatgagaaaatatatttaaattttgaaaaaataaattaaaaagagaggagaaaatgtgcgttcttaaattttctatatgtgattgacatgtttgttccattaacacatagacgtcaagcacacaaagcaagttgaagtccgtttggatctaaatgacactcaatgaaagtttaaaaacctaaaaatacattttgagagttcatcagccttagggggggcttctggaaactatagaatcagctcacctaaatagtccagttttttttctagattctgaaaagctgtagttatagaattcaaaaaaaataaactataagttagaagcttctccacattttcaccagctaacttcttactggttgtttctcataatctcaacctcccctaaacaagaccttagataacacacatgcacaagtttgaagattacacatgcactttactcttaccgctggcaagatataaacggtgacactgggccatgttcgtttcttctgcaagcagaagattaaattttggatactcgtggcacactttttaaacggttaaaggtgcgtttcgtgcgaaaactttctatataaaagttgctctaaaatatcatactaatctattttttaagtttgtaataattaaaactcaattaatcacatgttattaccatctcgttttacgtgaaacacttaatttttataaacattttcatcttcatcgtctaacgggagaggtaccccgtgtgaccagtttcatctcggcgagcaaaattatgacaagccgataatttcaaactaaatatactctaaagttttttagtgaaaaaaaaaagagaaagaggttgcacgttggaccggtcttctgaaaactgcaaaaaggagaagtgaaaaaacgattcaggaccatctccaaatcccgtcagtaaagctaaactcttaacggtgatgagcagtcgaacagatcagggaaaaaaaaccctgcaaattctgagctcgcggtaaaaaaaaattcaacccggactgacctagaaaatttacagcagtactcccagttactctggctgcttctgctgctaatgtttgatccgatttgatttggatcgggtttaatgttagattacgcggttcgatggcttaattaagcattaattagcttaatgctgggaccagtgcgtgctgcagtattttttcacggctctcgaagattttgcaaaacaccacgtacttcgagatcaccgtaaaaaaataaattatgagtaattagcaggaccagtaaatattctagttctgcccactgacatgggccaggattaattaaaagataagaatggttatgcttatcatctgatggaatactatattagaggggttaggacttaagaagtggtatattttattttatgcggagaaaaaccttcttaatttacagcagtttatatttaagatgtaaaattcattttcttaagtaagagggaaatgcaaagtgcaaagtagataaatgtgaaaagttttaatgagacttgtttttaaatatttaaaatcagtttccttaattataaatgggaaatttgcagctaacaaaaagtgttggatctttgtctagaagttatatttaagatgtcaaatctttttagtttttattgcattgttccctttatagttgcccttaaaaccattgttttcctttgcattttagaaaaaaatattgttaaaagtgtaacatagaactttttatcctaacaagtgtgcattgaaaaaaattatcactgagtacattttaaaattgacaagtacgttgggctcagagtaaatagtctaaaaaaaatcctaaaacacgatactaacccatataccgatataatctccgtaatacaatctcaatgcaagtttcctcttacattagtcaaaatatctttagatgctaactaaggtatatatatattttttaaaaaaatgatgttaaccgagattaacatttgcatccctctctctttttaccgtgaaaagttgttcgtagcagcgagagagattggtttgcaacagtaaaaaggcggcgagaataaaaacttctcgagattgggatttgagagagaatgaacgagcgagcaagcaatcaggtcaaaaaaggagaaagtaaaattcttttggttaatttgtattttaaaattttatttttgggggaggaggcaggccgttctgtgactggggcagtaaaaaggtagagaggcccatgcgcccatcacatgctgccgtggttgcccccactctgtggtgggaccaccccccaaaataaaccaggatcttctctaaacaatgggctccaatggtctctcatgtaccatgggctactatgcataaatgttggaatttataatgacatttatataatgtaattaccacttatgatggaaagaagtcatgctagttgttatcttcatgtgtgatgtgatgagctagttaaagatcatataaatggtgatgaggatccacctataatacaaaaatgatatagacatgtacgataattggaaattctatccaaagatgggaaatcaggaaaatataagcaagaatattttaagaaataaaataagaaaaatacgaattgactacaatggatcaaaacaaatcgagaaccaagagtatgtcaattagtcgaataatctttctcaaacccaaattagtttcatctcgagaggatgatgtgtttcctataccactaaatataattaattctaattctcttttttcttatgaaataatatcacctcaattgctttcatttagatcaatttatctatggtgcaaattgtccatatatctcatgagccatgcatatgcatatcatcttcattttgtctagcttttttttagcacaatcacctcaactcatttttagcattcttttctcttatgaagcgacatcgcgatatcatttatatttcaacagttggatgttctatttagatgttattgtgtaaagcatgtgaaatcaaattgtcaatgtacaaatcaattctatattgtacataatgtttacatattattatataattttccgcataaatgcgtggggtttcatttagtatgtacgatgttcaagtgaaattgtttggtttgtaacaagaaagcatgattataaatatttttggtgtcaaacaaccggacatgtgaaaatattgacaataattggatgaagataaatgttcatagagaattaacacatagatgcacttgaataaaaaagaaacttgcatgacttggtatgaaaatataggttaagaaaaggggcaccgatattgtttatggccaatacaccatatcatgattacctttattgttttttgtggataagaagtgaaaaccaacattcttttggtaagtcaaaataaagttatctatatttagctatgctacacctcgctacttttctcgtattatgccccaaatacaataatagtataacacatatgataacattagattgagaaaaacaacaatggcataaccaatttctctaaacaaataaatgacattattacaatccataatcccatataacactaagaattgagtagcaatgatcaaatatcggcatacttgctcatcaccataaacctaacctaaacacacagctcactccacaaacaatcccatcacaattggtccaagctaagaacaaagaggcacaccccttcctacccccactcctatcactattcatcccaacattttcacctcatcatgctcactccccaaaaacttacccactgaaaaaagcctttcagcacaagtaaataacactaaaaataaaaataaaaatagaataagtattgaggcaggcagagagtgatcacctccatgagatgagcaagaaaaaccaaatataaaaataaaacaaaatttttattcacaaaacaagtgagagaaagagaaagagaagaagaagaagagaagtactactagtagtagagaagtgagagcaagagagaagagaggagaagaggaggcttcaccttcccaaccaaacccaacctcgagcacaagcggagcagatgccgccgccgccgccgccgcgcgcgccgcgccgcgccgccgggtagctcagcgcaaaaaagccacagccgcccgcccgcccgatccgttgcagcatggggcgcggcggctcgcgcgcggcgtgcgccgccgcggcgccgccgtggcactcgctcccggacgaggtctgggagcacgccttctccttcctccccgccgccgcggacaggggcgccgcggcgggggcgtgcagctcgtggctccgcgccgagcgccggtcgcgccgccgcctcgccgtcgccaactgctacgccgccgcgccgcgggacgccgtcgagcggttcccgtccgtgcgcgccgccgaggtcaagggcaagccccacttcgccgacttcggcctcgtcccccccgcctggggcgccgccgcggcgccgtggatcgccgccgccgccgacgggtggccgctgctcgaggagctcagcttcaagcgcatggtcgtcaccgacgagtgcctcgagatgatcgccgcgtccttcaggaacttccaggtgctccgcctcgtctcctgcgacggcttcagcaccgcgggcctcgccgccattgctgccggttgcaggtgaggtggagagtgttgtttgggtcaaatctttttagctaaataagcatgggatctttgggttgttcttggatttgagaggaatctttcacggcccaagctttgattcgtcttctttttagctaaaacatgacagatttcttggtgccatttctttcttcacagtgttctttagtgagttcatggtctagctgaagtgatttgttcttccatgattcctatattaactttgttttgaacttcattgagtagtatgtggaagtagatgtggctttctgctaagatttgatctattcttggtgtttaatttgcaaagggacagtttttttttctgtttacttgtgtatgatctggatttacttttggtgtttcctaagttgaagaccaagaagtcttcttgtgacagtattttagatgcttataacgtgttaatgtcaaaggaatgattcccatgaaaattctgctgtgatttgtacattttattaggagttaagtaacagagtgaattgagtgatgctcacgtcttctttaaatcttagctatgatttgttcctaggaagctttgacttgtatttgagtgcctggtttgcgaagatgtgattctcttgcacggatctgtgtgattgacagaagaaatatttctacctgtttaagcaatgatggatccatctctttgtttctttttgtgctttttacccaaaagaatgggatatttcaagtttacaaacaactggtgatgcgcctttataattttgggcttttttaaaagaatgtattcttcccatcatgagttactagatctgagttgaactgttttcctttatattttcctgatatttaagtgaatttgttgagttcctatcctgatttgaacttccagattctaaagaaccaggtcttttaagcatgtttttgtcatgtagattcccagtttatcccctccccctccttttgtgctcaagaatctactaccttttatcttgcttttggtgagggaaagtgatttttgctccaatatttgtgatgtcctcatgtaatggacagttaaaacaaacagatttgttcttgcgagtatcttctggactccccccagaaaagaattaggaatgtgtgggattcctatcattggggaatttatatcctaaaccagatagaaggatctaatagtgggagtttcgatcctgattcatccattagtagtagtttaatatgccaaagcagtatcatttgcatcattttgaggaactcgaaacagttgaactgtgaagtttaactactgtacacttcaaacaggcagattagaataggttgtgagataactaaatttggttcggtgatcgtataaggccatattcttggatattaggacgaaatgagcctgagcaccacatgtgtacttgctgatggttgagaacttagcatagatactagtttttatgctagactagagggctactggtacattcacttgtttgataaatccagatgtatttaagttttgattcaaaatattttgactctagattggagactacattttagagcattcaaaatttacaatggaagcaggattttagcaaaactattttcatacatttactctgttattgagccagaatcattttttagttcttgctacttttttgttaacactgttatgcatgtaaactcagcgttacatttatttcaattacaaggatctacacttgtagctctgggtgcagatggtagttaacattgatgaatcttagctatatcgaaatactatcttctaagtacaaacttttcttgtgtgattcttatccttgttgttactgttgctacttatatccattgattgagcatgctttgaattaccttaagaatttctctctccagtcaaatttatttgactttgagagaactgtgtttatttctcccaacgtcaaatgttttgaattttgaatggacagagtatgtagtagtgggcagcacattggtgccctagctgcaaataaaaccttttttttttgttaaaacaatgattatgaggatgtcggtttacactgtccactcagaaatttgacttgattatggatagggtacaccttgttgttttagatggttccttcttaacaagatgctagattttgatgatttgattctttacaaggagtagtctaaaatactggaagtgtcaacttaaaaagttcaaacttgccctagccatacgtgatacattagacaactgatgtgctgtgttatctgcaactgacaattattgttgttgctatctcctttttttgctttagagtaggcaggtattttgtgtcaactaaaagtgtgtttcacgtgttgcctttcttaataccttttgaataatagggtataagaaaattttcatgaatggtttgctttccaattgttgatgttgctttccttcaccttattttttaaaccaccatgattaatctatttatctaggtaatattgctcatgctgattcatgatacgtggtaaaaaaataggtcttttcaactttcagaggctgctggactccatttatttagttgattttgatccctacaccgattttatccattggtttatattcactgctaacatatgatactcgctatcatttacttcactgttgatcatcaatgttttaattttgaccattattaacttttatatgattaatttagtattaatgaaagttgtgcggttgtatttatggcatgacacacatttctaacatggcatacttttaagcatacataactttttttgtaaaaaggacaagcgatcaaaggtaaaaaggtgaatagcatacagtgagaagtatttgagaccaaagggagtataatcattatctactaaacaaatacaataccattcattataagctgagttcgcatagtgtaattgaaagtggggaatgctagtatagctcacacatgaaatcaagtccctgtgaaatgatagtaaaccctacgtgttcattgttttagtcttatgatatgttccagttatgtttgccatggttgttgaatgcagtagtcaaagtttgcttctgtttgtttgagtggattctcatttaccttgccttttccaccatatactcatatgggctttgtttcacaagtgataacattggttaatggctatatgctatccttacagtttcattcttcttttaagatatgagtcaccatgcacatttcttcaacttctgattttgtctaatattgcagacacctaagagaacttgacctgcaagagaacgagattgaggattgttctattcattggctcagcctcttcccggaatcgttcacttctctagtaactctaaacttttcatgcttagagggggaggtcaatatcactgtacttgaacggttagtgaccagatgtcacaacctgaagactcttaagctcaacaatgctatcccccttgacaagcttgctagcctccttcataaggctcctcagctagttgaactcggaactggcaaattctctgctgattaccattccgatctgtttgcaaagctggaggcggcgtttggaggttgtaaaagcttgagaaggctttctggggcttgggatgctgttccagattatctgccagcattctattgtgtatgtgaaggcctcacatcacttaatctgagttatgctactgtgcgaggtcctgagctcatcaaattcattagtagatgcagaaatttgcaacaattatgggtatgcaactcttgtcaattcttttttactactatgtattcatcccattcgaatctgttaacttttgaaaaactgttgcatatctctttgcaatacaagcacttgattccctacaagtggattttgcaaattttttcttttcttctggacctccagtaaaaaagttcctgatgttttcttacttatcatggtcactagtaaaagtccgactacatgtattcttttttcacaatgtagttttatcaattatattggtatagggctgcaatagcattttatgatgaaactgactgcacttttcccatgacaacaagaatttgtggcttggaataatctattgagtgttaaatcatgcatatgtttttcatgtttgtcaatacagttttgtaggatgcatgttacattcaatggcatgctgttgggtgcctccaatgaatagattgaaattaccactcttatcttttggggaagtaggatatttatatggaaaaaacatagatgacaatggtatcctatccttattagaatcattgtgaaaagactgccagatgaatccatttgctctagggcagcattctttgcctttcttggcaaactgagttattgtctgaaccctcatagtttccatcctttaactgttaactgctagatgagttgcttgctctacggcagatattttaaactgaattatgatctgaaccccaatggctattaacctggtcatgttagctctttatgcaatcttttttctctatatttttcttctaaaagttaagctgcaatttttcaggtgatggacctcattgaggatcatggtttagctgttgtggcatcatcttgcaataaacttcaagagttgcgggtcttcccttctgacccttttggtgcaggattcttgactgaaagaggtcttgttgatgtctctgcaagttgtccaatgttggagtcagtgctctacttctgcagacggatgacaaatgaggcacttattaccattgcaaagaaccgtcccaacttcacttgcttccgcctatgcatccttgagccacacactccagactacatcacacgggagcctcttgatgcaggtttcagcgccattgtggagtcatgcaggggccttaggcgtctctctatctcaggccttctcacagatcttgtgtttaaatccattggggcacatgctgatcgtcttgagatgctttcaatcgccttcgctgggaacagcgacttgggcctgcattacatcctctcaggctgcaagagcctgaagaaactggagatcagggactgcccatttggtgataagccattgctggcgaacgcagcaaagctggagacaatgcgatccctttggatgtcgtcgtgcttgttgaccctgggcgcatgccgacagcttgcacgcaagatgccccgccttagtgtggagatcatgaacgatcctggaaggtcatgccccttggattcgcttccggatgaaacacctgttgagaaactgtacgtctaccggacgatcgcaggtccaaggtccgacacaccagcctgcgtccagattgtgtagggggcagtatgtgcggtatcggtatgcgggtgttatggaggtatttattttcaatctcgattagtaccttcaaacaccttcctcgcataacatagaattgtttccttccaagtagaaaggctgatggttggatagacttgtcatgatctctactcggctacaaaactgttgcaggtgtagaatgaaaattcacagcctttttcaggtgttaataactgtaggaggagactggatgaattacagaaaactactagatagcatcatgagaaaacttcggtttgttttcttagcgtgtttagcactttgtatgtataaaaatatggcatccatttgtactgtactagtggaaaatttgtatctggagctgagctttgtcacttctacttttttgacctaaattatgaattgttgttgcttcagcatgttgtgaatgtttaataattattggcctgtgctgttcatcatccatttgatattactttatttgctgcaaactgtttaacatactggcttggtgataacacttggaagctgtgcccaactatattcaggctcaagttcacagcttgaagccttaaacctcatcaggacagtatgaatttgctccttaattactgtacttgtttactctttgttttaaaatacaggacatggaaatgcatggactctagataatactcctattttaaaatatagcgatctaggacagattaggggaccgtccagatttatatcacaggttgtatctaatctgatctagattattatatatcctagattattatatttgggttggagggattatatgatatgcataagcaagcaatgaacctggtaaaaaataattgattacctggctctacccagcttaagaattgattacctggctctacccagcttaagataagcagaaaggggaaatgatgaggggatcttcatacagctggagcaagtgtcatttgactacttgtaagtacatgtaagttcatccactttgttagggtgtgtttagttgaggaaatgaaaatttttggatgtcacatcggacgtttgaccgaatgtcggaaagagttttcggacacaaatgaaaaaactaatttcataactcggctggaaaccgcgagacgaatcttttgagcctaattaacccgtcattagtatatgtgggttactgtagcacttatagctaatcatggactaattagactcaaaagattcgtctcgcgatttcctccctaactgtgtaattagtttttttatttatctacatctaatgcttcatgcatgtgtccaaagatttgatgtgatgtttttgggaaaaaaatttgaggaactaaacagggccttagtagaagaaaacctgcgatcttcaatgataactgataaacaattccaaaagggtggtcagtgctgcctagcttagcttgatactaggaacctagcacaatatattttggtcatgtttgggggaaacaaagatgtaattatcagaatctctcctaaacctaaacagggcttttgcttctctactacaccttccatctcaaaatataagtttatttatgtattctgtatttaacgggtgatcgtccgttttatttaaaaaaaatataaaaaattaaaagaaataactcacacacaaaatattatacatgtttttatcatctaataacaacaaaaatactgatcataacaaaattttaaataaaacggatggtcaagtattgaagacaaacccataaataaacttattttggaaaggagtggaaaggagggggtgtagtaaaacaatcgcagtaatgtactttgtggtagcatcttgcttgatctgtctctagctgtgactgagtcatcatgctcaaagctacctacttgcatctgctgccttgcatggacagcttgcttgatcttccttcatttcgcaaatctcgacacatggataatcccaaatgtatctacttcataaattgaaaagaaagtaaaagttatattcataggcaagcaaatctcgacacatgaatctcgggaaaatgggccgtatggaatagcacaacctaaaacgaagggtcaaacttaagtactactactagcatgagatgaacacaatcattttggccacaattaattatagtgggcactttgcttctgactaaggcatcgttcgtttaggggtgataggggagattggctctcgtttgccgcgcgtacgcttttcaaactactaaacggtgcgttttttacaaaaaatttcaataggaaagttgctttaaaaaatcatattaatctatttttggaatttaaaatagttaatacttaattaatcatgagctaatggctcacctcgttttgcgtatcttcccaatctcctcaatccccttctcctcaaacactccctaaagcttcctttggccacaattcggtcaagatgcaactttgacctttaattccgattgcaaattatctcaaaaccccaatgaactataacaccgtgaagtactttagatataaaagttggatatagttaaaagtatttgatgtttgaagttattaaagtttgacatggaattcaaaaagcaacttgttttttgacaggagagacctatagtaatattgattaaggcttcatcctaaatggatattcggttcggctaacttcacaatttgtagaagtttcttttaaaaaaataaaatatatctttttaagtttgtaataattaatacccaactaatcatgcgttaatagcttgtcttgtttcacgcgttgccgataacttaaggtaaaaactggtttgagtttaagcctaaggtctgatttaggagagtttatagcagctgcaggttctttcaaaatccctaattcccaaaacaatctgaattcttatatagttatagaatttagtaaataaattagaatccagaaactaaaaaaatccagttgttttctagattcttagaaacttattaccaaccaatcattactcagaattttaagctctttaaacataaccataaactcgacggtttcttagcttctcattaattagatactaacatatgcttatctgaatctccagctctaaatcattctaatgttcttatttgtttcattattagataatagtactagtaatatgatgagaaatgaaagcggacaaaaaggttagcaaagccgacacaccccttccctcccttccatagttccattcccccgccctgacctcttaattactccctctctctcacactcacactcccctactgctctatgaccattcctaacctaataactaggataatattaaataaactgacatctaggataaaaaataatatggcaagtgaataaacgagaaaaaagaagaaaaccatgtcttggatgagacttagtttctacacaatatctaagatatcatgtgagataagtagcattaaatttaagtatggaatagtggtgtttgcattggaagagtaatgtttagtactagtttctcgatgatgtggagtttatagaaactatgtctagtgtcttgggttgagaataaccttaattctatcactattcactcctactcctctagtagcagtggttagcacttagctctcgcctaatgctgctctccgagcttaagcttaagctcaagcttaacccatcctcctctcctctcctcccactcgctctctctcccgcagcgtcagccgctttgccgcactagcagcagtagctactactaccaagcaagcgtagacgacagcagcagcagcagcagcctgcgccgcgatcccacccacccggacgaggaggaggaggattttttccccctctctccccttcgctttcctggagcttgaaggatagggatcgaggaggaagaagacgaatcaagaagcaagcaaggttggttttgctaacctctcgctgtgcttggggtttgttttcttgattggcttcttcgatctgggtgacggggggtttcgtcgatcttgttggtggtggtggtgagggtttcttggtctcttctccggcggcggcggcggccatggcgatggctgggctggcttcgtggagggtccggctgctgcctccgccgtcgcgggattttgggtgttaccccagcgcctgaatttgattagtgtgtgggtttaacttcaattaatcatacgcgaatttggtttctggattttgctcttcgtccgggctgtgttcttgattttattttatttttactgcggcgttgcattgattgggtggagctgaatcagccgttcttgctgtcctccggttgttccattgactccgctgctccggtaccgatgagctaagctgtgagccacaattgttctggataattgcattgatctcgttcccgtacgattgttaccgcgaacgctagcattcggtttattgcgtctcttaaatccgagaattatgtcatcatctgcagcattgcgagtacaaacagatgacacttttcctctttatttatgtagtactgtgttgcagcaagaagaggatagcaatggcaaaagagaacttagagagagagagagacagagacagaggagatagtatgagcaaaagcagttctcaactctgaacattgatagcttcatcttcatagcttgatagaattatatccgaggtatgtgcctcttcgcgtcatcggtatatgctgtttttgtatcattgagggaacaagatatgatcattctccaccttttcgggttgcaattaccgacctgtaattgtgacgtagtttctgagtgcatttttttgctttcttggtgtgcagcttgcaggcatgtacaagaaccagcttcaggagcttgctcagaggagctgcttcaatctgccatcctatgcgtgcatccgcgagggtccagatcacgcgccacggtttaaggccacggttaatttcaatggagaaacgttcgaaagccccgccttctgttctactctgcggctggcagagcatgcggcggcagaggttgcgctcaatgagctgtcgaagagagggccatcatcgtcacttgctgcaaaagttctggtaggttctgttgatccctccagaaattgattctcaagcattatgatatggaaatcagttgcatgtcttgtgtgaaaaacttttgcatttgtcatcttgagaaatctctggtatgttttgactgacatcctggaagagcgctaaccttagatctcattgtagttctatgtagaatcagagatttagtaacttgtcatggatgtttttttgttgataaacagataaagtgcttgaaccaggggacagttaaattgtatcctttcagctttgccaaataagattcatgtcacatgtgtactagctagcagatcacctcagattgcatagttgccaatcatctattgagaaccacaaaaggatatcactgtcacatcatcatgcttgttagtaccgaaaaaatcagattggcataggaagttgaaagtaacagtcatcatcagttctctatttaacttgttgtagcttagtttgatatggtaagagtgaggaattgtccatagctcaagtccataactcacaagtcacagttagactttttgcttaacatgctagacttactgacatattacgcatcatctcattgctttatctgtaaaaatacttagttcagtccttgtgctttatttgacaagttgtacttgctgatgctattatggcggcttgtacatgctgcttctactatattgtagtacatattatagtagtttctcagtggatggacattgtgaaatgtcctggatcactggatgtaattggtggtaaaccaacctttcctttggtcaaaggacaataaatctcatctacgctgtggatgtatctaagatacttccagtggcaggtgtattaaaagttcagtgttcttgacaattcccccaagcaataagtcaaagggatgtggtattatttatgatggatcggttgggatggtttaactcatttatgatatctgatgttgatttgccagttgtcccatctagttgcatcattcctgattttgcagtaaaaacaaatcagtatacaacgttggcagccatgtgattttcttcttccagtgtgcatctctacaatgctcactgatgtcagcatatgaaatggatattaaataaataaacattgagcttacttgtgtttattgtgcatatccttatattgtgcattctgtaacctcttgaggaatggtttttcaagctgagggcctaaagctgtttcactccacaggatgaaactgggatctacaagaacttgcttcaagaaacagctcatcgagcaggtttaaaactgccagtgtacactacaattcgatctgggccaggtcatacacctgtgttcacatgcacagtggagttggcagggatgacctttactggcaatcccggcaagaccaagaaacaagcacagaaaaatgctgctatggcagcctggtctgaattgaagcaatgtgagtatcttctcaccttcttaccacctttggtctcttaatgcatggttcactggatgtacaacaatggaccgcctatgtgctaagtactttattggaaaaataaagaggaaagacaatcatatatgttaatggatcttcccttattaacctatgcataatgcactgcggcatttcctagtcattccattgtatcaacttcagaactttttcactgactatttggttttgttgtgcctaacagtgccccgagtaggtgagccatcatcctcatcttgtccaccagatcatgacgatgatgatcaggaacagattatagtggctcgtactcttgcaagcttgaatcagacaaatggaggaaagacaccacagcaaaaggaaaaacagcaaagcagtaaccgcccgtcatctcggagaccctcttatccgaaatcaaatgcatcattttatggccggttgcatttacaaaagcatgcatacccaagtgttccaccagagcaagcaatgtaccatatgtggcatcaggtgcaagcaacacagcagaagccgcattttccaatggtacccactatgggcagtacaggctttccaccgcctccaactgtgctccacatgtaccctccacctagagggcaattcaccatgccatccagccaagatggtttaggtcttattccatgttatcctgaagcttcccccgtccttccacggtacttctcgccttatcctgcctcctttgtaccaagacgtccattgccagttaatgttcacaaaattcatgagaaaaggttagtgggtgctgatatggttgagcttcctgatgctgcggtcttctcccgatacactgctccagatttctctggtacatcagaaaatgctgttcaagataacaagaaagaagaatataccgagagcagtcctgcctccgagcaagaaagcaaatctcatactgcctcaagctccgccacgcgttcaccatcacaacagctagaatcaaatcaagatatagaaatcatgggcggtttgcggttggaatcaaagaagcccgcagaacagccaccggagtcatcaccatccagggtcaatcctgttcttctgtgtgaaactggccaacggcaccattacagttctgttcgccatggtgatcctgtccacagaaatagtcctcaaataagtgtggctacatcacctagtcctattcgtcgtggtgatcctgcccacataaacattcctcaaataagtgtggccacaccacctgagtgccggtctccccgtgcacaagctccaccaagatttggaacaagaatgccggtaaatttgccgagttcgttataccagcaacggcctccttggttagctgcctcagttacaatcagaacaactatccctgtatgctcagcgaggccaaatgtggtgaactctagtgctggagcagctcaacctgctgttcagatcctctcggcctcgcctagaaaagaagaacctgaagctcgcacgaacaccagtgacacaagcaatgctgcaacggcgagttctgagctcaataagcttccatatttgaaagtcacagttttggttcatctgagctttagtcagggctgagaacttaactctcagctgcatctcagttttgattgtttcttttcctttcattttttttatctccttgggtatttagctagatagacataactatatgaagagttggagagcgggcatctctcgcgatatctgaacctgttggattttttatgtaccacatcttatcaagaagagtgaatgggaacagtatatataccgaatgcaatttttgtttgtgagatttcagaccgcactgagcatccataaaatgtagtgcagtggagtacatcttcactccagctctctgcatctttatggagcctgttgtaatgttcgtcacatgaatgcttttatctcttttgattctcagtacttggaagttggaagctatttgattctctcaatacttggaagttggaagtagtagttgcaggattgcctgtgtatgatattctcacaccgctattgcaagatatagtttgcctgcagtcgactgggtaattactaattaggcagcagaaggcataaaatgatacatgcgatgccatatcccctttccaggaaaaggagagtatcattacctgtgcaatgatgcagacgcctgacgagcggtggtacattggtgtggagacgacatgcatacaggtaaaagcaactttgttttatttgattgatgtctccaaaagagagatcaactacttgttatagttatgatcacctaaaatttgtaatgttgcccgtccaatttaaaactttaaaacacaaccactttaaccggtatacaagctaaccatctcactagagttatgtctgctagtttttttttttttttttgagctaaagctactgctagacaattgggatgtatctggggtttccccttgggtttcatgtcaacctccaaatgagctccctaaatgcatatggggggaggaacgaacaataatcagatcaccctcgccttctccttccctgtgagaaaaacaagtgggtgaggtcctactttactgtaataaccaaaacagtgtgtggttctagtaaagatgaacagaatgcgatgtaaataacacttaccgagcctgcattggcttcagtgtaggactggcgcctcctcttcgaagagctttgtggaggggtatcgagcgaccttgatgaagaacgctttgctggcgacatattctgcaagtgcaagaaagtaaaaaactgaagattagaaagattgcattgtgatgactactagggcaatatgtttgtacttcactatgaagtgaactagaagccaaacgggaattgaaaaaggtctactatgaccaaccttcttatctttcctggccaatctctcacgctcatcatattcttggttctccttctccactagacgaatgagggtctcgcacctcctagctagctcttgggttgttctagacttcacaaaccaatcaaatcggaacaagggcgacatgcgaaaggctgctttcagttcatcccagtttccgtatccgagtttgtgcaccatgcataactgtaatagacacaagctgttaaaatgcaaaaaagaaaggggcttaaattgttcaggaacaattgtggtgtagcataccataaaacgatcacattcttcgttgtataacttccctttattctggccatactgaattttcaactctaaccaagggttcttatagcggtctagctttttcccaatagctttcataatctcatccttccggtatatccttgcttctcctttctcaatgttcttaataactcggtcataatctgataggatgaggacatcatatttagtcaaaacagattttgtatctgaccattactcagctcagcatgtaagcaatccattacttggttacaagttaataacaaagtcagctacacattaaataggtcatcagtagggaatacaaacagtaagagaaaaggttacaaaatataccatttaattccttgtatctttcctggaaaactttagcgtaccgctgcacctcctcttctgttttcccctccatttcagaggatatgttctttatgtcattacgaccgtacttctcacaagcacggatgaatgtattgaagtccctccttgtccatgtcgaaaagccctggatattatacaatgcaaaaccaaacaaactcagagaaggaaccagatataaagcaggcagatatattgaacgacaaaaacagcatgtcctttttcccccctagaataaacaacagtaacactaaatccaaaaaggattttcattgtttgtaaccacctcttccaatagctgctctttctcttcttgctcctccacagtcaacggttccagttgatctaaatattaaaacagaacttgtcagaacaaaaaaaaaacatctatctgctttagtgccactataaatgcatagttggtaataccttcgtcatcaccctcaccaaccgtatcctttttctgatttgcttgctggttaagatttgtaaacaggtaaaaattaagatcaagaatcacgaaaacaattctcagtctcatttagtagcatgtacacatagacaatatgttggacattgggaaaaccaatttatctggaaattctacatgactagggaataatatatcacaaacaaaggcaacctaatgacctatcatatagtaatataatgtctcatgcttctgacataagtaaaaaaactgatatcgcaaatagttctagtggagagattaccacaaggtatttgacttccttctcatataattcattgagtctctgagtgttgaagaactggaaatcatgcctaacaaaaacaaaaccaaaatgagtacaccactgcaattaaatgaaaaaaatattaaaaattttgaaaaatgaaaaaaaaaagactatgtgaacaagcttacaagtgtggcattcgaggaattctcggttccctaggttttgctggtgcaccttggcgaagtgcttgcttgaaataatcagactcagagtagctaatagaaacatattaacaaaaaaatagtctgatcagaaggagactattattctcgttattaaaaatggacataacatagttatataaagcatactttcgcttcctttctcttctgctggttggctctatccagttgtcagtgaccaacttcttaaaatcaagtttgttttcatccttcagaaaaaataacgtgcattcaattatcacaaaatcggaccaaatatgacagcacatcttaatataaaaaacaatgatgataattaaactgaacttagagcatgcagcaaacaacagaacatagcactgtttcattaccttatcatcatcaaaatcatacagttcagcagctgcagaaaaaacatgaatgaataagcttggtaagaatacattccatatgtacactagagccatgtggtgatttttttgggaaacattaatttgtgcagacatatttaaccataacctttagtctagaaaactatagaagtagttagaatgcattatacaatttgacaatatttcaaaatgagtccgaagtatgcggacaagtacttgaacctccatttccagatattttcttagagttattaagaaccaaagagaccaaactttatgagtttgtactgaatatatgcagacatagagaaggaagtgtgtgagagatattgagagagagagagagagagagagagggtcatactgtcatccattttgaacttaatagcatcttctgtgaacttcttcatttttgcatcaagttgtgctgttgcttcttctcccttagnnnnnnnnnnnnnnnnnnnnnnnnctgttattgtgctatccttggagctgaataccatttcagcaccaaatctgaccatctgcaatagctcatccttattgacagctgaaacaccacgacagaagaacattaattgatgtttgaattttcatttgtcaagcaacattttatgaagcaaaaaactaacctttctgctctgccaatcgaccctgttgtatgaccaaagcatccagggcaagcttcttataagctctctcaatcaccttttcctcaattgtatactgcatagaatatgaagcatattctgttatataaataaatagaagatattgcttagtgctaaaccagtgtttttaaatcttaaaataaattaaataaaacctcagtgcagaaacgaaaaacttgaacttctttcttttgaccaattctatgtgcacgatcttgcgcttgcagatccacttgaggattcctgtgaaaccaaataaccataacctttaacttcacaaattgtagaatgagaaaaaattacgatttgaaaaggacataccagtcactgtcataaagaataacaacatcagcagtagcaagatttatcccaagaccacctgccctagtcgaaagcaagaaaacaaatttttcactccctggcttgttgaaagcttcaatcgaagcatcacgatcttcaccaccagtattcccatcaattcggcaatattgataccccttgtacatcagataatcttccaagatgtccaagagcctagtcatctgcaggatacacagttgtgtatacacaaatgttatgaaaacataaaacataggcagaaaagcattatatataaaaaaaacacaagataaaaatgtggacatttgcatcaaaccagctcacaagtagaacacacacaaatcatgaaataagattgctatcatatccttgatgctgtctgaactctgacacaatgcaaattcaacttgagtgtaacagaaagaaaatagtgacctgtgagaaaataagtactctggaatcacgttcctttagcttgggaagtaatttatctaacagaaccatttttcctgtaaaataagagtgcatgatcatatgtgcagtattgcagaaatagtaccaaattatgacaaatactagagtggatgaatagtacctgcattctcaattagatggtctccagtggtatagggtggaccaggctcagcaccttggaataaatatggatggttgcagcacttccgcaattgcatggctatgttaagaaggcgtttgcgttcaccaccggcattgacaacctccagatctttctgaagcagagcacgataatattgtttttgcatctcagacattccaactttaagtatagtttccttttttggtggtaaacctttctcaacatcagatttaagcctccgaagcagaaatggacgaagaaccttcaagtgtaacatgttacacaaatcatacaaggaaaaccaacatgatctatcaattgagaatatggatatcaaatctgttaccttatgaagctgctgaacaacttcatgttgatcattttcccctgagatttggaaccaatcatcaaaagtctcagcagagctaaatatttcaggcaacaagaagttgagaagagaccaaagttcatgaagattattctgcagcataatcaagtcagtggtgataaaattggacataacttgaacttgaagaaatgtatactgaagcaaattaccataattagattagaaagagtacaaaatttgcataggtagcaatgtagaattaatgtgacaaggtggtgctaacatacctgtagtggagtgcccgtaatgaggagacgataattagtattgtaaatcctcatagtcttagagagaagggaattttcattttttatccggtgggcttcatcaataataatataacgccagctgaaacgcttcaatgcagttttttctttaattgccatttcaaaactagtaacacagacgtcaaacttccctgggactaacaaattttcccggatatggttctgaccaagtatgacaaatatgttagcaatataccacaagaagttcacatgaatgacagagataacatggggattaccctttcttcggggtttcctaagaacttgatagcacgcagaacaggacaaaaccgttgtatttccttcatccagttcccaagagtggactttggtgcaacaaccatgtggggaccggttattcctctaaactcatgcaaatatccaagcagtgatatagtttgaagggtttttccaagaccctgaacgagaaggatttcatgccaaatatgagctcatgaagttgaattaagcataaccatataagagtcaataagtataatcttaatgttaattgatatgtgtaacaacaatgaagagcaatagagtaccatctcatcagccaatattccattgatgccattctcatacaagcgtatgagccaattaagtccagctagttggtaatctctcatctttccttttatgcctgtcaagtaaaccaacaagaatataatgatcatttagtagttaacataaactgatgagattgcacgagtctgtgacggactcattttaatcacaaagaaagctaccagggcatttgtacataaacactaccattcagttataacaaggatgtgaagataacaacatctggacataaacacgggttaaatgctgtgaaggatgcagacttatccccaaaaaatataatcaaatgaatgaactaggagtctaggacaacaactagcgtaattgcaccttgctatcacacacacctacgaactaagagagagccagctgagcagcagcagatcgggtatgtccagatctaccgggtagaaactaccgggtacctgttgtatgtatttttcttctacaattaagtgcaatccatgaaagccacaattaatccctctaattcctcctctttaatagataaaaaactaacaacttttgttctacagactgctttgatgtttttttctttaaaaaacagactattttgacaaaaagctgatgttgcacagcatacggtcgctgacttggaccttggttcacacaagaacaaaagcatgtcgactaaacaagcagcatgcaaaagaacaattttagaaagacagaagtcagtttcttcttcctttctaaatttaccgcgtcctttttgtctgttttcagtggagcaaatattcgaaccgtttacgcttaattatatcagggtgccgtgaaaagctccctaatcggagtcctcatagatatcatttcaagggctttttcgggggaatatcatcaatcgtctgatcaatgacaaaataaatttgaattgacctaaagatgaaacattttaggagaattaaaactagcaaacttggacaaacaattttatagctttgtttggatggaacggaatccttgcccaacacgtgtaagccaatgaaaattagtataattctcacgtggacatggaaacgtgtgccggaatccgactcgactagtgtgtctgattcggcacaaaagaatttgacacacaaaatccttcctggaatccaacacgagcgtcaaaacccgattcggactcgggatgtccgattcagcaaaataaattcaaagcaacacatatgttctagtcaaagtgttcgaggttgcatttcatcgaaacaatggctttattctcaggtgacactgaacaaaatgtgtgagtggtgtttatgggaggttctctctattggtatgtcttctcgacggtgtgcctttggcacaaaagaattgggcacacaaaatacttcttggaatccagcatggatgtcggaagccgacttggattctggggtccgattcggcaaaaaaaattggacacgagtgtctaggtaatattgtaaattcaaagcaacgcctatgttctagtcaaagtgtttgaggttgcatttcatcgaaacaatggctttatacttgggtgaggccgaacaaaatgtgtgagtggtctttatgagaggttctctctattggtacgtcttcttgacttgggttggtgttggtattttattgcacctttcccagtcttaaattaacggctgagttcctacatccgtttcagaaaaaaaaaaaaagggggaggagcacatcctattcctatccagtacaaaaaaaacacggagaatacaaatctagttatggccatcaggctctacatcctcatcactaacacagacaaacaacattaacactttcacccagtcttgctcaaataatggctatagatattatctcctttcctgccagtaggagcaagagtagttgagaaatcagaaccagggtttcctttccataacaggccgtgagatgaagcaacataatttactgcattccctcacaacagctttcgttttaaacaccatccgaacagaaaaaaaaatcacaaaatgttgattaattcagcacaagtaatcgcaaattcgcaatgaaattgcgaaccgttctatactgtttcgccatcaaacaaatcgaaccttccatgcaaaataaacattttcgttacacaaactgcatttaagactggcttgtaaaacaaaaggtttgacagaatcatcaagcaaatgctcacatgatggttgtgaaaccagacgggtccctcctgcaccatcaagggcatcttcctcctccttgagatactcctcatcttcttcctcctctgtcatctttgatgcatgacgtcccctaagatccttaccacattagctaaacaaagaagacctatgaagaacaaagaaatatgtaccacaacaagaagagatagatgccctggataaatagatctgaatgttgtggtaagtagtaccattccccaaaaattattgaaatatgtttaacaaataccacttgatactagaatactagatagctagggcacaaaaagatgttgaaagctctatgcactcatcaaaatttactgaaaatgataaatgagccaaagatgactggttaggtgcatgttttaacagcttgaccatttttaactactttaaatctgaaatctgaatatgttgaagttccaatagagaaaagcttttcttaataatcctgacaatgttcagctaaaggaatgcactacatgatatcttggagttcatcaaggctatgaagatgggaatgggacggcaagtcatcactaccaggtctcaaaaacagaaagtatttcgcatattacagaaaaatattggcactgtactgttgtaacaaatgacaaatggttagcagtaacttcccttaatggaaagtatggggttagcatatttatccaaggaagaatataccttccacgtgatttcttctctgtcgattggtttcctttcgcaaaatgagcaaatatttcagtttgctgcaggagatacttcagacgtcccttccccttgttgttctgtccatgaatttaatattctaagctaccacagaactcaaagccatgaagtgaacgcaaaaaagcacagaagatttagatcacatgtcaataaggtattcctatttggaggttaatcgctaggagatatgggaacttatcaaaccatgtcagcatcaatggccttattttgggcatccagtatttcctggattttgtgcttcttcagcttttgcatctccctgagctttgctcgctcccgcttcccgatctctgcgtttccagtagcatcttccaactgcaattgaagacaagcaactcagtgatgttgagtgacactcagagtagtcactccccttcaaaatattttgaaactcttttttagaactaacaatcactcctttgataactgtaaaccatgctgattggctaattgcgataaaaaactacttcagtagcacaaatataccacgaagctttaaacattttgctacagcacacttacgcataaagaaaacccaaacggatacaggaatcctcaccagatggaccaaacaagaacaactttactaaaatttacaacctattgcacgggagaggactgcctctctttctaaaaaaaaacaatctacaattttaaatgaacactaatatcatccctcaaatgtctacaggagtatagacgcataacagattactttacagctaaacagagggaaacaggaaaaaaatctgtataatcaacggaaatctgctgatttcgtttcagaaaaagagaaatcatagcataatcgctaccacctatcaacagattcaaacataaaccacccaacccctaccagcacctagatcaccaaaccgtgccacacccaccttgtcgccatcttcaccgccgccatccttcccggcggcgacctcgtcgtcctccgtggactgcgactcctcctccgcgcccccgtcatcgcccacttcttcgtcgtcgtcgtcccctccggcgccggtggtgaccgcctcgatctcctcctcatcaacctcctcctcttcctcttccccagccccctgctcctcctccacctcctcttcctcctcctcaccctccgcctctgcttcctcctccccgacactagactcctcctcttcctcctcctccacttgctccccatccgcctcaccctccacctcctgctcctcctcgtccccgctaaacccctcctcctcctccccctgctcctcctgctgctcctccccctcttcctcttctacctcctcctcctcctcctcgccggcggaagacgaaggggagagctgctcctcctccgagtcgtcgtcgtcgccgtcgccatacttccccggcttccccatcacgcctcgctcgaggcggcggcggcggcggtggcggctagggtttcgggagatttgcgagaggcggatcgggggtggggaattgaattggattggagttgccgaattgggggattggggtgatcttatattgaagcggtttcgccttgtcgccgctcgcgcgggggcggcgtgaaatgaactagtgaagaaacggaagaggaaagaaattggagcggagtggaggtagggggcttttttacgatttggtccctccagaattgagtatttcttcccgcccagcgtgtggggagggagggccgggctgtggatgttggggggccttcttgggctggaatacaaaatgtagttttagccaatgggcttaattgatagtgggccttttttatgttttgcttccttcgtcggcttttcagcgaaaatgaccttccgtatctaacgttgatcggccgaatgttgtgatgaattgacaccggcgacttcactgtgcaaatttgatatagttctatcatctactgataccattcaatacttcttaaaagtgatggagtctcttctgccacaccatctataccaccgatattagggttctacaatctatattattacatcacccttcaacgatttctctcccgtttcatagctaactctctataaatttggaatcacctacttgttcaataagaaaaataatgaaagtactatttggattaaatatgtgcttaattaacttaataagccgaaactcaaatttgttttccgttgcaacgcaaaggctcttagcatcactaaatctttatgtttaccttgcgtatttttttagttaggtatagatctatcctttttcacgtcgcgcagtggatagcttttctagtttggttaggtcaagacatctcatccttatgccgccacatgcaatctcttgccgattcctcgcgtcgctgaagctagggtttccctccatttttcccttcatctgcaccactgtggagtccaccataaggcatgtctctacacctccactgcactttattggcattagccatcacacagttctcatccgcttttcacaatgttgcaaatggattccccgtgctgggaagacgttgtgacacctcaaatccgccgatatctccaccgtagcttgacatcgaccttcctcctttctccaataactgagcttcaattcatggcacgttccattatccccatattccctaagctggccaccataatcgatagatgcactgagccataggacgcattcctcctccgttttttgttgtcgtcacatcttcggatcccctccatcattgccacttcctctgctcgg

SEQ ID NO: 68789 - DNA, 7071 bp, Oryza sativa
aaccactgtcaacacagcttcagcgacttaccatcacaaagtgcccattgctagcagactggttggaagtccaaatttcgcaccagcaatgccaggtatagatctctatcaccatctacgtacaaatactttatgctttaagttttattagtgcatttgcagtactaggaccactgtttattttcttagttcctttttctgaattttttatttataataattaatgtcccttctctcagttacatgagtctaaagatgcttggtatgaagagcaacaagctctgaatgaattgaatgatgcaagtgaggacgagcacagagaggagtttgggcttttgtacgaagatgacaatggagaggacaacgatgagcaagaccatgagcagtcagaagatgaggaaattcagtacggcagtgatgacagtagcgaagaggatgaatagatagcttaatttggtataaaaattagaaagaacactgcaacctataagtaataatcacctaatcaacgtcatgctttacaggtgaggagctcataccatattagctacatatatattttaccgtctctcatgggtcatgtggtgtgattgtgtgaattaaacaaccaactattatttaccttttgcggagaaaacagctgcattatgtgtagtggttcctgagtggtgtaattggtactatttggacactcatagcagcctggttccttttctcttatcgctataagaaatggcatgcaaaccttctacgtattctttaaaaaaaaagatagttaaagtcaaggctttggattgaatcaggctagtcacaaacctgaaatgcatataacgtatagaagtataatagctgcagtaacaaattatagccttataggcccagttctaggttcaaactcgaccaagagatctgaatggcaacaatactgcatccaatctccagctcagcaaagaaactatggagcaactagttagctcaaatgtagattaattgtggatttgcgcataaccaaaaaaaattaactcattctaaataattttacctacacatatcgccggcggcgagaactgggaggctcagcggggcgcggcatttgtgcggagtttgcagcagaggccactggggcaagagaaaagggccgcccggagaagattctgccgctggtccccgagtcccgagaggcaggtgccttagccgttcgccgttcgtgcttccggcgcccgccgccgccgccgccgccggcagcaccggtagcttggcctggggaactactagacgtgtgaatcggacggtgggccgtggggcggtgtgcttggacgaacaagcacgctggcccatatggcccaacgacgcagatctggaaggcccaacataagctggaatcctggaattttgatgggccacgaaccacgtttggaaaaagttcactgccggtctctcatctaaggttgagtttcgatcgagtctctcaaccgcgaaacaatgtactaacgcaatccttatctttaccgaacagaggaaatgtagtcccaacgaagacggtttcaacgtgccatattgatttgttctttatctaatgtggcgtctatgtgaaacttatacgataaaacaacaacaacaaaaaaaagtgggtcaacgtacatgtaatccatagagaagaaatatagtgtgcatatggcgggactatatatttaaagtggttttagaagatgaggggcactatccaaactcaaccgttatatgcggaagagtaaattgcactagcggtccttaaacttgtaacgaggtttcacttaggtcaacgaacttgcaaagcgcatatcgaaatccctaaacttagtttattgtatcatcccggtctaaagccgcgtttgaccgtggtcttgcctacgtggcacgccacatgaacgatgacatggcacaaattttaattttccttttttttctctccttcctccacctctagatgcatctgtggcaggcaaagggagagagggagccagcgagaccggtgcgaggaggccgtgggcggggtcggcgacctggcggcggcgcaggagagaggcggggagaggcggttgacgaccggtgcgaggaggttgtggccggggtcggcgacctggcggcggtgcaggagagaggagctggcggctatcgagaggagaggaaaactcggcggcggcgtcgtcttggctcgagcggaaacgggcggcggcgatggaagggagaggccggcacgggggagctcggggcagcggcgtcggcgcgggctgtcgcgtgcgaggcagccggcacgcgacgacgcggctgaggcgacagcggcgtgtcggcgcggcgcagcttggcacagcgccgggagaggggcagcggtgggataagggaggggagctcggtgtgggagaggaggctgcccacggcgggcgtggcatgaggcagcggggcggtggctgagcgcggcagcacggccgggcgcgcgcacgggagggaggcggcacagctcaggaggaaggtggtgcggcgcagtggcttggccacgcgcagctaggaggcgacgccgaggggaggaaaggaggaagggacacgcggctgggaggcgccgcgcggcgtgtcctcccccaatcaccgtcgtcctccctccctcccgtcaacgaggctttggctgccccggcgacacctcccccctcgcgcacctcagccgcttccgcatgaatgacgtgccgccctcctcttcgtcccaccactccggcggtggcccccacatggccattgtcgccgtcgagctcgcgttgcccagctcgagctcgccccaccgccccgctgccgtcgtcgagctcgggcccgccgacgcctccccccgcacgcgcggccgcggtcggcgacccctcccccgggagcggctggcgacaccaccccccgtgcgcgcctcggcctcttcgccccaccactccggcagtagccctcacatggccgttgtcgccgtcgagcttacaccgttgagcacgagctcgccctgccgccccgctgcagcggcttctctcctcccgccagccgacacccgcgcgccgctcctttctcgccggccgctggccgcgcacgcgcgccgctcctctcctcccgtcggccggcgcccgagcacgcccgcgccgctcctgccccgcgtcccctccgaccatacgaggtgaggaaggagagaaaagatggggagaaaaaaaggaaaattaaaatttgtgccatgtcatcgtctacgtggcgtgccaagtaggcaagaccacggtcaaacgcggctttggaccgggatgatacaataaatcaaatttagggatctcgatgtgcgctttgcaagttcgtggacctaagtgaaacatcgttacaagtttaagtaccgctagtgcaatttactctatgcggaatctaaagtgaatttttcctgccacgttttgagcgctagtatccctgaaagaaaaattgctgcaccacaaatcttctcgtcttggtaagtactatagctgtctgacaatcttcaataatcacttgttatgattccgaccccaattccaggtgaatttctgatgaacttcaacaatcacttattatgaatttgctatattatatgattctaccgctatatgtaccaatcgtaagtaaatacactagtatactttacatggtatatagtagtatatttctatggctgtacttgaagcttgaaaaaagtggaatctcacaagcagctcgatcgatcagtacaccgtgaagatgagatgaagcctacatagcagcgagctgcctaatgttcacggggaagacgagcggcggcgagccgtcgaacgcgacggcggtgagcatccgcgcggtggcctcggtcgggtggtagaagtcccagaacacgtagcccgtccggttggcgcagtagaagctgaccggggtgcagccgatcttggcgttcatgtccccgaggccgcagcacgccgcccgcgcctccgcgaacccgtacgccgccggccgctcgatgtaccggagcagcgccgcgctggagtcgaacaccgcgtagcggaggcccgcgcgccgctcggccatcccgcgcagcagcgacgccgccgccgcgttgtaccgcgccgacgcgtcgttggcctcgccgctgcagcccctgtcggcgctcagctcccgcagcgacgggcagcagcccaccggccccgtccccaggaacagcaccctgcgcgccccgaggtcgtacagcctctgaacacaatcgatcgaacaccattagaacgtaacaccatgaaattgatcatttgatgatcgatttaattatctgtcgatcggtgacctcgatcctcacctgtagctggccggtgagcgactggatgagggcgtcgacgaactgctccatagggttggtggccttggcggcggcgctggacctgacgtagccgatgatgtcgttgctgccgatggtgatggcgaagagggatttcgccaggtggctcgccgcctgggcctcgccgaggctctgcaccagcgacgcctgcaccttggagtagtactcgatctgcttgtcgaagctgatgcactgatcctgcattaatgtttaacacaagtaattaaaaccaattttcaactctaaaacaagttgaaaacaaattgactatatcactgtcgacagaaatatgtaaaccatttgtattatttttttaaaaaaaatgaactttatatatagtgcgttgacgactaacatgcatacatataatcctacgtcctggtaatctatgagaaaagtttgttattgcaattacgtgtacgagttgaaactaattagaactaccttgtttgtagagttgaaaactccggcgccacctgaagcaaagttgacgccattcacgtagttagcactgctgcttgacgatatggcgaggtacggtggagatgtcgccaacccaaggttctcagctgcaatgcaccattcatatcaaaaatgaccaagtgataaattaatttatgatcggatacacaaggatcgggaagcttgtaataacatgattaaattaacgtactatatatgtaataagcaggttcaaaattacggactgaaattttcaaaattttgggtctatcgcccccctcccccccccccccccccaaaaccaaaactattccacccttttttccattttttgtgaatttggcaaattttgtttaaatgtgaccaaattttattaaaattcaaattatttcagtacctgatagaaaatagccaaaataaaaatttgaaccctggtggttagtatgtaagggctaagctgtgtagaacgtacgtatgtacaagttgaaaattgtaattgctaatgcacatatatatatttcttgtttttctgacttttttaaaaaagctgtttgctagttgtcctctcacacccttcttttttttctcgtcaataatgtagaggtccccttccaaaatcgaaacttacatatcttttatggactaattcatgagaaacttatgcctctagcctattggagctccaccatatggcacataacctatacatagaaggtcaatccagcaagcttgcaagagataaattaaagaaaacagtgttgtagccaaactaaagaatgataaaataaaattccaaattaattaaccacaacattttttagaacaataataaccagcttgtcaacatcaaataggtaaatcgcctaaatccgatcctcaaatgtagaataattaaggacgtacacgtatggtaatctgacccacgaaagtgaagtagagaatgacaccaaatttgttctcaattgattggcttcgccaacggacaatttccatttcactttcttgggggaaaaagttatggccaggctgaaaaggacatatcggaaaaaccctttggctagatatctgatatctcatatgatgtgcttgacctatcattcattaggtaatatgtctccagttatctttaaaaaatataatttgtctccacctaaatttatagctaccaaaaaccaaaattaacaaaatagagaaggcaatactatggtgtggcttcacctagtaggttgaaatctaagtgcacacgaatatatggagaaactacaaactatagttcattatagtgtacatccaactattgcgtgaaccttaaaatttatatgtgtctatatatttttataggtataacaaccaaggaaataaacatatcttgagcgtacaagcaacgtcggatgaacacgtacagaaattgattacaagctgtatggaatcatcaacaagtagccaacgtgcatcaatcaacattttgtcattggttctcaacgaatttagaaaagaaaataaaattactccctttattttataactaggaaggaagcccgcacggtgcgcgggctttttatttattgttttatgaaatagtgctaaaagaagtcatatctcaccatttctacgtcgtgagatagatcgtagacttcaatatagttaaattataagaatgtctcccagaattaaaaacactttgtcccgattacatataaattttcctattatcgtaacaactcattatcactattttaaaagctcgctaactaccaatacatgaaattgcgcataataaaataagcctaatatattattaatacactacttagctaagtgtttatgtctcacttatttccaaatccacatataaatattctaaaaatatcactaacgggtgaagccggtcatagccgtagagactttctttctctattaccttgaaaattgggtagttgtgtcccctcaagatcagcccgaagcacaattttaatgtctaatttactataaccctttcatagagtcctatgacacactgggcccactcaactcggccatttgtatgccacgttagagggtaaataacgggtccaccaatttaaatgaaaatcgatggtgagattatacagtaccatgtgatggcctaggagcacttatagcagcgtcatatggcgacttaggaatattaatagaaagtttaatgaacgtttagtatataatagtttttcttgctgcgaatagtagtaccg

SEQ ID NO: 68790 - DNA, 1464 bp, Oryza sativa
caccgccgccgccaactccaccccacaaaaccctaatccgatcgagagggggcgcagccagtgacgggaaacgccaccgccgcgccacgtctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctctctttcatctagaatgtcgttcatcaaacccaaatagaaccacccgactagatctaacctatgtgatcctagtgcaaagttcaacacggcgcccatgaggctgagcgtgccgcggcgcgccgtggagttgaacacgacggagaaggcgagccacgcgttcagcgtcgacgccgccttgccgtcgtagaggtagagcccctgcgccctcaccgccgtctcctccagcgacggcggcagcgcgctcgtcccctccgtcatcgggtcgttgaacaccaccgtcgtgccgaagatggtggtgttcttcgccgccctcagcagcgccgccggcgaggcgaccaccgccgacgtcgagttggccgtgctgttgctgaagtcgtagaggatgtcgtggaagtagagcctcatctccttgcacggctcgtcgtagctcctgacgaacctcctgccgccgccgccgccatggacgacggtcgccgagctgaggaggaggccggcgacgaggaagatggcggcgacgatcagagacgccttggaccaagtagcttgcattgttactcttgcttgaggtaattaattaatgtaccacttggcttaattgattgattaagcttgctttcttgcagctgttagcctgtgatcgatgtggcgagctcgatcgagatttgcgtacctatttatagtgatgagaaaggttttgcatgcatgcatggatatattatatatatttcttgctggtccgattctctggtcctgaactcctgatactgatgtttcatttaattaagaaattaaatggaatataaacttggcttctacatcaagccggatgcacatagccatgtcctactgctgatgtatacggtactagggaaaattgctagaagagatagcacgtctctttcaaaaaaaaaacattataaatctcaagaaagcaaaagagatttgtttagtagtactccctccaatgccagaagagtaattgttaatattttcgacaaggttaaagttaaactactagtaactaaaaaaattagtttaaataaactagaataacacatatagaataatctaaaggtactataatagaaataaatatttatttattgtatacattataatagaaaatcatagcaaagatatgttttgaaaaccgtgtcattataaagaaaaagtcaaaaattatagaaccggagagagtatttattatatattgagatacg

SEQ ID NO: 68791 - DNA, 1622 bp, Oryza sativa
gaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccattccccagatctaccggcgcccgccagctggaggcctgcgctgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggtgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttcccgcgcccacgcttccactaatcccattcgcccgcttgcggcgcatgaggtggatatgcggttgtggcagtcgagatagatcatatcgtgcgcgcgttaattacgcttgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccgcgagggacgtcgggcccgagggtgatgcgttcgccctcctcttagtccccccgaggggg

SEQ ID NO: 68792 - DNA, 680 bp, Oryza sativa
ccacgacatgaagagctatttaaatcaactcggcttggatcgcgccgaattctacaagtcccatatttcctttgtaacctgtgtttcccaccatataagcccatatcaaatggattaggactattacctgtaagggggctgaacagtctaaatctagtcttttgattacttgatgtcgtactacctagatccttgtaccaccgaaccccaataccctctatatccagcctaccaacaaaggcgcgccaagtaggggcacttgatactaatggttctactactatgccattaaacttcgtcgacaacaacgtcaacaccagctccagacaagcactctcagctttgattgtgctggcatggactcaaattggacgaaatcttatgcccggttcacaccaccatgccgagctcaaccgaatctccaatgactggaaacaagaacgcactggctatgaaccataacggctccatgtcgaaaaatccacccgttgaaacacagaacggattatcgactacatccaaactcgtgaaggattatgatgcggacaagtcttgtcccttcgacaaaaccacgggccaacaaatatgacttccgaagatatctggtctttcgggcccatccacagaaccaaaaaacatacccttccagattgctaggtatggatcaatgtccgtgctga

SEQ ID NO: 68793 - DNA, 874 bp, Oryza sativa
gcaaaccactgtaaattctagcactataatcaatatatgtaaaaatgatgaagaaatgattaatgcattgtctgcctcagttggagagaccatagatttaagaaattctgcaatcctatgaaaaaaaaaattctgcaatgcctattttgactagaggttttcttttgacggatgacaggaatggacaaatgatcaagttgaaaatgaaatggagactgtgttggattctgtgaacaagctaagatctcttcggccacatacagatatacatgaaaggtatgcttatgttcaccagatgtatattcttttggtgtgcttcaagactgtcacttcctttttatagttttattcttattttgattcataagaatttgttcattttgaagctaataccttctgccctattttcatctggacagacggcctgcttttatgctctgccgtggggtagacattgctgccattattcagtgctaccaggcgcagatttcaactcttgcttctgtttcatctcttaaggtttgctcggtcttatacctctctggctctctcaactcggccactcacctcaagtcactgtttatgaatgccttgttcttgatggataatggcataatttctatttctatttcaattcaattcactcgagttttgtctacagatgtgcttatatttttgctaatatattttatgtctaaaatgcctaaaaagccaaaaaaaaaggagggaaaaaactgattcaaagggaacttttgcagatactgacagaggatgatccaactccacccaactgtgccacaaatattgtcaacaaagatctatccgtatacctccagctacgaggagctctaaacactgaagctgagcgtgagaa

SEQ ID NO: 68794 - DNA, 5720 bp, Oryza sativa
cctcccagatcaagtggtgtgcctccatctccaagtgaatggcgctcaagttcctctcgttgggaccttgggtgaaattacttggagaatggacacccttaatgtgcagacgggggagatccagtacaatctcacggaacacatatctcaaacgcaagaaatggcaacaatctgctgatgctcacatcaataacatgatgcagcaacaacatgatgaccttcaggcgtactttcgatttcaggggttcaagccttatcaaggaccctgagcgaaagccaaacttggggggagatacctctcccctcactgaggtaacttgtatcacattgcatatttccctttccaattgcatatttgctttccaattgcatcttataaaacttgaaaacaacataaaaatttgcaaaatagaaaataccaaaaagataggataggtttgtgtcatgctaggtaagacaagctagttctctttgttgaaatgatgaatagttgctctgttttatatctctgatgtatgggttcttggtaaatactctctcaaggattaaatataagtagccactaattatccggaaacctgaggtaaatgggctgcacttgctgatctaagtctagattgttgcgagatatgagatagtaaatatgagtagttatgatcctgatactagtttgacttgaattccggatgttttttttttcaaaatgataaattgaaagttcctcatttgatataaattcctaccagagcccaaaaaaaatgtgctatcatgattaaagcatatacattttggttgcttgccattccactgaactttgtcaaactcttgtgacttgtgtagatacttctcaagctctatgatcaagatcatacacccacatatatgcacatgctaaactcctacactgggagcgaagcaatattccattccatttccatatttccactaaaataaattatccatgctttcatgtgatttcttctcctaaaaagaaaaaaaatccttttgaaaaaaaaagagaggagggaaaggcatggttatgaaaaaaaaataaagttatgctccatcaagcatgagcatgatgttgaaaaataaagttgcggggtacttcagacatttcgcagcagttacaaccgtcatacctgcctataaaaggacttcaccttctcacttcactcacacacctcaagcaagagctctctcatctctctcaagtttagtttagtagtatctagctggtggaatagaattagaataggaatcaggagtccggaagtcttcggaagagttcgggtatggctctagcagctttccattcctcttttgtaagctttgtacttttattaaaatactcttctatatacatttatgatattgaaatactttccgagtatatgagtacctactttacattatgttcttgttaaactgaatgtacggctagcttatctgggagatgctttggtgcgggtatagtgtttgcttatgcaattactctatgtcatgacgatgatattagagtagtatctggtagtttagacgtggtgtctagattacgggatatcattatttggggttatatattgcggatgagaggtgagccgctgatggtgacagctcagtacgggtattcctccgcgtctatatataatcctaagttaatttcctgggaagggtattcctccgtatttagccctggttggatggtcatgatgggttgtcgtaaggaactcggtagtcaggggtggcttctcgaagtactaggagggcatcggatagagggtattagctagtatatcagttaactagaatgtatgtatactatgtatattagaagtataggaatagatttcctttctcttttcttttcacctagcttagataaattattatgaggatgagtagaaatgcttgtgtgtcactctacccttggattatcttaaccccttcttagaatatgattatcacaagtatatataaattattagttaagttctctctacgtgatcttcccatgggataaaataaatacgatacccttggaatactctcgggtgaaatgctacaatggtatatccgtgcgcttgtggatgaactctgtaaccataatataccagaagtatttctgcgccattgctgggcattatgtttctagtaatgtcattaagaaataccaacagataacttagccaatctaatctagtaaagcgttttagccgatactggcataaaccctaaagcgaaacttagtcgatacatgtaaatagaactaccaaacaactagattaactaagatatatatgatagataggtgcttacattgacaagatcagagtgtcgaagccctagccctaccgatgcaaacaaccatgacaagtataaacttgttgaaaaagtagaaaagtaaaaggggtggcgatgcgccgaagtttattgatctgtggagatagtttacaatgacccaggtgtatatatttatacccatgggtagatactagtccttcttggacaagaaagaaacttacctaaagataaaaaaggaaaacataaagtccttatggggcactaaacacattttcctaaagataaaaggaaacaaacagactcttcctaattaatagataaattgacatgccgcatcctcctttaactcggtcacttctagataagctttttttaattgattaatttccttaaccgaatatagaaagaatgcgactattggcgacttgataattctcatcggccgattccaaaactctgaagctgatactgactctaggccaataatgacttcggggcttaccaaatttcactgctaacatgactaggccgatgatgtcttcggggcttaccaaatttcactgttaacaagatcaaacaaacgaaacatggtgaatgtgtatcgggggttcagattttactatggatcaggttgacgaggagcagcggacatcccaggaacaacgctcagtaccggacgttatcgtcagcacgcagccctcaagcatagaggaagacaagccgttgtagtagaccaatcagcgatcacgtgaagcgcttaccaagaaccttattggtaccttcttccggggcaggacgtcaagggcgatgggtcgggagatctcctctcctgatcacaggtacacatcggcaagaggaacggagtagactacgagtggtgacataatacagagaaggaggcaaaccctagattggttttcgcgtatattgcgaggaggcggtggctcggtttatgtacaacatataacaggacgcgtgatcaggatgtctacatgatctccaaaacatgtaaccgaaccgaataattcgcgtgtaacttatctggactccacgccgctccatgcatcatattatttggtgcatttccaaaaacaaacaccgaattttacagcaaaaggaagccacgtccacgcaaggatgaggaaccaatttggtggaccattcacacgcagccctgtcatgtgaggcgagcaagggcgcacgtatttctctagttctctccaccacacatacctcaagtggttacgagagcactctcccttttaaggagatatctcttctagaatgaacgtacgtcctcgtgcatgcctttccatgatatgggcttctatgattgaattaaactacaaatgagctaagaccaatctattaattccaacatattctgatcacattcgatttgaccacattaggatattatataattttgttcattccaagtttcaaacttcacagtgaaacgaaattatgatatctatgctttaatttatttcattttaatgtcataaatactactttctgttttaaaatataatatgatgatttctagaatacaaataatgtaccacaatataaacattactgcactgatatccatgactcttatcatttcaatgattctacaaccaatcagatgcttgcaaaggcaattgatcgaagcaattcaaaatttaaaaattgacaactgaatgactttttgacctaacattagtatttgctaaataatgtagaaatttttatattttggaatggagaaagtagttaatttgcccatgtgttactacgaaatcttaaaaaagaaaaacctttggtattcattttaatgcctaaaactaagtactactaaatgaatgggtgaatccctatgatgggcgaagtgaatccatgcaatggtagccagctgaggtcacaaggtggtcatgggaactgcaacggatccgccggtctctcgcagctgcaattgcatatgctttagacacagatcatcacgagcgtgggcgtgccaacgatcagccacgcgctcgtccgccgtctttggcatatgcaaaggcccatttgggatgttaggcttcttagtccaactattcacaagatgccgaagagggctgaatttactcatttgggctaggagggcgcaattgcatgtgcatctatcatcggcagaaacaagaagtcaatatttactccctcaactattggcagaatatgctttgccatcactcaaccataaaaccagatatatcgcctaccccaactatcaaactggttcatttcacctctctatgtggtttgtgttacatgatgcttgcgttgtattacaatatatggttctgatgtggcgttacagtatatggtactgatgtggcattgcaacacgacccaccgatcagcaggtccaaagagataagggaggcaaaatatattttgtttcagccatataagacacagcgcaaagagaggaggtaaatatacatattccaaccatgcaaggcacggcctgaagagatgagggatgcaatgtaaacttattcaaggatgagcacgacgggctgtttgtgccttcgggtcggcatgacatggtatggcccgagtcttattggatcgtacctgggccgtaggcgcaacctgtgggcgagcacggcataacacaacgagttggtcagggcgtgccttggttggcagcccatttggccattttatgggtgcatggatgatggattcttttgtgttggtgcattaataggctatgagaaggcatgcgatagggcaggagctcgatgagagcatcgccagtgcaggacctcgatgaggcttaaggaggtggataaggaataaaggacggagattgacatcatgctcactatctccccccccccccccccaccctcacggataggtcgatacgagggagctcctccacacaccagcaggatgggggcgaaaaggaagaggatgccagcctctgaccttggaggtcgcttgacggcttgccgcgaatgccaggctttgaccttcgagccttcgaggttacttgggggggcctgccacctacagtggcgaagctatatagtgtttgggggaggagtggggggggggggtgcacatgaacccccaaactcctaatttctcacttaaaaagactagaatatatagtattgtacttaaattttctagattctcaatggtagcgtacccaagggagagatgtggataaagaagatgaagacatagccagttatatgtatctcatatcttatttatttatttaataactaggcaaccacgtagacgtcatgtcagctaaaaccacctctaaattagccgatgtaattattttatattggttttaatacttaatgaagatgatatatacaattttatgactaaagattacaaattatattttgccaatagtt

SEQ ID NO: 68795 - DNA, 8087 bp, Oryza sativa
ctggatgtcgagctggctcggctcggctcggtctggctcgttaggataacgagctagctcggctcggctcgttatcctaacgagctagaaaccaagctcggctcggctcgtcagcaagctcgagctagctcgtttagctcgtgggctttggggatgagagaaagcaaacaaggggaggagccgaggaggggcgccgggaggagcggccgtcgtcgggaggagcggccgtcgttaggaggagcggcgcgggcggcagcgtccacggctggccgcgtcagtgccagggaggagcggcgcgggtgacggcgtccacggcggcatcggcgccggggaggagaggcgcgggcggtggtgtcggcgccggggaggagaggcgcgggcggcagcgtcgacatcggggaggagcggcgcgggcggcggcgtcggcggctggccgcatcagcgccggggaggagaggcacgggcggtggtgtcggcaccggggaggagcggtagcgttgagggctggcgcctggcggcggcttgggtggggattagggatggggacaagccagaaggggattcactcactagggttttgagaaggggatgggctgttgggctgggctgggcgcctgggcctcatttgctttggctcgttaaggctcgcgagcggctcgcgagccagctcgagctggctcgttatctctaacgagctgaaatgccagctcggctcgttagaaaattcaaacgagccgaacctgtcacgagccgagcgagctaacgagccacgagcttcctgtccacccctatatagggctcatattatatcccgagtacaaacttagtccattatagacacgactcaaacctttctaaagttaagatataaacaagaccacataggcagtctcttgccaaatctctaacaaaccgactcaatattctaattaatagatacaattgtcttaatcaagctctatctctaattggcaatggcagttatcccaatttaggcccatgccgagcccaagtcatgttatatcggctatatcggccatcggcttcattaactttgatcaacttcatactctgttttcagccgatacgacattccgccgatgtgcagtctgactcgcagatcaactcgatttcacaccaaatccgcttcgatcttcttcctccttttctgaatctgatgccaaattctattgttaacactaccaaaactgctcaaccacatgttgattacttgtgttttgacctaggaaacacggttcaaagtcctctggagttttggttattgtagcggccaagacaccttccaccgaagactatttagtcgcaccgcatggtgactaactttgcatagctagacaaatctagcataaggagatagaaatgcattcatattgttattctctgaccaattggagtttgtggaatgcagcaataaatctagcataaggagatagaaatgcattcatattggttattctctgaccaattggagtttgtggaatgcagcaatgctctaatattcagaggtcaggctatgcaatcctaggtgctggtagcaagaatcatgacggaagcaataatgcattggcatagggcaggtggtggtggtggccttgcaggatggcgtacaatatatagttagttggatgaccgttcttacttttccatgcatgtttttgtgtaacgtcctgcctctcctaggccaggcccaataatgcattggcatagggcaggtggtggtggtggccttgcacgatggcgtacaatatatagttagctggatgaccgtggccctgtttgtttcagcttaagattagtagattactgtaatctagattattaaatcagattactctaaggtggattataataagctgacataaaataagctgcgagttgtttgtttctctggattatttgaggcatctaattgtagtgggcctttagccactcaataatatgaaaaaagctcctttagaggagattattagattatactatctggcttatagattataataatccagcataataatctacttgtttgtttcagcttactactaataatctagattataatattcctaagctgaatcaaacaggggcttacttttccatgcatgtttttgtttaacgtcccgcctctcctaggctgggcccacttacatctggtagctttcataggtcatagactatcctcacagaccaacacaagttttttctgcacattaagtttttgtgtaacgtcccagctctcctaggctaggcccacttacatctggtagctttcataggtcatagactgctctcactaacacaagatcactcgtgcgcactcaggaagaatttcatacatgtttttgtctaacgtctcctcactcgtgcgcacccgggaagaatttcgaatttcatgcatgtttttgtctaacgtctcctcactcgtgcgcacttcataggtcatagacttccctcatagaccaatacaagatcactcgtgcgcactcgggaagaatttcatgcatgtttttgtgtaacgtctcctcactcgtgcgcagttaggaagaatttcccgatcggccacccatccctaaattgctccaagccaagcacgcttaaccttatagttctttagagatcggcttctagaaaaaaagttgtaacttgttgatatgagtattctattaatcctattaagccctgggccgggatgttacaactaaggtcatcgcaatagacatggacatggacatgatcagtcaaattattcatggacagcacacaaagataagttagcaaagtggtacaaatcagagtagcaacggctagaatggcaaagaaataatagttgataatgtggatagataatgacagcagaaattctaccaggatcttacaagcttatgcaggattaaggccagatagattcacaacatggaatggaaactgactctttgcgcatgtatgcacttgacattttgatttaaatgaagagacataattttgtatacaaataaaggaacaagctcaaaatctactggtagtgcatatagaagcttcaattttcagtgcaatataagttttagttttttctcatagttgcagtttcacttgatcaatttttttttaaaaaaaccataatgataaactgggcaaaaagcaaaagcaaaaattcagtagttgaaacctaccttgctaatttataccccttccgtttcatgttataagacgtttcgactttagtcaaagtcaaactactctaagtttgactaattttatagaaaaatgtagtttgactactctgaattttagggtttagggttggggttagggtttagggttttgaaaggaaaccgtcataaaatggacacttggcactaggaggatgaagatactcattggatgcttgaagaaactctatcctcccaaggcacctccacatataaatactcctcccatccttcattctcacatacactaaatagagctaaattataagaggctttaagtatactttaggttatttatatgttctgttttttctatatataacattggtgttataaatgagtttcttgtccttttttcataaggattgactttatccatagaataattctaattaaaacaatactaaatttcttccaaccaaccctagattgttcgagcaccacattattatctacattttattatgtagaaatagaaatatgttttgagtggatattgagtcgcattttattatgtagaaatagaaatatgttttgagtggatattgagtcggtttgttagagatttggcaagagactgcctatgtggtcttgtttgtatattagcatattatgccatgacaagaagtactgccctgcccttgatgtatgcttctgtgctctaattgattcaatatctaattactgcaattagtgcagctaatgtatttgcggaaaaaactccataatacaatactccacatttgttctagatttcatttttgtttcaagtttgctggtcctactgcatgtgcatgtaatagaatgtaatagagtgcatgtaagaacatacgaacaagtagaccaaggatttttgcaacgtttctttgagagtttatttagggacctaaaacaatttactgttatgtggattgaatatgcttgctagtcagcttgtttgaagctcgatttgagaccttttacttaagaatatcttgataagcagtataattagagatgtaatttttggggcgtatggaatgagatggttcactgtttgcatatttctgaaagcactatattgatacatactatatctgttgtatatatgtttggatttgatatgttttaagattttttaagtgagcacttatgtttttctacggcacatgtcccatttaagcaaactcatacaatgacagtgtggttatgcataagttacatgtaaacaaaaacattttgttcaggacaagcagcagctattaattaatcgaaaggcacaaaacttgagaaatgaaatgttagatttaaaaggttttacctggtcaaataatctgtcaagcaaatccagatgatgtcgacacctcaaattgtaatcctgagaatctctcgatctctgcacaataaatactcataagagaatagtaaatgtttgttcgtaaagaatttaaacaaaagtgaaagtaatattaccattttagcccacaattttatggtgtttctgatcttttctttttatattcttgacatcgtaagttgatcttttcttttatattcttgataccgtaggttgctccctgatcacacatcttctgttggatcaaccgataagactcttccgacagctcaccagaagcctcgacttcttccacacaatactgatataacataagtgtgtcatcatcgctccacgtgaccctaggaaaaaaagaacgcccaagacttagggggagaatgatggaataagtcttgtggcgcggaggggccgaatctcgtgcgggcgaggctgtcggtgacggaggtgtccaccatctcaggcttcttggtactgcaaagtgaaacatttgatgaattaagatttatctgagtttatgccaaacatcagtttccctatcggaagaaactatcggaagaagaaaaaaaagcacaatttcacaacctattagtatggttgactcatgtcgaggggaaaaaaattacagttaatgagaagttaattgatcacataaatttgaattgtgcccttgagccactgccatgtggggcccgcatgtcggcgcgccccctctctctctctagggtttaataatggcgcaataaatcaattaaggacttttctatttatagtaaaaacactgtggatcttctaaaattcatagaaaattcatccgagctccgtttaagcccattcaagtctcagtaaattaagaaaaatgcaaagaatccattaaaaatggttttgttctctgttttagtagtcttatagcctttttgtattgtttgctttgtatgtcgcttagattccggctctcccgacgctccggtgtactttgagatagtcgccgaggtccctccagctgcagagcaaggcaagtcatgcttgtcacttaaacatgttgatcctatattgcaaatgctctattattttcctttaaatactgcattgttttacaatgataccatgggatgtttacctactgtcttagccatactaattatttccttgttcctttgttagcttgggttgtaacatgattagatgttggactaggaatttcttagccatgcttagtgtcacgccccgaactagtcccgaccagaactagcccgtgacgctccaaattaacctgttaatcgataccagtcccaggaaacagtgctagtatcacaagaagacagaatatcacagcaacagaggtctctttaatatagagaaggagtacagtcatgttgggctgcggacagatcccgagctcacaactgcattacaaaagggaagcggaagccaagacttggaccaaacaacacaggcgcgacttgggaactaggccgaaaccctaaaactcaacgtagccggcttgctcctggaagaactcctcgtcagcgggatccgcttcatcttcttcagcaactggggggtagttatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttctcaaacgacacggatgagacagtgcgtctcgtccggtcggagtatgtgcaaatatatcattctttagaattgatcaagattggcacccggccaacaactttcaaacagccacccgggcctagctgatcccatcagctgcagattttccaaacatcgatcccctttccacaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcacctagcccgtggggatcagccacgtcgggagacctccaagctttcatgataaggcatttccaaagccgacacaggtttaccatatgccgacgagaggggtcccagaccaacaacaggttaggtcccagaccatactgtgccaggaagcccaggggtcctccccgacaccaccccgatgaattcacatgtctctcggcatcaaggctcccctgataagctagttactcggccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcactgggtgcacgaatatcgagacgcaactagatggttgcaaggggacatggtatcacaattaacaaaggaaggatcaaatgcaacaatttaggtaggtctaccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaaataaagccctattaatgatctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaagaaggggggaaaattagacttccctcgggcggcgagggcgcggcccgagagaaaggaggcggctcggccgagctaaatgggccggccggcccaaaaggcggcccagagcggcccaagacgcgcgcgcgcgggagggaggagagagagagccggtggaccgggctcaccatgcgcggtctcgggtgggacccgcttgtcagcggctcggctcaccgtgcggagggagcacgcggcgcggcactagggtgggggagggacgcgatgcacgcgcgcggttcgcggtggatgcggatgcggcgggcccacgcgcagcctcacggctcgcggtggaacgcgcgcacggggagggactgaccggggtcggctcgacccggtcttggctgagctggcgccgacgtggcgcctacgtggctgccacgcgggccggcgggaggtagacgatgacgccggccggaacggacggcggacgacggcggcgagcggtgagcgaaccacggcgatacaggcaa

SEQ ID NO: 68796 - DNA, 33415 bp, Oryza sativa
  unsure (1)..(33415): unsure at all n locations
actatcaccctgaaacggcaaattaacatgctaaatcgcaagaatacaaaatggtcgtcgtttctgttatctggatgcacataactctgttatcaccctgcaaccgtaaattaatttgttagtgaacaagacatactagtatcatatatataggagtatcacctatcacccctgcaactgtaaattaatttgttgctgaacaagggagatattcacacgcatacaaaaattagcaagaaagcagggttgtttatgggagataattaattgcaattggtgggcaataagtttattattaccaggggtgaccatgtgagcgaaagagcggatccaggttgggctgagcccaaagtccttggcacacctcatgtgcgattaggggggccaatcattgcgtggatcattgtctagtctttcttggtttctagatccaattttattagtaccccaacttgctcctccgtataattatgctatattttgaccaaaagccaagggcgtatatgcatcttataattaattaattggacaagaacacacttcgatcgtagaaagcactaaagcgagatggtacattttggtacgtatatgtgctgatggtttactttgtccatcgtccgtgtgcaaataaatattagattggaaaatgtgcaactaaattggaacaaataaataagctaaaaacccttttgattggagatactatcaaattaattctattaaaaatcttgtcacgaaagaaattatatgaaaaatcatccgagatgattctaagttagccagaggtgatggcacgcgtgctgctgttttttgtttatgattatgtagaagatgcacattatattacatttatttgatatctgttacagtgcacaagaggaatacacaaataggccataacatttcacatccagatactaaattcaaattacatttataattttgtcaacttaattattatagtctcatgagccttaccgagaaattttttattattttacctttttaattttaaaaatagattctcacaaaatttattttcagttttgaatcctttggcacacagtctcggtgatgtggccaaacaaaattgccacgtcattgtttcgcagccaccgacacttgtatgaccaaaaagttcagaattagaaaacaaatttcaggagagtctacttgtaaaattaaaaaggttcaactttttgaaaaatccatttactgatgcatgctacatgtgtggatgcatgttgttcgagctaagagagatggctttggatcaaaagaatcccatcaaataattctggatgttcacataaatttcaactatgtatggaatacctgaatagaaaatcaaatcattttactttcataaacattaattataactctctgcagttttttaaatacacgtagaacaaaaaaatattggtctaattaaggattttgaagatattgttaaaatagcatattctcatgatccagataccaatgactacttattaatttataacgtaatatgtttttatgcaaatagtactacatccgttttaaaatatagtgacctaataaactagatatttctagtactagaatatgtaatatatcttatcccgtattagatggttatattttgatatagatgaagtagaacactaaacgctcgtcagattaaaaaaaaaaactctggcagccaaattagaaacttaattatttctcaacctggactggagatcgatatacgtgatgccagtacgcacaaaaggaactgttggagttattttgcatttaaaacggtcgcgactgtacttcttgattgcaatgaaatactcctgccagcccaaaaaagaccattgaaaaaggaacctaaaagaggaagagaaatcaaaggggcgatgccctgtagcagccacgtgaacggtcacatgcattgctgctgctgcacggcgatcgctgaagaagctagctaggcccccaaaatgcactgaagctgcatacagatacagatacatatacagagggttgtgggcacaatctgatcgaactctgtagtctgtaccatgccgatatcaagtacctcctggcctaaaatctctagaaaattaacgtcatcgagcttcgtgtatatgttcttggaaaactgtacaacggataacgtattcgggaccatttagtactactgattaatttttagaaaatataataacggagtatagtatatattgttgaataataaaatttaagtgatctcgatgatggtgtagtctaccagtagtagttggtgatggctcatgtgacacgctttgtgattttcaatttgtgccgacgatttgtttgtgattttctaaagttggtagttatgttaaaattaatagaaactatatgcggataacttaaggtagtatttggttggttggtgggatgggatgggatgggatgggacgaacccacttttagaggtgtttggttgaggggcgagtgggatgggttggtccctagagaggaatattcctcccagatccgggacaaacccatccggcaaaatcggccggacgagctcgtcccacttggacggagcacacggcgtctccttggcgaccgccggcgctcgtccgcgcccgcgcacgctgcctcctccgtgaccgccggcgctccgccacgaccgcctgccaccacctctgcgaccgccggcgctcctccacgaccccctgcctcaacatcggtcgccgccgcgagcgagatgctcggcgccatcccgccgctcatcgtgatgctcgacgagagcggttgcagcagctgcggtgatgtcgacgcggcgggctcgagtggcggcgaagcttggaggtagggagggcggcggcggcggatccagagacgggggactcggcggcggcgaaacttggaggtagggagagcggcggcggcggatccggagcaagggatctcccgatccagccgcggcgacgacggtgggccagcgggttgggtgctccggcggtggtggccgtcctgctgctgccgctgtgcttgatccggttgttccacgcgtggatgcaggtggcgcagtcaatggtcgttgacggtgatggcaaacggcgtccatctcatctctccctcatccctttaaccaaacaaaaaattgggattgtcccatcctacaaaccaaacatgtgagtggaatcattccaacctcaaaatcagggatggtttcatcccatcccacctagtcccgaaaccaaacacatgctaagagataagcactatcgataaaaagagataccacctctatctttaaagagttggtacttattcaagaatttgtcacagattactgtttattttcaagctttgatcgttccttttccagcaatgaactttataaatccaatactcttttagaggctttaatttttggtgatagcagtgaatctgctactccatctactcatattttagtttgagcatattacctcttgaattgcttaatattatatagcaattaaatgtaaatagatagtggtatataaaattaaattaaggtgagtatcttacataaaagatggggcaacatatttcatgaagaaaatacttttacttatgatagtcaacaatattgtgatcatttttcttttatctgtggcaatagcagagcacaggcacctagtacttttaaaaatatgctaccttactggtgtgttgtagggatgaaaatggtgcggatacagacggatactgcccataccatatttgtttctatttttttggatataaaaacgaatacgaatagctcagatttagaaacaaatacgaattatctcaaatacgaataaggatcgaatataattagacacgaatacataaatatttttttctcggaacacggaaaccacctcaacttctaatagaaacaaataccaccatatataattagcacattataaaatatagtataaattataaaaatattcaaaattttaaataatattaataatgtggactagtgttaagagatgagctattattaatctaaaaaggtagattgaaggttgtagagttataaaaaaatgatgtatttctcatgactttagcggatatccgaataacacggttcaccaaaaatttatattattatccatatccgtcggaaacaatgataacatatccgtattcatatccaggagaaaataggccatgcccaacgctcctacatgccgtgtggtttcatcctagtggctccataaggccatgccaaacgttcctacatggcgtgtggtttcagcctgccctagccaaatattcgtgccggcaaggacggagttgtgcccctacggggacatgcgtacccctgtgggaggtacgcgtgcctctagatgggagatgccttcggtggtccaggcctagagaggaggaagagagagggagaatggggaaaagtaaggacacctagagacatggagtatgtcgaacagacaaaggactccggtgaatagatcaggggatcaggaagctaatcaggccaccgctgacaaaatcgacacgatctcattggagaaatcgatgcaacctcgctggatcgagctcccaccacctcgatgcacccaatgttgttgtcgggccgtctcttgggaaggaggggaggaaggatgccccaccgtcttgatttggtcaatgaggtaggagggctcgtgagcatggcggtgggcggagaacgagagagaccgatggcgcacgtggggagaggagaggctgaggacgcaaatagggggagagatgtgaataagggagaacgcagcagcaatgcttgttcgatgggggagatgcgaatcaatgagaaagagagggttgggtggaaaaaaatatagaggaagtggacgacaaatgggaccataaaagattaagggtacatatttgccatattacctaaaacataaaaggttcaggtgatcttataataataaatctcaaagacctgacatacaaataattaagtactgaaaaaaaacatgtaagtgtgacctccattgtaggatatgtgacctactgacctatgtgtggtgtcagctcacatggcccacgtgaaaccactgctatatgtgacctccattggccatgccctaccgcggcgtgcacctattgattcatgcctggtttgtgcatttggtttccatcactttttttcatctccttcatgatctttaatttctttttagtagttgtggtggaggaagcatctaatcacttatccaagtctgaactgaatccataccataaaggatgttaaagtacattcaccaaaaagaatctagttcctattgtctggtgatctgcaaagttttttttttttgagaacttggtgatcaactgaaaagtgaactggtgagagcctatgcagactaaaaataactagtccctcgttggacttcgacatgacctcttctggtagtaatagtactcttaccttggacaatcatgaagtagtgcccagaaactggtggcttcattcaacaaacgctacaaaactaatacctgaaagttcagggttgtatccttgtaggcatcagttactacaaattaattgcctgttagtattgcaaatgtttctggacgactttttggcagttaaaagtgtgtggtgccctctctagtctctccttccttgcatatatgtactctacagtactatatggcctatcgattctgttgcctaagcactacaaatttctgaatgggacctaaccatttgtactatacggaaacatgcatagaaccagaacatcaacatcaactgcacggtaagtactctgtgtctaaacaagatttcggcaatactaaaagggaatggctatcaagctggaaaagtggatgggtttagagacaagaaattttatacaggttcaggccttcttaatcaaaaagtaataccctactcttgtccggggattgatccgccgagtatattattaatcgtatgatctgggtgaaaatcgtgcccctagaggcacccggaccgctccttatataggggaaggggtccgtattacaaagtacagtccatatccctaacggaataggtagttacagataaaatataatcgtaaccgactaggatcccgggtattttcttgacatacaagtttagaacttaacccgagtccctttaaagatattctatctatatatggcaccccatactcagtcagatatacatgccgtgtaggtatgaggtatccataatctccacagtagcccctgagacctttacagtcgacgaaatagccttctctcgtaatccaaaacgataacctgagtacctcgactccttctgccttgatctcccgaacaccaaaatcaaagacggtaaagggctgaaaacaaaaaatcgggtgcatcgactagatgcacctaattaggtgtagcccccgactatgtgattagttaaaaactaaacatatagtcaaggtgcaaataacatccaaccgagtggttttacaaccgaattatccaaaatatcatacagccaagcacatgcgacgtttaataaaacaaaacatccagccgactgctttagctttaatataccaaaaatggagatataaagaggcctgagtaaaaaatactctaaaggtccataaatcaacacatatgacaagaatccgagtaaaaactctcaaaagatccatcaaatgtggtataaatatgatatcatgataattgatgagtctaaatagcctaggctatgactcacgccataatcaaaataagcatataacatgccgagaaaatgattgttcaaaaaccagtcatctcaacaaaacccaaacagcctttgcagcctaaaaaggctcacaaaagtagtataacacctttctatcgggcacctttttatttgcatcataataattccgaggaattatctaactgcgtcaaaaaggattttaacagcattgggccatactgttgtaagcaaaaattgccgaagcaaaaatgcctaagtccctaaggatcacaacttaaccacgccgataacaaaattgggctgaagtactgttttaggcccaggcccattagtattcccgatacccaaataacaccaaaagccaaacgtcgcttcgtcttccccgccgaaactctcgccactttccccattctctgctacagtgcaaaagccgcgccggcgaaactagggttcaccgattcgctccaacccatcctccaaaattccacaaaaacctcccatgcaaccaccgcatcaatctcccatccattcccagccacatctcggatcaaatcacaccatctagttcgtatccatggcggaagagagagaaagctttgaaggtcagtgggcgccctccgatgtaacggaggagaacttgaaggagatggtggcgcacggcgtccttccggcaaaagagatcatcgggtggcgtccagcatatggtgaaatgttcccgacccccgacacacacgaggtggtggtattctcccatttcttttatggcggattttctcttccaacctcaagattcttccgggggattttggagttttacgggatcaatttgcatcatctaaaccccaactccatagtccacattgccaattttatccatgcttgcgaagcttttctggggattaggccgcatttcgctctattccgccgtatcttcttcctcaaaccccagccaaacaaaagcaaaccatgcgtagttggggcagccatatttcaactgaggggaaccttgagccaaaaatatttctccatgccttttaaaacttcaaataagggttggcatgcaaattggttttatgtgcaaaatcccgaaccaactcttcccgagtactcctgccttcctccagtgtatcaagatacttggaactcacttccaatgggagatgaagctgctcaagcgcttgccctgatggatcgtatactgaagctgaaggagtagggtctgcaagaggaacagatcacccgacattttatcaagagctggctggccccaatcaaggaaagatctcacacggcttttgaattcgacggcaagcatgaccctaaccgcgaagatctagaatctcttgaattcaaaattatgaaggagagaatgtataaaatcttctcaaatgcaatcgtagtcagctattcgcacttgctgccagtggtgccatacaatgctttcaacccccctccaccggtatatatttaacatctcagcctttctcaaaagcatgcttttatcatctacaaagttgattgaaaacttggatcatcatgcccaggaattcgccctgatgaagtcagatcctccaatcgctcaacgccgctcaccccgtcggcaaactggtcaagctggcggaggaccaaaaatccggtctgatactcaacctaacacctctcaatcggctaaccagtcagacttccgcaagaggaaattggttctgagtgacgatgaaaatgacgatgctgaaaaggctggcagcaaaggggtgactggaaaacagccaaggcaagctaacccgaagaagaaaacatccagtcgtcccatgccgaaaatcaggaagtcctccaggtacaaatcatttggccatttcccttgtattgttgctcactcactattgaaatagcactgatagcataactcaaatttataggaagccatctgacatagatccttctggaaaaggcctgagccgactgacacggagacgggtccttcaaaagaaaccggagcaactgccgaagatcgcctgagtgataatcaaccagcaaccgacaatgtagagaccagtaacgagcccccgactggaaatcagtcggccgaagctggagtcggtgctaatcaggagcccccgactagaaaccagtcaggtacagaacaaaataatgacatcccggaagtagaagcccaggctgatagccctcccaagacgagtgctggcgtcgactctggaactaactctcctgttagggtgcaaggacctgctcgtccccgaccggaaatcataacagataagcaaatcctccaaatctgttttgatccgacaaactttctccaattgtttcaccattattcatgaatgcataaggccccgatgatcggtgacgaagaagaggtcctccggatacaatcggctgaagattctcgcccacccatattagtcaagtggtgggatgacgaaatgcaaccacaggggatcgtaataaataaacaaaaagaggacgaggaagtatgtctgctgaaaaagacactcggccaagctactcgccttgtaaatgtaagtctccctatacacggcttcaatcatcctgtcagctactttgcttagatacagataaatttgtggtgcagagaatccatctcaggaatgaggcgaagaccgcaactcttgaaaaattagttccctagcttggaacccttgaagcaaccaaagaccagctgcgtgaagccaaagagcttgctaggaaaactgaacatgaccttagagatcggattgccgagcttcaagactctaactttgagctgagcggttcatcaaaagataaacatcgtctctgtttgatttgtttcatgttgctatccatgtgcaactgaccaatgaaaagcaacacagtgcaagcttctaggatatccgcgctggagaagcgaatccaagctctggagaaagacaaggccgagttggcaaaacagagggactcggctctgaaagatgtcgaaggtactggtagctgaaacttcaaaaaccactctcatcttcatgcctagtcattgatgtaaacctatttgtgtagaccgcaagatcaaatcctaggcccaattcgacgtcttagttaataaaattaagaagcttgaaggagccagagatgaagtcgccaatgccgctacgccacttgtccaggccatgtttttcaataacaacggtccaagttcacttgatgttgtcgaaatcttcgacaagctgagagctactccggatacatactttaagaacatcaaagaagctgggagtatgggagcaggcctagcgctggcgatgaccaagtccttgtacccgaaaattgatattgatgctgttgacggctttgaagatgggacaagtgaagaagccgcccttgacctcatcagtgatgcgtaaaaatctgccgacaagatagccgctgatgtagtggagagattccaggacaacaatcttaagccgactgggtctgatgattctgatgatgagaaaactgaatctaattaattgtgtattctgatgataatgatgatgacaatggagacacaatttgtactatactgatgaacttatgctgtgctcgatgatttaaactcagctctagatttcttaaaagtttttgtcaaaccttattgagcctagaacccgcaaaagttgttaaaaactttcagtcctttttgattgagccaaaaaatcgaacaaggcaatgataaatcaagtaagcaaattgaattgataaaaatcacactccattattattatagtagcccccaactgacaactcaaggaaaaacttgatgttagcagtcaaagaggaagatacaaaagtaatgcctaagcataaaacgacgaagatgttcaatatttcaagagttgtcgatatgagtaccgtcttcacgcttgagttggtaagaacctggccgagtgacttcagaaattatgaacgatccttcccacaagggagataacttgtgccgatcccgtgtagtttgaatttttcttagaatcaggtcgccgactagaaaagttcgtgatcgaacattgcgattgtgataacggcgcatcccttgtaagtaccgagccgactgaattagggctgcttcacgggcttcttccagtcggttgagatcatctactcggtcttctccgtagcgctcctctctgtagttacgaaattgtagagattcaaattccacctcacttggcaacatcgcttccactccgtagactaggaaaaacggcgactggcccatagcccgactaggagtggtgcgcagggaccaaagtacagatggcagctgttctacccacttgccggcatagggatgcagtcggtcaaaaactcgtgcttttattccttggagtaccataccattggcgcgttcgacttgtccattgctcatagggtgccttacagaggcataacaaatcttgatgccgaagtcctcacagaaatctttaaatactcctccagtgaattgagtgccgttatcagtgatgatctgattgggtatcccaaaccggtgcacaatgttgacgaagaaatctctagccttgtttgccgtgattgtaatgaccggtttagcttcaatccacttggaaaatttgtcaacggctacaaagagatgagtataactaccgacagcctttttaaatggaccaaccatgtcgagcccccaaaccgcgaacgaccaagacaacgggatggtttgcaactcttgagccggtagatgagtttgtcgggcgaaaaattgacaaccctcacatgttcgcacaattttgtcggcgtcggacacagctgtgggccagaaaaaaccctgtcgataagccttgccaacgatggttcgtgcggccgcgtgattgccacagatgcctgaatgtatatcctttagcaattgtcttccctcctccaaagacacagcgttgcaggattcctgacagacttttcttgtacagctcggtctcatgtaagacataaagtctgctgtgcttggagatctgctcggcttcatctttatcttgagggagttcttgtttggtcaaaaatcttatgaggggctctctccagtcggcttcaatcatgcttacgccttgagtgtttgtggcctcgattatttctttccttggtacggttggctcataaagatgctcaataaacacgtcagaaggagctgcttctcgctttgaaccaaaattagccagtctgtcggctgcctcattattatgtcgaagaacgtgggttagctcaagtccatcgaatctatcttctaacttgcgtacctcctgccgataggcggtcatgttatcatcaaggcaggaccactctttcatgacttgattaacaaccaactgagaatctccacggactattagacgccgaattcccaaggagatcgcaatccttagtccgtgaagaagcgcctcatattccgccacgttatgtgacgcagaaaaatgtatccacaatacgtagctcaacctctctctagtcggggagattagaacaacccccgctccggtgcctgaaagcctctttgacctttcaaaatgcatagtccaatactccatcttctctgcaggcgtgtcttcttggcactcggtccactcggcgatgaagtcggctaaagcttgggacttgatcgaagttcgcggcttgaaggatatatccaaagacataaactctaaggcccactttgcgatccgcccatttgctttgcgattatgacgtatatccccgagtggaaacgatgtgaccaccgtgaccgagtgaccttaaaaatagtgggataatttcctaatggtgattagaacaccgtataacagcttctgaacttgaggatatcttgtcttggagtcagccaaaacctcgctaacgaagtagattggtcgttggactttttgaacatgaccttcttcttcgcgctcaacaaccaggactgtgcttacaacctgggaagttgctgacacgtataacaacaacggctcttgtggatgtggtgaagctaagactggtggagtagtgagaagttttttgaagtcttcaaaggctttttgtgcttcgggtccccactggaaattatcggttttctttagcagcttgaaaaaaggcatcccccgctcgccgagtcgtgagacgaaccggctaagcgccaccatgcagccagttaacttttgaacatctttctaggagctcgatggtttcatgttgaggatggcattgattttctccgggttggcttgtatgcctctatgggacatcataaatccaagcagcttccctgacggtactctgaagatgcacttttcagggtttaatttcatcctgaaagcgtggatgcttgcaaatgtctcttctagatccataatcaaatcatccttctgcttggtcttgacgactacatcatccacataagcttcaacgttgcggccgatctgagttgaaaaacatctctggatcatgcgttgataagttgctcctgcgttctttaatccaaaaggcatggtgatgtagcagtaggccccgaagggcgtgatgaatgaagtctttaagcagtcggattcctttagtcagatctgatgatatcctgagtagcaatccaaaatactgagtagctcgtagccagccgttgagtcaactacctggtcaatgcgaggtaacccaatggggtctttgggacaagacttgttgaggtcggtgtaatcaacacacatgcgccattgccccgtcttcttctgaaccaggactgggttggccagccagtcgggatgaaggacttccttgatgaagcctgctgctaacagcttagtcaattcatccttgatcacatcttcctatcctgtgcaaaacggcgcagtcgttgcttgattggtttagcgtcttccttaacatgtaaagagtgctcaatcacctctcaaggaataccaggcatatcagatggtttccacgcaaagatatctttattattttgaagaaaggtgatgagcgtgctttcctatttacaacctaactcagcgcttattacagcagtcttagtaggatcagagggatatagaggaatcttcttggtcttggcgtcgctttctccgctctttggcatcttggtcgcaggcacttctccttcgcttgctgtggacgcagccagtcggatttcttctcgggcgagcgtgatctcgcgggtctaggccatctcgcagctttccttgtcacacgtgacggcttgcttgatgtcactccgcagggatatgactcctcgaggaccaggcatcttcatcatcatataggtatagtgcgggacagccatgaacttggctatcgccgggcgtccgagtatggcatgatacgctgtatcgaaatcagcgacctcaaaacaaatgttctctgtacggaagttctcctgagtgccgaaagtaactggaagagtgatctggccgagtggcgtagcagatagccccgggatgactccgtgaaagggcgcattactcggctttaattccatgcgagggatctgtatgtcgtccagagtcttggtgaaaaggatgttgagtgcactgccaccatcgatgagggaccctgcgaagcttgacgttgtgaaccactgggtctagtaccagggggtaccgccccgggtggaccactcggttaggatgatccgagcggtcaaacttaattgttgtctctgaccatcgaagatattggggcgtgttgggctgaacaacattgatctctcgttcggtcagcttttgctttctcttggattcataagctaggggtccgccaaagatgtggttgagttccttgtgatggtcttgaaaactagtcggggcatcatcttcatcatccttcttctttgacgtgctttgatctccgtcagaggtcttgcgtgcgttcttggcgtattgttctgcaaactgtttgtagacgaagcaatctttggctgcgtgattggaattgttggatgatgcgaacattgggagttcatgatcttgtcaaaagtgttgacgcgtgaacgttgtcgggaggatggtgtagtagttgccacaagttcctcgggcttacgcttgcgatccttgtgattggtacttccactccccctatagtcggcgtatctttcttcggctttcaagtggtgcccgactgcttggacgcggtaatggcatcttcggctttggcgtactcattggctttttcgaacatttgcttgaccgtcctgggaggcttgcgcccgaacttgccgactagttcatcgtggcgaatgcccttagtgaaggcggcgatgatgacgtcgtcggtgatgtcggagatcttgttgcgttgctcggaaaagcatcggatgtaatctcgaagggattctccagacttctgaatacattgtagagatcaaactgtgtaccagggcgttcaaaggtaccctggaagttggcgatgaagtggtcgcgaagttccgcccaagatccgattgtgccacggggtaacccgtgaagccaggaccgggcagaatccgctagggccacatgcaaatagtttgccatggctttgctgtctcctcctgctgcgcgaattgtgagaccgtagacggtgagccgagactccgggttagtggtgccgtcatacttctcgattccagtcggcttgaagccagctggccaatccactcgacgcaggtcgcttgtgaaggcagcaactccatccacgtcgtcgtcgtagcgatctggtgaatggtggggaacgtagcctcttgccgcgcgccgctggttgatagtgtcgcgaagatcgacggggcgcctgtgatgtggggagcgatgtcgttaaactcgatgctccctgtgtcgttcgggaggtgagtggacagatcgctcgtcgtgacccctgctcctgcgactggatcccgcgctgatgacactgaggcttggttggtgacagtcttgagatcgaagagggggaactcggctgctagtcgacgtgcggacgcttgcagagttaaccaggaccgaggcggcgatcatggtcttggtctggttcaagatgttgacgatgtgattggcttgattgagtgcgtcttccttaaggagggtgtcgaggagggtgatcgctgcaactgcgttctattgaggggtgcgaaaaaccgccgttccctcgacgtcttgctgcccgataagttctcgtgctcttcgcccggcatccaaggcgcgctatcgccggtcctcagcctcttttgcagcccgttcgcgctcctgttgctcacgctgcagccgttctcgctcttgtgcttggcgctcctcttccagtcggcgtcgttcggcttcctgttgcacgcgttgttcttctgcttcttgggctttacgctgttcttccgtctcgttgtcagccatgaagatgccaaagtagagaggcgtgtagttatcttcaaagtcttcatcgaagtcgtcgaggttgcggcagtcgtagcggtagccgaagtcgtcatactcaatgatctccgttggccgtgagtcgatgtcgggggagctgaggtagccatccagttgttccgtcgaaaccgtgccgagaggctggagtatgacgccgacttccctggagctaggctggatcggggctgaggccggatcccgcctagacctacggggagaagacgcccttgtggtgaagacagcagccaaatcatcggggagtttcatcaggattggcggataggccccatcgtcttgatcggatcgtgttggagtagattggatctcgcccgagtggtttgaagccaactcggtggagatgatcttggggtagatctcggccgagttcgggataccgaacggggtggagatttggcctcttcccgactggttcgaatccgagtcgaggagagaaatcttgccgaagtcgttggtgatgaagtcgaagctgccgaaccggaacgccttctcgggagggaagacgaagttgtcaatgccagaaatgaaacccatcgcactagtcgacgaagaacttgacgcttcccttacctggtgcgccaactgtcgaaacaagatttcggcaatactaaaaggggatgactatcaagctggaaaagtggatgggtttagagacaaggaattttatacaggttcaggccttcttaatcaagaagtaataccctactcctgtccggggattgatccgccgagtatattattgatcgtatgatctgggtgaaaatcgtgcccctagaagcacccggaccgctccttatataggggaaggggtccgtattacaaagtacagtccatatccctaacggaataggtagttacagataaaatataatcgtaaccgactaggatcccaggtatttacttgacatacatgtttagaacttaacccgaatccctttaaagatattctatctatacatggcaccccgtactcagtcagatatacatgtcgtgtaggtacgaggtatccataacctacacactatgacgaattgtcatgcaaccccctgaaaaataaaatactaagcctacaaaaaaagattcttgtggcgcatatgcaaactaaaatacaaagtaatatgcaaactaaaatacaaagtaatcgccacatgcgtgttggctttgcaccagacccaccaaacgggagatggtaagctaatggagacagatacaagtacgtgtggttttaatttaattctaatgcgattattatacacctgttttatgtatcattactaaattatgggctattatgcacttagacccctaggtgccaactataaattttactattattttggtgttgcatctagaaattaattttgaggctagatttaaattccaccatcgaaaaaaaaaatccagaaattagttttggtgagctcatcagtatatgtccttttttgtgcggacaatctgttcgcatgatattatacgacacgattggactgcaacgaaagaggggccccactcgtatacagacgtcacctttcaactaactaattcccgcttgttccgagacaaaagcctctcttgcacaagtcacgtggtgagaggccccaagaaagcttacctaacagttcatcatccactagctagccactttgatcatcgatgaagctggacctttcgttaattgttcctcaattttctttcaggaattaatcatacatatatatatgcagccgttggatttgaagttgttgccacattcggaaggacgcaaaacgggatcagaatcctctgcagttgaagtcatgggactttatcattgacatgtggacccgatgattcctggacccaaatatcagtgacaaaagcaatgtgtatttgactgcagaggatctcaatccagcaaaatggaaggcgatggcatgagcaacacgccaacaagttcgaaaccttcttacaaaaagttaggagtagcctgtttcagcttaactacgggcctgtttagttcacaaacaaaagtttttacactgtcacatcgaatgtttagatatatgcatggagtattaaatgtagaaaaaaacaattacatagttcgccggaaaattacgagataaatcttttaaacctaattgcgccataatttaacaatgtgatgctacaataaacatttgctgatgacggattaattaggcttaataaattcgtctcgcaattttctggcagaatttatagtttattttgttattagactatgtttaatactttaaatgtatataaatgtatataagtatatctgatgtgatataaatggtcaaaatttttttttgcaactaaacaggtcctacgacaacaagcttgacaccaaagcatctgcacttctgcaggcaggcgtgtgtcacatgcatttctggctcacaggcacatgtatgtgtagttttaatttagccggtcagacaactgccatcgtcctctcttgatttcgcctaaaatgcacgctgcaagatagatctaactttgaggggaaaaattggagataataattttgctaagaaatagaattaatgctctttttttttgtttgacttgcaagcatgcatgtgccattttaaagaaagatcaatttagcgggataattggaactcacatgtctatatgcaggtcacgaatgactggattttgcggacgtacgtggcacaagggaatggctggtgggatctgcatttcccacgttcatattgatgttaatgaattttcccacatttatattgatgttatttatttagattcattaacatcaatataaatgtgggaaatgctagaatgacttacattgtgaaatcctccgtttcacaatgtaagtcattctagcatttccaatcctccgtttcacaatgtaagtcattctagcatttctcacatttatattgatgttaatgtctatctagattcattaacatcaatatgtatgtgagaaatgttagaatgacttatattgtgaaacggaggaagtaacacccttgatctgatattttcttttggaaaaagtacgaaaattacccctccaannactatcgcggtcgaccgaattatcctcctgaaccacaaaaccagatattctttacccccaactatgcaaaccggacgaattaccccctcggtccaatccgcggtggttttggtctacgtggcgtacgcatgacagtccaatcagcattctatttaaaaaaaattgtgggacccacatgtcatactctttcactcttcctctctcctctctctcactctctgtctcactctctcacgggtcggcggtggcgggtggtgggcggcggcactggggccgtacgaattacctcatcatctcctacggcgtcttcagcagagtaacgccgactccgaggtggccgccatggctgctaccaagaccgtcgacgacgagtcggtggagtcctacgtcacccagatgatgcacggccctctggtctttgagtagaatgatggtggcggtgaagctgatgccgtcaacaaggagggtgtccaggcgatcccctcgtcgtcgtcgccgatgtcgtcccccacgcctccccgcgtccgccgccagccacctgcgcaacctccgcgtccgccgccgccgtctgctgccatcctcagtggtgccgtggcatgtgctgatgaggggagggaggagagagagatagaggtggggaactgacaggtggggcccactgatttttttattaaaagaatttctgactgtattgccacgtaggaccaaaaccagcacagattgaggcggggggttagttgtccggtttgtatagttgggggtgaaaaatatctggttttatggttgggggtaattcggtcgaccgtgatagttcggggggagggtaattcgtacttttctcttttcttttccatttatacgtttgaatattactgatagatcttcatttgttggactttatcgacgatatatgtaattcaattccccttgattgttcatggattctaattaatatctttaactttttctcttttttttacggatgaccatgtctatttcatcaaacagagtaaaaaaaaaacagtgttcagaacaaaacagaagatgccccccagggtaacagtctaccattacaacatatttaatacgatcaggaggttcaagatgcatagccaacaggcatgaaaccatagtagtacatgagttcatatcccctacaactggaagttttaatagaagagatacagttataccaactcattgaattaatcattgttatcaaactattagaaaagaagtaattaatgatatgcactatcagtttctcttagtactgttacacaaattgatactgatgaatgttacgaaatgttgatatatgaaagtacttacactataattggtgtgttaatttcaattccatataataaatccaaattttgtgtcaatattgcaaagatcccaatagggtttaccaattcagcttatttatttcatttaccatgtttcatttatatagagaatagtttcatttgcatttaggtgtggatggaacttttttatttgttggatcattttatttaaattttaaaaacataacgtgaatagctagtgggtgtgaaagtatttgtagttcgtagcaccattattcatggccacgccacgtcttcttaacgacaaaatttgctacagggcatcaaaaaaacatgtaattagccggtgggcaccgtaagatcgtgaatttgctgcagggcaccatcaaaaaatggtaattagctggtaaatactcggcgtattattttattatttcggaggaaaagaggtgtgagaatttttgaattggcgagaatgcccccggtggcgcacccagttatcccgattgggtccggtcgaaccagacccattcggtctcgtcgccgcaccacatatcccaacctaaccctagcctgcgagtgaggaggtggcggcgacctagatcggcgaccatatttggtgagggtggcagcgacccagaccggcaagcagcttcgttcacctgcaccagtggcaattgactggaattccttgcacacatgccattttcacctgcaccagcgagctgctgccagcaccaggttgatgttcgccacggcgaagccgagccgcgtcgtgccgagcgcagacacctaatagcacatcttgaacggtttcacgggcggcacgcgggatgggataggcaccgccttgaggttaacggcgatgctggtgacgcggaggtaataggcgccattcctggggttcttgaggaggggcacggggttgcagcggagaccttcggcgatctccacgggcagcgctgcaaggagctggaatggtccgcagatggccacgccatcgccgccgccgctagccggtggggtctagtcgggataacgtggtgcgctatcgggagcattctcggcaattcgaaaattctctcacctcttttcctctggaaataataaaataataccctgagtatttaccagctaattaccactttttggtggtgccctacagcaaatttgcgatcttacggtgcgcaccaactaattgcacgttttttatgctctgtagcaaattttgcccttcttaacatgcatgatagagttcaagatagagatcttttcaatgagaatggcttgcctaaaaggttgagatttagaaagtatgttcaagatagagttcttttatagggctccatatttacctcttaagatatgacaaactccctagccattcaattcttgatagtttattttgcaaaagaaaatgttgtctctagccaaaaataaattatccaacaacaaatggaaataccaacacacataattacactcgtttaagttaattgtgaatattgtctactaaatttgtgcatacaatcaattaaataaccggaatcagaattttaaacaaaagattgaaatgtactcatattctcctgtccacaaattaatatgaacatctgaagcatttgaaatttgtccacaattataagcattccaaaataccacttgtcacattaatcacttctcattcaaacttcttcccatcttacccctaaccacacaactactcccatccatcactcatttaatgaagataccaacagtggcggatccagaaagaaatagcagtagggtctgagcaaactagatagagttacagtccccctcccatctacatatggtaaaaaattttagtggggtctttgtggggtctctcatagtcttcacgtcagtagtgggggctcgagaccccgccgccccatgctggatccgcccctggataccaaagtcttttgtttttaaccttaatctatgataaataatctcgaaatgtttatatatttatagaatgggggaatatcatagtaaataatgtgtgtaaaagtatgttgaggtacttgaaacagagaataagtatttttgaagtcacatgttgctatgtaaaaagaattaaatgcaattaaggagtatttttcttctaaatgagttaatttctactgaaaatagtttaatttgtattcttttagtatatgagataagtccatttgacccccttctcgaattcttcgctttatctagaatacaccctcgaactccaaaaccgaatatttgacacccctaaactttcaatctcgcttactttacacccttgagtggtatttttcccacttttgttacactacacgacacgtcagatgccacatcagtagggtgagagaagggtcccacttgtcaatgtcactgtcttcttcttccactccctctctccacttcccagctctgcaagctcgatgcggccacaacaagatgatcgaagcggcccatgaacttcctgccacaccacctagcctccgccagtgctcttcccctcctgccttcttattcttcgtcccttcctccctccgctctccggcaatgatggggatatggagctcacctcctcaccaagcgaggcggtcggtggctagtttggcagggagcccactgcccaccctttgtcctagctcgagagaagatggggtcggcgaggttgacagggagctctcttggccaaggtcaagagaaaacgagtaggggtgagtgttcggttttatggttaaatcagttcagttttttcggttctctagaattttggtttcatatgaatggcaaccgaagtgtttgataaaaaaaataaaaccgcacaaaataaactgaagcacatcggttcggttcctcggtttaccgagaaaaccgacctacttaccttgcacgcattccagagagtgtcaggatggctagatgcgatcttccttgcggccttcacggagcgaacatatccagcatgctagttagggcacccacaatggttatctataagctctctacaagagatccatgtcagcatattttcctatttgaaagatattaaataaagagagagagcaaagctatctactaacttagagatagtctatagagaaaaacgaggcaatgcatgagatagctatagatacccatgtagacatactattgaggtggtttactattaatctagtctattgctgagatgtacatgttttatagtgagcaccttactttaccattgtgggtgctcttagcagcctagttgtgttaacgggctttggcttattgagttaagtggacttttcagagtttcacgtcgccaacacaccagggaatgactttgggctagcagtgcacgtatctagatcggttgttcggcttcatcggttgttgcgaacagaaaacagcacaaaaaaccagagaccgaacaaaagaagaaataaaaagaagagaaaaccaaagaccaaacaaaccgctacttcggctcggttcagtccgatctttggttgtcggtatttttatgcccacccctaaagacgagggcagcggcgagcttggagaagtagatgaggaactcgggatggagcggagttttagcgacgaccacctactcaagctccaccctctttggcatctggatctagcggtgtctagttgagttttcggagtgtcacctccctaatgtccatgatacctctgccgtcacctcctacccaaactctataaacactactactctcctcggcaagcttcccgattttctcggggaactcgacgacagcctcctacccaaactgcccgcaaaagggtgggagcgacggcagtaggaagacgtcgaccggagggaggggtcttggtaatgggttcttcatttgtcgcgacagcgtactataaagtggttgaggagacagaactcaagctcaagctcgcagtcacatgcgctaatttactagaggaggaggcactgcaggatgtgacgctcaaggtcactcgagcaatagggaggaagctcaacgatgacatccatcgagaaggagccgagcgacggcccacagggaagaacccaccggcaacagctggtgggtgcgtccatagaaagagaggaaagatcaggaaaacgaggagagagaggggaaagagtggaagaagtgggtcactaataggtgggtctcgctatttttttccttgattgaactgtaacatggacaaaaagcactccgatttggtttaggactgtaaattacccaattttaaagtttaggatgtattttagataaacataatattttggggtgtaaaatgattgtaatataaagagataggtgtactttgttcgctcttcggctcttgtatgggtacgcgtgttgactcgtgagatgaaacgaggatttcaatgttaacacacatactcgcggtacaaattaattgaaccggtttgggaatttggtaacacctttgtattgtttgctcagtacatcgtctcccaggggaatttctcattgaacttctccagtgcagctagcgctgacaagattgtactagtatatacatatatatttaaaatcctgtactagcaccagtatgatacattctctattatctacgtcatccatcttttaaaataagatgaaagcataacatatcccattggcaggaacgataacactgtcggcaaaactcctagagatccaccacgtacccaccaaagataacaagttaattagccaaaaaccagtcatccctgatcagtttggcagcttcaataaccgtttgcctcaccgtccaacacccaaaaacaaaaaaaataagaatccagaaaaaaaacatacaaaaactgtgatgagatctcgtccgcgacagattcctatctgatggagcacgtaaaaagttttatgccccccgatgacctgtaagttttaaacatggccgggctcggctcggctcacgcacgcacggtagctgcatcttgcagtgcagtgctgcctgcctgcctgcctgcctgccgatgccgatgcgtggggaggcgagtcgtacgtcgctgtcggcacatgcatactatgcccgatgtagggtatgtttggaaaggttaagcttctggtgatgtttggattagagactttaactttagtctttatatttatttttagatactaatttagagtattaaatataaactacttacaaaactaataacataaataaaagctaattcgcgagataaattttttaaacctaattaatccataattagagaatatttactataggatcacataggctaatcatggattaattagactcagtagattcgtctcgtgaattagtctaagattatggatgagttttattaataatctacgtttaatatttataattagtgtctaaacatctgatgtggtagggactaaaaagtttttagtcgcatctaaatagagtcttaagaagcagctgtttagttttcagcttgtgacttctagtttatttctagattttataattatagctttcttaaaatctagataaaaactaaagtgttaggagaagtttttgattcttttaaaaaaactgcagcagttataaactccgtccgtaggcagtttgatcgagttgagtgggctgatcgatatcacttcacttggcgtctgcttacgcctctggcagcagtggcacccagtactactctttttttttctttttggctcagatcaatgcgcccttgtgatttttcgcttgcgtacgtcctcccggagattggcgcgctctcgtgccgtcgtgcaggccaaaacgctggctctccaccccaacctgtcattaggttagttttttttttcttatagagtatttaatttggggtgcattgttttgtttttgtccttgtttctctctgtttataaaaaaaatgtttcttttttctaagactttctatgtggaatctcaatgacgtagtacgcttaatttttttgttaattaatttatacataaataatgattgtagatctgtcgctgtggtaagatccgtggcacaaatgtacagtggttcaaacaatattatagttcacaagttcaatttgatgcttaaatcaatcatattaaactttcataatgctaaattttggtattgctaatatttaagtaaggttaagatatgtatgtcgtatttagtttgttacatttgcgacttttttgtgagataaaagattctattattatcaaactttggtagtaaaggtaatttttgtttggattgttttcttgcaaattttatcgatgttgtcttttttccttcgttgggacctttattttgatgaaaatataagctatgttgattttataacattgaactgctatcataaccatatcgtgcgatctaaacatgtacactaaacagtaaaacatgaacagatccgttgacgagaaatccacgctcagccgatggtgctggaactgtgttggcgtgaactaagtcgacgaacacaacgacctgggagatctgcttagctctagtacaggtccaaaacttgataagatgcgagcgtaccagtcagtttgatcctgcaactgataagatagataaatatgttgatcaccaaagagccgatcggctgacaagccaatagagagattccagccaatgtcgatagggatttgagcaatcggttatatgttcaatgtagataatgatataaagataatcggctgatgacaatgtaataaaacaacaatataatccagtagaaaccaatcgactaataatgatatgatagaataaacattgatccgaaggttaaagcatacatcgactggaggtccgatgtcaataaatccaaacaattagataaacagtaaaacctttgttgcaatcggctaaatccaacttgtatgtaatccttataagccgatgcaacgttcatataactcatcggctgaaaccccgatgaaacccttattataatcaaagacatgttagtttttatgattctaagcacgactagggatgatgcatctcaaagtatgcaaagaagcataaagtctatacaatcaagcctttgactaatttttagggtggtggataccttagctaatctaatctagtaaagtgatttagccgataccgacataaaccctaaagcgagaatcagccgatatgactaaatcgatatattgaaactagataggcaaatatatcaaccgaactagagcgatcgaagaggtcgaagcgatgcagccttcaacaacaccaatgtaaccgatacaattgccagggccggcggaacgtaggacttaccccttcgccaaagatcgaaagccgatatagccccacgtcaagtgtcaagttccgccagtgataagtaaaaacctcggtaaagagggtggcgatgagccgatagtagttgtattgatcgagatatagtttacaatgaccccgagtgtacatatttgtacccataggtagatactagtccttcttggataagaaagaaacttttctaaacataaaaggaaaatataaagtccttattttatataaacactaaacacactttcctaaagataaaaggaaactaacaaactcttcctaattgatagataaaccgccatactgcattctccttgaactcagtctcttctggataaacttcctttaattaattaatttcctcaaccgaatctaccaagaatctgactgttggcgacttgacaactcccatcggctgattccagaactctgaaactggtactaacttattgatgaaaaatctgcgcttggtggtgctggtctgtgttggcgcgaactaagtcgacgaacagaacagcctggaagatctgcttagctccaatgcaggtccaaaggttgatgagatgccggcgtgccagtcagtttgatcctgcaactgacaagatatacaaatagcatatcaatgagtcgatcggttgacaagccgatgtcgataccagagtctgacaatgatagggttttgagctatcggctatatgtttgatgcagagtctgacacttgatgcaaataatgatgtaaagacaatcggctgatgacgatgtaataaaataacaatataatctagtgaaccaatcggctaataatgatttgatagaacaagtgtcgatccgaaggttaaagcatacatcggctgaaagtccaatgttataaaatccacaagattagataaacaatgaaacctttgttgcaatcgactaaatccaacttgtatgcaatccttgtaagccgatgcaacgtccagataactcatcggctgaaaccctgatgaaacccttattggcaatcaagaagaaggctagagattatggtactaagcacgacttagtagatcaaacttaactgatgcaacattaagtatgaaaagaaacataatatctagacaatcaatcccttgactgattttcagggtggtggataatgttgacggtcgttatcaatcagtttcgaccatcaatattaccaaaataggagagaactagtgatgcttgcatgcataaatatgttagaacaataatattccactagtattaggtttactaaccttttgcagagaatgaccataaagtggaggagaatcgacatcaacacaaatgataaatcaatcggacgatgttgagaaatagacttatgtatgaatgggccaagaactcagaattgacacgacacaataggccaaaattcacaagtctacggaggagaataacagaggaggccacctgccgattttgggctaggttgggccggcccctggttcggccgaactaggaggttcggccgaacctccctctccaccgttggatgtggggtttggcagggacgctccagatcctctcctgatggcggttgcggtgtacttcagacatttcgcagtagttacaaccatcatacctgcctataaaaggacttcaccttctcacttcactcacacacctcaagcaagagctctttcatctctctcaagtttagtttagtagtatctagctggtggaatagaattagaataggaatcaggagttcggaagtcttcggaagagttcgggtatggttctagcagctttccattcctcttttgtaagctttgtacttttattagaatactcttctatatacatttatggtattgaaatactttccgagtatatgagtacctactttatattatgttcttattatactgaatatacggctagcttatctgggaaatgctttggtgcgggtatagtgtttgcttatgcaattactctatgtcatgacgatgatattactctcgaagttcttcccgatgggcaaaaccgacgccctttgtggacgaatttccagtttccagcagacaagggacgagtccattccggaagcatgggaactactgcaggagtacgtggccgcctgtcctcatcatggaatggacgactggctgatcttgcagaacttttacaataggctcaccccaatgtcccgcgatcacctagacgccggagctggaggagcctttttcttttaaacggttcaaggaaccgttgaactcatagagaagatggtctccaatatgggttggagcaaggaacgactccagacccgtcagcgaggcatgcacaccgtcaaggagacggagttacttgctgccaagctagacctcctcatgaaacgcttggacaaccatgagaaacggccacaaggcaccgtcaaggccttggactcacacgtcacgtgtgaagtctgcggaggcacggatcattctgggaacgactgcccggaaacccgtgaggaggcgatgtacatgggcaacaacaacaacggttatcgtccacaaggagttcaggggtggaaccaaccacgctcatattatcaaggaggaaataataacggtaacttctctaaccaaccctccttgaaagatcttgtttttgcgcaagctaaagccactgatgcgctaagcaaaaagcttgctgccaatgataagatcttagagaacataaatgtctagctagatggctttgcttccgcatttcaaaaccagctgagctttaataagatgtagaaacccagttagctcagttggcatatttagtccctgcaaatgaaactgggaggattccggggcaaccctactcctccattgaaaatgttaaggcgatcacgacaaggggaggtaagtccactcgtgatccaccgtatcctaaccctgccggaactaatgggatgtcaaaagaaacgccatctaatgactcggctgacaaggagattcagccagaaaagacagtgccacaggagtactgcgacacacggttgctgccatttcctcaatggagtaggaaaacgtcagtggacgagctgttcgctcgttttgttgaagtgatccagaggattcacatcaacgtgctgttgttggatgcaatgcaagtgccaatatacgcccgttatctcaaggacatactcaacaacaagagaccgctcccaacaacggaggtggtcaagctgacggaacactgcagcaacgtcatactccacaagctcccggagaagaagaaatattcggagtgtcccacgatcacctgctcgatcggggcacaacaattcgaccaggccttgtgcgaccttggagccagcgtcagcgtcatgccaaaggacgtctttgacagactcaacttcacggtgttggcaccaacgccgatgcgcctccaaatggctgactcatcagtccgttaccaagcagggatagcggaggatgtgccaattaagatatgggatttcttcatcccggttgactttgtggtgctagacatggacacgaggaaggagacgccgctcatcctagggcgtccgttccttagcaccgcaggagccaacattgacgtggaaactagtagtatctgtttccatatcaacgaaaaggaggaaaagtttgagtttcaaccgaggacggaacaatgctccatggtcagaatcaagtacgggccaaacccgcagaacattcaagaggtcgaagtggagccacccaagacggatagcctggtaaggtttatacagaacttcctagagaaggaaacaacaatgcccaggaaccgttattggaggaagccggtaaaatcacctgtaccggccaagaagtttgagcagtcggctcagaagaagccgtcttctgcaccgaaatcaaagaaggtgtggaaagagaagctgaagacgcccgctccatcacatccggagacgggttgaaaatccatgaactgaatcgaaaggaggtgcggtcttgcacatcggactttaaatgatgcgaccttcgccaaaaggtaaagtggtatgtatctgcatatttgttttcaacatttgaatttttgcatcaccacatgtttgaatttcaaaattgcatttagggtttttgaattttgaggaagttcttcaaatgaaaatttttagagcaaactaaaataaatttttcaacgaaaattcactgtgccacgaccgcactaaccgttggattccaacggccgaaagaggggccggttgggcccaccaggtgttcggccgaaccaaccggccaggcaacggttacctgctatttttggtagggtaacggctagtgggtccgacatgtcatttctgaccgttgtgggtaccctataaaagccagccggccgagagagggaattccaccccatttcaacacattttcattccctctccaaagtttgctctcaagttcattcaagctttgatatttttcctcaagttcaaatcatttagttacatatatacaagttgctttggtgaaactaaccggcgggtgaaactcttatcatttctaacccccgccgagttagcccgttcttgctccattgtgcattatgaggaggcgactgtgtcgtctgttcaaggggtcgggctctccatcaagtcgtcatgacgagtctagcactcgctcatcagctgatgtctcgatggaagactctaacgctccgcgacaactcctgagcgacgctgacctcgaccttgccagtgatcgggagagacaggcctactacatgctgagcaaccgggagtatgctcatacgcgaaaacactcaccggagttgctaaaatagataggtatggatgttgaatttcgttctatttggaaagctgttggttggcagagatttgctgtggtagatgagcccggttctcgtttgcttactttgcaatttctgtgcaccttgaaagaaatggaagatggtatttcttttcgctttttccgtaaggagttcatgctcacgattactgtaaaatcgatctccagaaggaatttatgggttcgagaaaaataggttttgggaagatatttctggtgctccaatttgcaagaaacctagaacaaatgatatccataatcctacacttaggctcatgcacaaatggattgctatgactttgtttcctataagtgatctgagacccattaggagagatgaattaattatcatgtttaccatggttagaaagatcaaaatttctcctgtcaaatgtatgataagacaatggttagaaagtataaagttctctgctcctgttgaatgcacttctctgattactcggatagcaaaagggctaggggtcgttagtgaccaaattgcttttatctcagccgctcgtccgcgtattgatgaggcttatctagtgcaagggcatattttgaaacatggagtagatggatctttgatatactttttccccggttgtacaaatgaaatcccgttgccaaatgcggggtatcatttgtacaactgccatgaactaaccattcccctgcagaccatagaagaatctcgtgcaggtggaacatacaaggagacgtacaacatgacaaggaacgaacaaggaagttcatcatcctc

SEQ ID NO: 68797 - DNA, 2106 bp, Oryza sativa
tatgcggcaagaatattaaaatcatggttggagaaaagatatttgataaatacatggtatggtagagtagttgctgaaagtacaacatctaacaaggacatgttaacaaaatagcactattgaaaacgagttgtcgtcattggtaggaaaaatgagttgtacaggacaaaaataacgtgaggtttcttcttatgtggaataggaagttgcactgattgtcctgtgaaggggttgccaccaaggtgtattttccatcatatatatactacctccgtcacataataactatatttctagaatttaaatttgacccaaaaagttgtcataatagagtattaattgtcctatcaatcacttctcatccaaatttctctctgttctaccctcagccaccctcccacttttatctatacactattcaatgaggggcatcatagtctttttttctcaaacctttatatatatatatatatatatagtaaatttgtttggtgctccatggtgcccgggcaccatgattgaaatttactatatacccaattcaaatgagtatgaaactttttcaaatatttaggtattaacgttaactactttagtaactagttcaaagcaagtttgaactgaattcaaacttgcttttgttagattttgattccaggtatatagcatccaaacatataattagttaggtatgtaataatggattgtgaaataaagttaaatttgagttgttttgttgctaggtataggtatgaatcgaatacttataagtaggtatatactcacaatttgaaaattttgaaaaatttgggcgaatttgtgtatttcataccatggtgcccgggcaccatggtgccccatatgagtgtcctatatatatatatatatatatatatatatatatatatatatatatatatatatatatatgccaaacaacctataattataattattttgagacggaggcagtatatcacaatatggcttgacgagtatgtgactagagtgaaaaaattcacattgggatcaagagaacataatatattgaacctataagtttatttagggtaaggatatatataaaaaagcaaatacactgactatatgtgttgattaatgttgggtttaaatgtgtcaatgagatatttttgtctttaatattttaatagttgtactacccaaattataaggagcattcacattccatgaaatatgacctgtatttttggcataatattagtgcaataaatctagccgcgtgccaatggccaatgcatgggcgtcgggcaaccccaatagtagtaaaactatctttaacgcaaatctatatacaaccaatttacataataaaaccggtatatattaccgtttaaagtggactcaaaagataacccaaaaaacatcagtcctatcatttcaccaacagctaattataagacgtaacccttgttagttagaaaataatttgagggtaaaattttatgtgttcctaatgaattaaaaattaatgctgaaaataaaacttgataaaaaaattcaaaattaactctaaaattaaaattttggttgctactaataagctgaagagcaaacggtagagcgatacaataagtagaagcggaccagacattaattaggcatcccgggtcatagcccgggaaatgggatctcttgccctttatagcctgtttgttttttccaccatggatggactctcaaagtccaaactgcaataggccacaggttgtggcccaattctgggtccacctctaactataagagtgtaacgaaagaactcataaaactaattgttatataaatgcatctttattgtatgaaaatgaagatgtgatacattgtcaacagactgtcagaaaagacaaactggtttgagttacatttatttgcacattcattcttgcatatcactatcagtactcgtcgtaaaacaaaccggtatcgagatagaaattccaaaaaaaaaaaaaaactaaacatcacgttaaatatatataaaacgtgcatcacgtgtgcaatatatatatatatatatatatgtatacatatatatatatatatatatgtatacatatatatatatat

SEQ ID NO: 68798 - DNA, 2466 bp, Oryza sativa
attcctgcagcccaataatatgaaaaaaactcatctagagcagcttattagattataataatctagtttatagattataataatctgctataataatctacttatttatttcagcttacttttaataagctagattataataatcctaagatgaatcaaacagtgccttagattgtttaccaagtgaaaggtttaatactccaagaaaaaagttaaaggtgctaggagattcatcttgaagaaggaaattaaataaaatgcatggaatctatcgcgatattttagccacgagaacaagattgattgatccaatttaagccgcacggagtatatatatagagataaaccgattactttccacggttatgcctttttgtcattacccacttctttttttaatttttcttttgaaaacatcaaactaaaaacaatgaaatgatggagaaatagaccctacgtaccaactaatgatcattgtgttatatattgcgaataattacgctcttattataagaaaatcaatgcccttttgttctctttgtaccaccctatctagcttaattaggttattactcatttaactcgtcctatttttacaaagatgtacaatttgtcctatatatgtcctattgtcatatgtatacactatcttttccacctctttgtcatcgatttttattccccttcttttcccgggaattatatatcttttgtttatttctgggtattaattcaatttcttttgttttgtttgtgtggcagctggcgtgtaaaaacacctgccacaaacaaggccacataatgttctcttcagggagggagatgattaagattaaagcaccagttccaatcagtacggctagctgcttaattatagcttgtgctaataagatcagacaggtaccgagtgtcatatctgtccatctttttatctacctgatgacgccgtcactatctactactccctccctcctataatataaaaaaaattaactttttcttacactgtttaaccactcgtcttattcaaaaatttatgcaaatataaaaaatgaaaagttgtacttaaagtactttggataataaagtaagtcacaaataaaataaataataattttaattttttttaataagacgaatggtcaaatagtgcaagaaaaagtcaaaatcccctatattatggacggagggagtacgtacttcgttcgtctcaaaatataaacaattttaacggaataaaatacatccgacactaatactataaatatgaacatgttacaagtctaggtagttttacgaatatgaaaagttaaaaattgaactaaccaatgtatgacattgcttagttcaaatttgcactatctactacgaagtactatcctttttctatatgacaacgtatgaaagtaaatataggtagtatttaataaattgagttttggtattgaataaattttacaaaactacatgtattttgtacaatttatcacgaaattacagattcagtgtctccgtttatcacaaaactatatatgctttgtacaatctatcagaaaattacatatttaaaaacttatttcataaaactatagattttatatagtatatgtagttttataaaatttactctttagtatttattatcggacattttctggctaatcatataatatgttgtacggttaggtagccggagtagctaacactaatttttgatatccaatcaaatcaacctctgatcccaagttcccaacatctgaaaaaaaagtaccccctctgatcccatcgattaagccgcaaatgaaagagtttgcatgcatcgatgcaccgaaactatttaggccctgattagtttccgtaattttttttatccaatcatattaaatatttggacacacacacacacacacatatatatatatatatatatatatatatatatatatatatatatatatatatatatatatatatatatagtattaaatatcgatctacagtatggagaagggacacatatatagagtattaaatatagatctacagcatggatagggcagatcagcagctaatattagcttgtgagtatttgttaatttaatttgatataatcgatcacgagaggtgattattaattaattagattggatacacaacaacgtaccgtacctacttaattaattaagagtagcaagcaaaggcattgaatgcatgggtgcaattttcatattgcatggttgggcgacccccccacattgcgggagagcacgtgcattcctatggtccatacaaactactattactacacacatctccatctttctatcatatcgcgccacgtagccagccaatagcggatctaggaagaaataacaggagagtacgaaaaaattagataaaactacaaccccttcctatttactaaaaacaaaaaattttaataaatgcttcgtgaggactctcata

SEQ ID NO: 68799 - DNA, 41992 bp, Oryza sativa
  unsure (1)..(41992): unsure at all n locations
taattacttcctctttcccgtgatttcttttctcctccactccacgcctctactttttccacccttccgctcatggttaaaaataaggtacgacagataaatcgtaatgaaatacaagtaacaaacatactccaatattttgttgtagtagataaatggtttaaaagctaatgctgtaaactaaacttaaataataaaaaaatcaaaaatcgtgagattatattttaaattaaaatcttggttttgataagctaaatagaggtcgattagacatctttaaagtagagatttttttttgttaaatttcattagaattgaactttctcatgtgaaaaatttatgtgctagtacaacaacttttagcttctgcattagccataatatgtgggtttatttgtgaatttgagcttttctaggggcctgatcatctgcttgtactgttcgtttacgtgctggattggcagtgatggagcctgcaagggattgagtgggtgctgttgcttgtcgatgtgcagtgtggaccaaccccaatttaaccattgcattgcattattatgcacaataaaactgttctgcgcttttcttgtttttttgttaaaaataagtagagaaggaagcaaactatacttgcaaaaatttggagacctctaatgctaacatactttgatacttcattatttcaatgcatatcaacatgttcatcctaatacgacaagatgagggagaatattaggtgttctcccttctaatctctatggttcctgttacaatatttcaggaaaaagcttgtccctttgtgagcttattatcaacctgcagcccattgccacatttttttttctcttgcagaacatagcttcaacctcaatatggcaaacagacttcttctatgttgtcatgttcttaatacttntaggagtaagtattaatagttctttttatgcagcaattgatatttcttcagttgaggccttgagggtttcattattaaaaaaatagagtaaattttataaaggtatatttttttatcaaattattgcaaactacatatntaagatgttgtattacaaaacgatagatttaacaccaaatttaccatattcttacatatttaaggctaagtacatcaaaacaacatatttgatattaaacttatcacaaaactataaattttagggtttaaatctttagcactatgtttgagttataaacatttaagttttatgcttaaatatgcactaaagctatagtttttttttgataattttattaataaatctatagttttgcgatactccaccttaaatctataatctatgatatatttggtgttaaatctgtagttttagatacaccatcttaaatctatactcttgtgataatttgagaaaaaacatattttttgggaatttactgaaaaaaagggtatatatgccatctggattaacagatgacgaacacacgagacatttgtaaagcataaatacgagtatactaaaaaggatgtgtatacattatgtcgacaaaaccgtagtctacatgacgtatgaacatatttttatttttgttagttctcaatatattcaattccgtgtaggtacttctaactttttatttttaacatgcatgttcatgtatttactaaagcgaacgaatttaaaaaccaactcaaaaacatatatgtatttctaaaagcgaacgaacttaaaaccgactcatgcacgaataacgtatcaaataccggtaaaaacatcttaaatttttataatagtagagatatagctcttcctatataaaggaaaaaatcaataggacactagaaatgataacttctaagaagaatctatctcgacatagcattatcttccaaaataggggtgtgaaaccggtggttcacttttcggcgagttggatggtggaccatcgacgtgtattttgacaaatgttcaggtgtctcatagcaattatatcccattgttattcagaaaaacagtaacaaattaaatgattgcaggaagggtaggattaagaaaatgtgagatggtaggtggggccatatcaggcttgttcttaatgataatgagcaggtgggcccttctggttgtccagtgagcgtgccggaaatttagggttgggggctgttggctcaatcaaagaaacaaccaaaaggaaagcctcagcagaaaatgaataaatatagtagcagttactgtgagtaggtgtttgaaggaattttgtagcagggacactttgtgacttggacatccaagcacacatcacatttagatcatctccaaatcacactttggcaaccaacttggcgacggtgatgcctactttttatttgatatctccaggtattctttccttttcttttttcctttctgcaaacgcactggaaaatcactatgcctgatctgccccttcctttgttttcttattaataattactaccctcgtctataactataaagaagcgaataataaaaatggtttcttcaacgaatgcacattgtacccaaaggtacttaaattcaatatttttttaaaaaagaaattaaaccataagagaactatcaattatattttaatgaataggagtaaaaaccctaatacgcttagaaaagcctcaccaataagttcaaaagaaaaacccatgaccatcaggggcagaaaatagctatggctgaatacatgtaatctctacaactagctccgtaatccctattattatttttgaaatgctacataatttatgaaaaaagaataagctctccttagcttagctgtatgcttgaaagttttctgtctcgtcaacctcacgcaataacaccaaacaccaaccatacacagctattgcatcgttcctgtgctttgttgcaaaaacagtacgtcgtcgtttctgagctttggagtagtaccgtattttgggaatttctagtaccgcggggtggtatcgtaaagtgcaaatgtgatactccagtagatcaaggatgtgtttagtttacaccaaaattagaagtttagttaaaattagaataatctaacaaaaaagtttaaagtttacgtgtaaaaatgtttcgatgcgatagaaaagttgaaagttataagaaaacaccgcgcaagtagcagcaggcgttgtattgtgtgcaggactactggcctgcagctgatactgtactgtagtataagatcaagtttaatagtatatccaactactagctctattttatttataaccaatatagtagctcattatacaatagttatatactacactattaatacatgttcctatctgtcatacacacactgcgtcttggagtccgtgctacatctggctacaaatctgtagcccgctgctcttctctcaccttatttattttcttaaaatatgtttgcagctggtttatagcatgctattgtgataaaggagaggaccactggatacacagcattgcacgcagttgaagtcgcatctggctccgtctgcttcgaatactctagaaatacatgccataccgtatagtatactctagtaccagtatatgtgtatagcctcacaaaagtaactgatgagctttgatccaagaagatcatcataacattgttattctgggcttggccggaccaatatttgttttctaaacaaaagaagaaactatacccttgtataaatgctaatacacgaagaaatattctctcctttctaaattgatcatcatataataaaattcaaaattagtcaaattgattataatataaccgcattgaaactgatttcatcataatataattaatacaacatgagagaatctgtgcatgctaaggtataattggtatagtgttttaatcgatgcatgcattgtgggagaatgtgtgcatgttgtcttgattgatgtgatttaaattatcctttgtttgtgtgattggtgttttgattgatgtgatttaaattgcatgcagcaaagagcatgcggttttaactaatttgttttttttctttttctagaaacacaacacaaacgtggacgctcataacgtgtacacacttacccttatatacacacatgcataaaccccaattataaacactcataacacggagctatctcgtaagcatctctagaaaattgggctcgcatatgttgagattcatgaagtcaccacagtgggtacatcatccaccactctagtaaccgtgtcaaatataaaacttgaatccgagtgaattgtccttaatactcctagaaggagaaagagatagcagttaacgctgtagatttattccatcatgtaaggccatgtttagttctcaaaataaatttttcacgctgtcatattgaatgtttggacacatgcatggagtgttaaatgtagaaaaaaaactacacacattacgtgtaaattgtgagacgaatcttttaagtctaattgcgatatgatttgataatgtggtgctacagtaaacattttataataatgaattaattaggcttaataaattcgtcttacggtttttcggcgtaatctgtaacttgttttgttattagactatgtttaattttcaaatgtgtatccgtaaatgcagtgtgacaacgagatccaaaaaggaaatttttggttgtcacatcggatgttggaacaggttttttacacgaatgaaaaaactaatttcataaaccgcatggaaaccgcgagacgaatttattaagcataattaatctgtcattagtatatgtgggttgctatagcacttatggctaattatggactaattaggctcaaaagattcgtctcgcgatttccatgcaaactgtgcaattagtttttctttttatctatgtttaatgctccatacatatgtccaaatattcgatgtgacgttttttgaaaaaaaaaattaggaactaaagaaggcctaaattactctcggcccatgggctccaacaaacaaagaccttgatttcaggcagcggcccgtaaaatgcagcgggaaaggggcggaggttggtcccacatgtcagtgacggtgactgttttcaaaatggaataccaaccgctctatcctctcgcctcgtctcgccttgcccgcctccgtttcaatccccaaatcccctcttccctccctccgatccctagggtttactccctccccccgccatggccaagcccaagactagggggaggaggtcggcccccgcgccaccgcctccgcccacgcctccccctccgcccgcgccgccggcgaacgtgatcgacctcacctcctcccccgacgcctccaccaccaagggcggcggcagcggaaaccggaccaagcgggctcccccctcgctgctcgacatcgaactcgacgggatcgagatgtggaccccgggccagaagcgccgcctcgacgaggactgctgcatcctctccgccgacccgctctcccccgacgtcgtcgctgccaccgccgccgccgccgcgaacgatgacgtcgccgtcgtcgccgagcgcggcaaggtacgcccgctcccccgcgccccatttcgatcgactcgagtgtgagacgcggcggtttcgatgtttgcaggtggcgtgccgtgactacccccatccgagatctgcctgcgccaagtttccattcggcactacaccccatgatgatcattgcgagcaggtaccccttgccgcgcattcgatactctcactagttcaatactacatgtaaacaaaccaccatatgcaaaattacagatgtgataaacaatgcatttccattacaaaatcctgcaattgatactttcatgtccatacatctagccatagaagattttccatagacaggatgggtatagaaacacacacaaaaaaaactcacaatgtggcttctacttgcaacaagttatggagtacaatcgttgctcgctcagtcgtttgttactgcttggtggttgtgaaaatttaggtccatttgccttttcaagtgttctagtattacacagattatgtacaggagagaaagcaccactgcaccacagaatgctgtcctctaacagttgttgttcactaaaattagcttactttatgtgatcatgctttgctatcaaattacctactaaaaattcaattataatgctccttactgcaaaaactaattgtttgggattttcttgttatgtatatactagtgaactgttagctagcttgatcatgtagtgcacaggacagagcactaaggagcttactttatgtatctataccaaaagtagtaggtaacagcttactttatcagtctttcaagcatccataaaccctattacagttgcactactattacataaatagtaggtaacagcatcagtttctgtatatggtgattgcttccatgttgcagtgagactgtgagagaagcacctccaatccttcgttgcgtatcatggacaatttgtccacaagaattctgagagatggcatggtttaatgaactcaatcaccatgttccctgttaaatactgaaattgaatactagtgtgcgttgtacacttgtggtagagacgagctgccttgacatgtaactaaacttgctagttttgtcgagtatacaaccacaccacttaaatcaagcacgcgtgttggcgtgtgtctttcaagcatcaaaatggtctactgtgtgttagtgaattgttggttgacatccatacaccctattacagttgcactgctattacttatctgaattgtcaccaaacgtgttcctcatgtgttgcagtgcttctgctacgtatgcgacgtgcctgccccatgttcctcatggaagggagaaaaagggcattgccatgcgtcggacaaggacaagaaatggaaggtcaagagaacggccaggcagaagcgaacacaagtagtcaagtagcgcttacttgatggagaaaattagttgatcccacgcggcgcaggcctggggctggccatttttcacttaccagtcgggttactgcagcagtaattgtacagcgttagaatatggagttaattagtactcatgttcctatatatagtatcaatgggttagcaacaataatagtatatgatataactatggagaattatcagtatccattttattgtggcgtctaattccagcatcagaagtgattcgcgtgctatgtaatgctgcgcggtcacagttcactgctcctcctgcatagctcaatcctctgttttgctgcaaaaattggaatatcgtgttccatagtagttctactaacataacgttgctcttttaacatctggattaatcatttcctgttctttaagtttttcctactactgcaattcaattgcagtctgttcgtctactttaaacccctcgagatctgaatatgtttgcatttatgatttgccgtccatctattttctcacttattgaggctcttcgttacccggtgtgcctcttgggactctgcaacttgttttaaatcaggcttgctatctggtgtatataaatgtagggatgaaaacggtcggaaacgatcggaaaacagcctcaaccatttccgtaaccatattttttcttagaaacgatatcggaaatgataaagtcggaaacgaaaacgatatcggaaatatcggaaaaccggaaaaggaacaatacaaacggaaacatgtcggtacagatcggaagccagtaacaaatacagaaatattaaactataaaaatatatatttaactttacataagtatgttatatgtatacataaattcaagcttatactatataaattataaattaactttattttagccatgtacaaaatttagagatttgattgaaagtctgtcaatctgtaagttgtaggtcaagtatagacataccctataaatatcgacatatttaaaatacggtaattaccacattataagaaacggtaatttccacaagaatacggtaaatacggaaacggtcggtataacagcaaaatcatttccgttttcatttccatattttttaccatttccatttttgtttcggttgattaccatttccatatggctcgaccggtagaaagtcgaaaacgaacgccggtcggccggtaattaccgttaccgttttcacccctatataaatgaccactttgtatggtgatcgccttcaagcaaaagtggccaagaaacctccacaagagaagggagaaatggtgaagatcgaagaggagattgatgctgagagtgacgatgactgctgcgagatagaccctgacgagttcgccaggaaagttcagctcaaagtatctgatgaagtcatcctggtagctgccaaagggcaggtagatattctttcctatgccttgttgatttgttttgttccatcttctccagaaatctgatgatcattgtaccattgtagttcagtttaggttttatctttcttttattttgttgatgcaaaacctgtgtatccatcagacaccttaggaagaattttcaaaatacaaaatatgcccccaaaatatttgtgatatgaaaccatgaaccatcggaacatttctcgtgtcataatctgtagatcaaagttgatgcgaaccaaccggagggctttggaaatttgttggatctctctgactctgacaacaacctacagccgcatcatgaatatgctgctggagatcgcatggatcatccatatgagattgatgaagataaaaccactctagaaaagctggttgatggcgaggacaagtacagagctgatgatctccaggtagacgaaggtgatcgctgccgtgaggaagtcatacctgtcaagatatcggtgaagagcgaacctgaagaacacggtgtcattggggaagaagatgcatatgatcttctcccggagatcaatggcttcagtgagcagctgttccctgatgaacgcagagtatttgatgaggaagacgacgatgacgttgttgtcatcgggagagattctctgtaaacgggttccgtttctatgtaattatctatgtttcttcttcaaatgagaataccatcttgcgaaaataaattttgtggtactgtttaatttttatgttgtttactacacaaatacaagggcatgaatgagcctctgataccttctcttatctacaatgatgaacatgtaggtggcactgagagacttccctcatccaagacacttgtgtgcaaaattccccttcgataagacttctcatgagagcagctgcagaaaggtaattcgattttatccgtgcaacttctcattttttcacctcatctatctgcagacataatactagttgtgtcgtgtgcttgcatattgcagtgctattgctctgtgtgtgaagttcctgtttccagttgtctcaagtggaaaggatcagaagggcactgccatgcaaccaaactaacctagctatctcagaatcctccactttacgattgatctatgcatgatcagactgtactaagttcactagtttttcctcatgggtataattctgcctatcaagaaaacaaggttcatatcgatttatgcatgatcaggattgtactatgttcttgtttttcctgttgatataattctgcttatcaagcaaacaaggttcagatcacaagtaatagctcagtgcatggtactatgcatatttgtgatgtgctgaaaaagacatgtgattattttgggtaacaaagcagcttgaatcaattcatgccatcattttttgggcaccggaagcccataatttttgcaagatacataactaattcaccactgtttgtccaggcggcataatttaggggatatgctgtcatagcttcccctttctttcgaatgaaaatgatggcatatcaatgagcggcaaggggtggagttttccaaacaaattctcaccccaggtgctcccagataaattataaagtcattttagatgatgcaatacagatgattcaatggcctggtttgaagccattaattataggtgccccgttaatttctggtgcagctcctctgttcttcttgacgtaggcagcgtattcaccatagtgcatagtgtacaaggtactctggtagcgggtgacacggagtttcttcctcaaagagtcggttatggtaccattgtaacctgccttcctcatcagtgagtcaatggtctctagatgtgtccatcctgccaggtatcaggcttcatgttatgcatagtttcatagaaatgaagaatgagacttatcactagggtgatccaggaaaaactagatgaacaccatcaccttcttttttttgttctatcatgcttctgaatttgtattttcatcacaatgtatgcaaaaggtgaaatatcaagtgaggcaactagataactcagcatgggaaaatgttgaacggtttaactgggaagataacaggatccattcaggtagttttttcatgcaacgcagatcgaacatgctatagacaaaaaacgaaattattccccacatgaatttaactttgtaactgagaagaacaattattaaagtgcttttagtgtttccttgtggtagttgcaataactaataacttagtgacaacatgtgtagaaggtgaaaatgcagcattcagcagcaatatatagatgcaagtaagttttcaccttcatgggcagcaacctcaggtaaataagttgcactgcgcctcatgttatagtctggatcagtgaattcaataattaacccatgcttacccacctgcagtaccacaagattattagaagagagtgaaagaacgactaaaaccaatgtgtagttgcatacctcccagtcaaggtggttaagtgcagtttcatattcggtcagtatagatactgtacactccaaatacggcagttctttcgactgtataggaggaaagcggcggtccctcaatgcactgcgagagagtatatttatctttttgtctgtcttgatataacacaaggagtcaacattacctaggttctgttatgtgtagcaccccaaaaaaaattcctccaattgtattgacaatgagaccatgtttcagtaagaacttataaatgggcagcagtggttattcagtagttaccttgtgagcgcatactccttgaagccagtgacaatctgacgagcctccaaggttccaatgcatcctcgaaggcgtggttctgaaccattggtagccttcttccaggtgacaaacaatgggctgaagtttacaaaaaaaagtagtcccattgagttcagaatttggttgctctagctagaatattgtaacaagaaatcacaatacaaaagctagacatccttaacatgtatcacaatggtagaaaagcatctcaaattgaaggcaggctaaacttaaaaaaaacacaccagaaaaccgaaggcattctatgcacccctcctaagtatggtcaaaagggggaagatactgtgtttgtgacgatttctaacactaacaattcttcctcaagataatctcaacaacagcaacaaaattcccccctctgctttcagagagaatgagacgaagcaatccctctgctgaaaggcaaaggatacaaccctcttgtgaaatgtggctgctttgctttctctctgcaagaatatactaatactaacagtaggccataggaaggccatacaccaaaatcggcttaagccaacaagtaatcgatctgcgtcgcagatgacgatgatgataaatcaaagcgaacaacaccctccagaaaccgcgaaaccaaaatcaaacaagaggccaaaggcggcacctttccccccaatctaccacaccaattgacccccaaaccgcacgggaatcgctcgccgcaaaaccccccaagctccccttcatcggggaaggcggacgacgagacacacgcgcgatcgcggcgggagcgagaggaggagggagggggtgcttactggatgccctcctcgaaggcgggcggcggcggctggtcgccgctgtagtgggagacgagggcgtcgaagcagtagaccgccatttcctccgtggccaccaccatcctgtcctggcaaggggcggcgactcggcggtggagctcgtcggagaaggcgaggcagccgccgctatctggaggaggatacggaggagaagcgatggatgcgcgtcgcgttgggtttgaggtcaagtcgttaacgcgacgagctccttttttttatttggatggtctcttttgccccttggattttgtggcatttacgtgttttttatggctataggtggggacgggaggggtagatacgggatttccagtagatttatctgtagctagagtacacaaatctgcaaaactgagaacaaacgaccagcgtgtttccttttaaacaaaaatttagcaaacaaaaacaacgcacatgtgagtgccaaacttatctggattctggacccgacacgtctacgtttttggcagatgcagtagcatttagaatgaaatagtaaggtcgagttttgttccaaactttcttttaaaactttcaatttttttatcatattaaaactttcctacacacataaatttttaatttatctgttacatcgtttcaatttcaaacaaactttcaattttgacgttaacgcaccctaacccaactgcacaacagaacaccaaatctgaattcaaaatgatttgtgtttactttaatctggaggggaggggtagttgagttttaaccatttcattatcttcttcttcttcttcttcttccatggcttgcttccacctcttgccaacgttgacatggatgtaggatagtactatcagcgtttccctatcactctcccccaaaatgcaagcctgatgctgacatttttgctaatccacctctggggccaggcaaggcaaagcatgcgtattatgcaagcagcatccattttggagaaaaatagtgtgagctagaaaaatcaaagttttaacatttgatgcagaacaagcatgctactactacttgtatactagtagcacaatgaaaaaaagaatctatcttgttcttaggtgcggctttaggtaggccacttattctttctgacttaatgctccagatatcacagtacagtaccacatcaacctttcacagatgagagcgactcttgacccaacaggatcgaatcccatccaacaaagtaggattcatatctagtacatatgcaccatcctgcaacttggcactaacaacattttctcttcatttcaatgcgatttcagtggaccacattctaaacagaccaagattatatgtcatgtctctcattatctataaaaaatatgtcatgtatcttgagtgtacacaagaaccaatgaaagcacatgaactattgccactgccttatctaggagtaatatcttcagttcaatatgaaatccatgaagtatgtagcatccttttctggaaccaaatttaaggaatgaaattgtaacaaacgtctgaaaggactgacaagctgggtagctcagctgtactgaacaatgagctagctaggcctaaaagtaaacagatgctatatacaaatggaagtcctacgactttcagctaaaacgatcagaagtttgaaacatggtctgtttcaatatctgaacaaaactccaggttatctaggtgaagtgtgaatgattcggccaatctgtcggcgtcctgaacccgtaagcgtgtaccttgctgcgcaacgacaatagcagctactcgcgaagcgagcaggccaatgctcttcaaatccgaagagccccgaagaatgccatatagaatccctgaagcgtatgcatcaccagccccacatgtatctataggtacacatggtggtggagggatgtatatcgcttcccctttcactccaatgtatgaaccgtgcacaccatctgtcacggatactagaggaacagaatggcttaagtatcttgccgctgacatggggctatctgttgagcttagctcgcagaatgccctcgcttcattggcattggcgaataatatgtccgcatagtttgttacaatatccctgaaaaatcgttggtttatggtcagtacagtacagtatagttcagagatgagatagtggctcactccataatatagagaaagcatacaattaataccataaaaaatatttttggtttaccatcagtacaataaggttcagagatgaggtagtggtacactagcataatatagagaaaataatacagtcaacaccccaaaaaacgtgatgctagcaggagatagtttgcaaggagactagtctcaccaaaaatcattgtagcaacgcttgatgcatgacacatctgatgctgtaactgcaataagtgagccattcttatgagcatcttcacatgcttgcttgatggcttcgatcgtgtgaggtagctcaaataggtagccttccacaattactacatttgacttggacactagactggccaaatctgaatcataactcaaagttgacgatgttccctggaaatacacacacgcaaaaagggaacagtaaggtcatactcctatattagtgccagcaacacttctatatagttgtccagtaagtaaattatacacggtgaatgttcaatgagtcaaaaagtacagctaacaagtaataagacctgtcaagtaaagttgatatctgatggtggttctcattgatacattcatactaaaagcagacctggttaaactactcatcttcaaaaattaaaatttagtctgatattgcaacagaagtccctagaagggggaataacaaccctgaagtacaaacatatcaactgacctgatatgcaagcatagttcgttgtgcatctggagttgttagaacaatcacagttccagtagtcccatctttgaccggcttagacaagaaatgcaaattagcacggcgcaattttgccctaatagaacaattcaaccaacagtgtgatgtcagccaacactctgaagcttctagtgcagcaattaagacatcagtacgtgcaaaaatatgttgtcaaactagtgaactacctgtaaaaactaccaagtgggtcgctgcccacactgccagccatcgcgattctaagctcggggtagttagtggagcggctactaccaagccttgatagcgcgacaagcgagttggacagtgagcctccagcggcagccttgtagctgcaaccatccatggcgcgcaagacacgccctctctcctcgtggttgacaacctttctggtacccttttgtatgcccaatctgtgaaggaactcgtcgtccaccatccctgagaaatcaacctgtttgcaggccaaaatcccagccacaaattagcattgatcacaacagctcaacaacctattgaaacagaaagaacaacatcatagtgataattatttccaacacaaacacataggaagaaagaagccgtctttttattaagcgttcatgcaggttgcacgcacacgagtagtgagtggatacagtggcgacagttgagccaaattagccgtttcgaattcgacatttctaccataggagaagtaattttcttgtatgcgagtactggttccttgcaaatgttcatcgatcaggaacacgaagtaattaatgaatgaatcaataatatagatttatcttatttagagtagaattgaagaagatgggggcgtaccatggcctggccgaggccgaggacgtcccagcgctcggggccggagggaggcgcgtggaggtcgaggttgacgtcgtcagcgtcgagcgggcgcaggacgccatgggcatcctcctcctcctcgtcgtcactctcagccgcatcggcatcctggaatcctcctccgaggagagctctcggcagcagcagcaccaccgccgccgcccggtgctcccaccgcacggcgaagcggctgtggccgcgtggcctgggtacccgtcgccggcagggtcgcggcagagaggaggaggagaagcggtggaggaggcgggaggaggaggcgagcgccattgttgcggaggagaggatggcgatcgatgccgtggagctcccgcggccgcccaccccaacctctcgtctcttctctatctatcgccacgcatcccgacctcgccggtagcgtgggccccacctctcagtgactctgtaatgggtaggcgtggcggtggacccacgtaatgggctacgctgcctgtaaatattcgagaaaggaaaaaaaaagaagaaacgggtaattcggaacgggattgtcactaagtccggcccatgggccatgagtaagtctaactgggcccattttaatagagagatccgtgtcactaagagtgggagtaagtttgctttaggtccatctttgaattatgtcttccaaccgcaatatgagatgtagtgtgtttctcaatttgcaaaactgatttacccgaaaatctagggcactagggggacagtatagtgtctaattttggctgtcgtggtgagtttcccccacatgttgacggcagagagacacagggtgggtggagctgtggaggtgatgctggaccggcaggtcgccaacgacatattctcctatgatgcagaggtggtgagggagtgtccgcacagcaggcgcgacacatcatcgacgagacacctaatgctcatccccaaccatcccctccactaggctatccacgaatggcgcctccgtcacgccatacaaaacaagtggcctcttggtggctgcttgccaccctccagtcgcacacccctcgcaccataggccgtcgcccttctccctaccactcatcacctcttgtcactgctcggagacctagtgataactggggaagatgggggagacaggaggaggaagaacatcgcctacaaatctaccacacttccaatcaatcgtaaccatcagccccctccaagttggtagccatccttctccccaccactcatcaccctctcgtcactgcttgaagaaatggtgacaaatagggaagatgggggagagagaggaggaagaacgtcgcctaccacccttccaatccatcacgaccatcgccccctcctccaagtcagcaccccgcatgcctttctccgctcaccaccttcttgtcggccacctccccctttttcctcccgcttgctgctctcccatcggctgccgcttaaaagtttggtgagaatctgagagatagggagtgggaggagaatagttggcagtatgcttatttaaatacatacttatttacttgattcaaacatattattatatatttcttttttgccatgaaaatgcttggccaccatattggcagtgtttagttccattcaaacttttaaaaactccatcacatcaaatgtttggacacatatatggaacattaaatgtggacgaaaaaaattacacagtttacatgtaaattgcgagacgaatcttttgagtctaattacgccatgatttgacaatatgatgctatagtaaacatttgctaatgatggattaattaggcttaatacattcgtctcgtaatttacagacggaatctgtaatttgttttgttattagcctacatttaatacttcaaatatatgtatgtatatttaaaaagaaaattaacacacgaactaaacacggccattacgctgaatgcatatatgcagccagccagcagtcagtcagcagttggaaccgtattgattatgttgctgctccatggatggattgcatttactactgtagtgtaaccttgcctatagccagttgtctgcctgctcacgcagcatattcattcatcgctaattaactcatcgagaaggggagtataggtagctggtttacttcccaactttttcctttaaaattttaatttttctatcacatcaaacttttctacacacgtaaactttcaacttttctattacattgtttcaatttcaatcaaacttactaaacacacccttagtataaatctggagaaggcgaggcaagtgaatacagtacgagtgtacgacttttcatctactatcagagaatccagaatatcaccggttcatcataagatcccaaatctcatgggggaaattctcaacagaatatctagcccagtttagttcacaccaaattttctcaaactctcaacttttcatcacatcacatctaaaacttttctactcacataaactcttaacttttttttctaaactaccaattttccccaatttcaaaaactaaatacagccataatcacgttcgttcgttcgaaatcctcaacaacagaagaggccggccgggtacgaaaaaggtcaaaagagtgaggagacgacacttgacagctgcatgcatatgagagcgagatgtcctcctatgaaatactatgatgtcatcgtcgttgtgtgccatactttccgttgtgttggttgcgtcaggcctcagccggcgaccaacacatgcatgcatggcatgcgcgttgactttttattttgtgtgtgtgtgtgttggttggcggtcaatgcgaaagaggcgacacatgtgagttgggccaaccaatggccatgcatcatctgatcactcgaatgaatctcagtgcaactagcactgtgtggttacggatcggttatctgacaacatatatatggacccccaaccctcttgatctggttgtacatttgtaggccatgcatcgtcctctattggagtactagggtccgtttaaaagacctataactattaaatttaacttagaagttagatatagagtgtagctgtggagaatcataaactcatttccatatctttagcgttttgttggagcgctgcacccagtttcactcctattttagttggagttgaaactgtttggttaagctctaactacagaagaaatagagttgaagctaaagttatgccagaaaggtccctagtatactcttgcatgaccgagatcatttaagctacgactatattactcatgaacaaagaaaaaaactgaaagtaatttataaataaaagttttatacttatatttgttattaataaaaaaagactacaacggaaaaaaaaagctaacataaactctcaaagatattcttttttaaaaaaatatttttttttactactcatgttatctagtagtatgattctataacaaattaaaaagcagatgaattgaacattataaaccttcatctttgaaataataatatatatatccataatataaatttgcacatttgtctgctggatcgggtggacagttcggcccacccgggatgtggtcgggcccgggccctgcctccgtgtttctcaggcccaccaccgcccatgcacagggaccaaccaaacaccagcagctgaccctcgcagcgggtcccacatgcagggacaggtggcagccctcggaaatcgcagcaagaggtcgcaggcggtgggtcccacagtagtatattttatcggtctcgggacggatgagatggtcacgtgatgggcctggaatcctggcccggggccccaccaccagcctcaccacctctgactcacctccgtgttcacacccgctcccggctgcgtcgctgccatgtgggccccacactggccgcctgccgaatagcctcgctggtacgtgtccgtccaaagtaggcaggctgcagcaggcgccacttttttttctctctcttttgtaatttcttttttcccgcgagattattatatttaaaaaaattgggaagggtagacgtcgtggaaaagaggcgagatggcgcgagtgagaaagccgagacggacagagcaaaggataaacaagaagcaaaaagaaaatcaatttgaactggctgattgattcctcctgcaagcacgcccaaaaagacaagcccttttttaaattattgtaatcacagtggtaggagtactagtcccaagccatcaatactcgaccactttactttatcccaatttcctgcattttttactagtaggaggagtacttgttactggtactactgtagtaccaccattatatacttgtactactagtagtactatatgggtcagttattgaattttttttttttgaattttgaattgaatgggggcggctgggttttaaaatgagtaaatagcaaatacttaaacaggaggaaactgaaagctcttttgaattttctattgttagcggtggtgggatggagtaaaaagttgggaaaggaaagccagtgatggtttttatgacttgcatcttcacgaactccgagccaaaaatgctttccccccccccccccccacctcctctcctcccctttttatttattgctgcagtagccgtgtatgtgtgtgagagagagagtgaatgctggtgtgtacgcataacaaatttcctttctccacccctttcttcattactactactacagctactatacgtagcagttgctttacctttaataattcctttcctttccagtaatttccctggtattttcttctcctctctgccttgctttgcttcttcctcctcctcctccacctttgccctcctgcattttgcttgcaaaggataggagttgcagtactagtattgctctctcattgcatgtgaagctagcaagcaagcaagcaagagagagattctaggtgagtggtgtttggtgtgaagggaaggagcatggtgatggtggcatggctgatctgctgctaatagcaaggagtagtagtaataataatactactagtcactcatcatccttctccctcccttgagcttagctataggtaggtagtaacactactgctctactacatcctactcctaactcccacctaataataataatctctctctcacacatcacatttctgtttaaaaaaaagtcagcatggctatccatcagggggagtagtttaattagggagcgttttttcttgcttaattcgcagttaatcttgcaagtggtctttgctcttgcagagtggagaagaaagaaaggagagtagtcaaagcgactctttctttgttttcttgcgcttcctcctcggctgagctcagcagcaagcaaacctgctcctgctacagcagcgagcgagcgctagatctgaccaaatggaggccaaggacgtctcgccgctcgtcaccgtcccgcccgcgcccgccgccgccgcgccgccacctgcggcagcgcccgcgccgccgccgtcccagccgccgccgccgccgctgccgttcgcgcagcaggcgccgccgccggccgccaaccccgcggcggcgcccatgcggctgtcgttcgaccagatggcagggaaggcgcccgggggggagcagcagcaccaccaccacccggggcccatgctgtacgcggcggcgcccgcgggcggcgccgcgccgccgccgcagggcggcaatgtgatgggcatgggcgagctgatgcgcaagaagcgcggccgcccgcgcaagtacgcgcccgacgggagcatggcgctcgcgctcgcccccatctcctccgcctccggcggcgccgcgccgccgcctccgccgccagggcaccagccgcacggcttctccatcagcagcccggcgtcggatccgaacgccaagcgccgcggccggccacccggctccggcaagaagaagcagttcgaagccctaggtagtaccattttcctcggagaaaaacaaaagcgccttttcttcccccgtggattccggctgaatctaatcccaaactgacgcttttgccttcaaatcttgcaggctcatggggcatcgccttcactcctcacatcctcaccgtcaaggccggcgaggtaaacccagatctcaaaacaaaacgattatcttttcttccttccttcctcctcgatccatccgtgcagccagccattgcagagtctgctgctgctgtacagcaagtggtgatggatctatgtctgcttttcctgcggagtggatttggtgcacgtactaactccactccactccactccagccatgaccatgaccatcactggttaggttggaaaggaaccaaccaaggttgcgagacgaggacgagctgcggtgtccgtcagattcccagcatggctgtcagttgaccggccccggccccacggtcagcggcacagatagtgggcgatgcacctacgttgtcgtggactacgtgtagtagtactcctatcatcaagtacaacaagccttctctggctggctgtgtagtagtacgctgtccaacagcaagtagtagtagtagccacacctgtggactgtgactgtccacaactccacacctgcactgtcttgttcatagtcggatacaattgcctctactgataggaactaggagcactcgcctgcaggagtctcctgttgtggtgtgcttagagttccatgtttactgcgcatctgaaaaaaatgtcatcttcagttgtgttatcttgcactgctgaattttctgttatacctgcaactgactgaattaaagcacacttgatcatacgattttcttaatatgtttagcaacctttttgaacttgtcataaagtaaaatttttatatttgtatccagatgaatttgctgaaggaattactttagccaagtatgaaaagacctgtttttttccccgtgtaactctcctaaattagatagaagtggatgcaatgggctgattgttcatacaaatttaaatggatttgcttttcctgaaagtatctgaatttgtatgagctgtcaggcataacaattcaattgcaatttcaagctattcaggattcttagatacagatacttcaattatatcacaacttgggtttttttcttctgatatcttcaattctgcatcttcttttttttgggggttttggtgcagttatatactttccttagtgcttactaggtgtctcttttgaatgcaatgtgagttgtgattatagtacctttgtgttgcaactagactctttcttcatgtttaatctagtgattaacccacttggcaatgttggttatagtaaaaacttgatttccatcattaactgtctactgtcttcgctgacaggatgttgcttcaaaaattatggccttctcacagcaaggccctcgcacagtttgcattctctcagcgaatggtgcaataagcaatgtaacacttcggcagccagctacatctggtggacttgtgacttatgaggtatttgtcttgtgacttatctttggtgcactttaagaattgggcttaatacttctcatttatgtgatcacaagtgggtgtggttctgtgggggttattgttgcacctgtatcttagaaataaaagggggcttctcaatgatgtatagactgtagaatacatcagttttgttttgttttgttttttttgtttctaacagtggtatggctatagtagagaaagaccaggttctggaggaaactaattgtgcctttttgttaactagaacacccagtcttgttctgttggaagtttcaggaaatctgttgataatagccactagtgtagcactatggattcatctaacttcaagttcttttgtcgtgattaaaccaatgaatgtgaaaaagaaaatcaataatgctactactttgacagtacacaattattcatgtacctggaggaattagctctgtgaattgtgcatgctttagttatttcctattagcaaaagtaactactgtatcatgttctgatgaatgcgtattattttgtgcagggccgatttgagatcatctctctatcaggttctttcctgcttgcagaggatggcgacactcgcagcaggactggtggcctgagtgtcgcacttgcaggatctgatggccgagttcttggtggatgtgtagctggaatgctgatggccgcaacccctgtccaggttcgatttcgttctgtataacgagtgtcacaactaacgcatctgttccaacttcttaatgcttaccgggcatttctgccatcatgtcatatggctaccaggttgtcgtggctagcttcatcgcggaaggtaagaaatcgaagccagtcgagacaaggaaggtcgaaccgatgtcagcgcctccacagatggcaacctacgtgccagctccggtggcgagcccgccatcggagggcacatccagtggatcgtccgatgactcgggcagcccgatcaaccacagcgggatgccgtacaaccactccgggcagcagcagcaacaccagcagcaccagcacatgccccctgcttacgcatccggtggctggtcgctctcagctcatcatcagaacaggcacgactctgacatgaagatgatgtcgaactaacactctgctcggcctcgaggcgccccatttgtttggttgggctgaagaaggagctgatgatggatggtggatcgtgttcgtacccccctctgctagctaagagatttaggaccatggtgatgaatgatctcagagagatgtgttgttgctgttgtttttccttggagtaagattaatttaggcgctgttgtaacgctgtagctgtcataattaagccgcctctaacgcaagagtttattatgtgttgtactaccggtggatatgccttctgcttgtctgtcttgctgagatcttcacctccttagtaggctagtagtagtctacatacagacttgtatgaatttacctgaatgctttgatttcaattcgagaacttttactaggttgtttctttttcttgttctgatccgctgtgtttgggagatgaatgtttgtgttgctgtgctggtaacactgtttacggtgaaattcatgggctgtttttgtcacggcgataagggatccacgccagggagtatgcctcaacttcaactcaagcataatatgttttcagctgcttcgtcggaatattaccgtgcaatatttgttcggcgtctctaaacgtagttttattgaattatttttcttcttctaaattatttatatccctttttctatactggtcgatatttgttaaatttatttataaaaatatttgatatatatctataatcataatcatatgtagatagataactataattatttcaaaatgggtcactataagaatccgatcgatggtttgtctcgaactgaaacctctcggtcacaaacatcagacctactcccttcgtccaaagaaaatatctatggacaatttcaaactgtcaaattgatttttttatgtgatggctttgaatctacatacagatttaaattcagaagttttttttttctggtgctgtgagaatattagagccccttggttgccctaataagtcgaagccaaagccagagccaaaatttgaatttttaaatttaattttaaagttaatttgaagatatttccaatatagtttatttttaaaattaattttaaaatcgctaagaacacatatatgaatgttttatctatgcattgatttttttaaaaaaataaatcgtttagcttgttatgaatacgagcaaccgatgagtaacttaagctttatcttcttatcttggcccatctcttttatccaggctgagtttggcccggatgagaagatacacacaaagttatttggttggttgtattggtttagcatgactagtatgggatgttgtttggttgcttgcataaaagatatggtttgaaagaaattttgtttggttggatgtatggattgggtgcagatacctctttatttagttgggtgaggttacctcttcaatgttatatgaaaaaaaaattacctctcaaatgttatatgaaatattctgagtaaattgtactacctctatcctctaatataagggatattcactattttcatataacgtttgaccactcgtcttattcgaagaatttatgcaaatataaaaaacgaaaaattatgcttaaaatactttggataataaagtaagtcacaaataaataatgattttaatttttttcgagtggtcaaacagtgcaaacaaaatatcaaaatctcttatattaggggacggatggattactttgcatcatgttgcctccaaattaatttcacttatctagatgtaaacaattgatcaggacgattagggttcaaaatcgtgaaaagaaaattattttgacccaatatgaccgatgtatggtaactaacctgaaccccacgagtatatatccagtccaaactccaaacgcacttgacttcctcctcgtcatcgctgattgcattcgctccgagatggccacgccgcctcccaccgactccgaccaggttcgtccgctgcttcctcctccttcgccgttcactcccgcgttcgattcctgcttcttttgcgctccgcctcgttgggctcacggatccaagcccaatcaaccatcccgcgaattagctgctgctttccctcattcgattcgctcatactcagattgattgatccagttaggttgttttaacatgctcgattgcgtctgtagcagcaatttgatcgattccgctaggtttgcttctcccctctaatttgattgctgatgcgactgtgtacaactgtaatagacaatcgcccatgggtggctttttcttaatcaccaccatgaatgttttattagtccttaatcaccgtggcgattataggcgcatacatggtcatatttcattcattgctaatttctatactcttgtcgtagttcacaggcaattcagaaattcgactagtttactgcaaacagattatgctaattacttgttacatctgggtaggtcagttttatctcggggttcaacttcaaaccattctgccgtagaatttctacagataaaaaataatagcactgtcttgtgtttgacgaccaggattgtttccgtatcctctgttcgtctcaactggcctcaacaacacaactattttaaggaatatataagcagcatggagagtttaaactccattctaatttggttcggttttgtctgttgtgcgtgtaattaggcatttaaatttcctatttcatgttcgttgccaaacggccaaatggctacactctggtattcgatgtaacaattttatcatatcgggaactgttgttatgatctgtatcttcttcgtgtgctgtctactacaagtcttctctgtacaatgtcatactttttatgattggttctacctgctactgagaataccttctgctatttctctgtttgccaggttttggtagaggcaaatggtgtaacacggacattgcttatgaataggccaaagcagttgaatgccctctcctctgcaatggtatgacttctaaagaaaaaaagtgacaatgagtcaataagtaatggagcatatatggtattcgtggctacatatagggtgcaggaacactgatacgagaaatttatttttgctttcattttctagataacaggatttttgaggtgcttcactgcttatgaggaagatgaaggagttaaactattgattgtgaaggtaatgatcgtgtttgagtcctacaataatgaaatatctgatgtggtccatatttaaacaatgtattttgaggtttatctttgattaaaaaaaagaataacgaggtactagctaacatcaaacatgaattacccgattaaatttccaaaatcgagcattcaaagtttcatccgcttattgaagtttgaatcatgtacaaccaagttgtagtaacgtaaaacaccaatgctgtccatgctttttgttgcatgctaactgtccttttgccatttgtaaatgtaattgattttctgttgctgatatatgagtcttgacttattgggataattccaactttactacctcctgctgttacctttactgctgctgtttgtgctcagcttgatttctataactccctaccattcttgtcatcacttgttttttcctttgtcaggggaaaggaagagcattttgtgctggtggagatgttgctgcagttgtccggtctataaataatggtaaataaaacatatcatgcatccatgagaccctgatgtcaaatatcttgagcttccatgctgtttttctttaacttccattgcctttccatttgctatatgctaattcactgttaacatgcaatatatagagaattttgttcttgacatttgattagttctactatgcatttcttatatcagatagctggaaatatagtgctcattttttccgaaatgaatttctgttgaactatatcattgcaacatataacaaacctcaggtgagctatcgctattgctttgaaactgcttgtccacataattgttattgtcattattgctcaatgcttaccactgaatgctacaacactcttatctaggtttcacttctcactggaattgtcatgggtggaggtgccggtgtttctatacatggaaggttccgagttgtcacagagagcacggtatatattacggaacaaactctatatgaagcttccatttttacttaaatattttcaaaaaggatgtagcaggggtgcagaaaaaagcttgcttgattcttttcatgggataaacagcttaccagcatatgcctagagtttgactctgtatttttactactatctatgcaggtttttgctatgccagaaacagcattgggtctctttccagatattggggcctcatattttctatctcgacttcctgggttctatgtggtgaactattttcctatctcatatctcctttattcaactgaactttcacacatgatcatatgaattctctttgcaatgtctaaaactgattattaatactgaaagccccatgtgctatgcatccttgagtgcttatcatattattacatgactttaaaatgtgtgggtgtggaaatatatgtggccactctgtttctcccatcatcttaataaattttgaccaaacctccatcatgacctggtaaaaagaaagaaatgtatgtggccagattttttattgcctgtccactaggattcatctgttgaattttgatataattgtaaattagttataattttacaccatataagttataggttgatgggagactatctttggagatcgttttcactgatttgttgttatgtctttctcaggagagtatgttggtcttactggtgtaaggttggatgctcctgaaatgctttcttgtggcctggcctcattttgtaccttcagatgaaaaaaaaaacccaaagtcagctaagagtaaaacttgttttgtgaagaaaatagttaagagtaagatgaaaattgtatagagttttgtaaacataacgtttttttttatttttgaaagtattactaaataggaatttctcccttggccaactagaaaaggggtggggcgccttttttgtcttttcctacagtcgtatggctctgataccagctctgtggacccccgtttttataacaggaatcaatcgtgtgaacagtaccatttccctggatcaagtagtctggtacacacgagttcatagctgaaataccaaatgcacatacacgaaagtctagtgcggattattacatcataagcccgcaggcatagtcttagatcatcagaccgagcggtccggaatacattccaaaagcagagtagataaggcagcggagtttaggcagcggcacgccattgccacaggcaacgaccgtaactaagacctattgggcgccatcgtcttcatcaccctcctggtagtacgcgtagggatcctccgaagcttcgtctccggcctctgattaagtttatatattgcaagagtgagtaccaaccgtactcagcaagccatcacagcaacaatgcacatgataggggtattcaaaggatggccatggttctttgcgcaaagccagttttgtaattcttttcacaagcctaagacccagcattgactgatcaaattttagtaccagtgttcacagttaaacaacgacggttctgtctaccatccattgtgatcccaaggatagcttcccgccattgagtcgtcatggttttctgaggacgtccaccttccagcctctcaggaagtggctccaacagcataaaaatcatcatgcaatatcccatcccacacaagtcaagaattttgagtctagccaagtgtaatacacgtcccggtgctcaataaccgcgagcacggctattcgaatagatttggtttactcacactgcagtggatgtacactttacccgcactccgtgactgcccaacacatgagcctcgtcccaacacataagacgcgtcacgacaaaggttttcgataaccccgcattggcagtacccgctccatgaacttaaatcctcatgcactctaggcgtccatgtttctagcagtgagaggagttctggcgctcccgggaaagagaagtctcacacacatattaaattatggttcaagttaaattctctctctcatacactcatggcagtcctaccaatggcgacaccgatgtagggcacgcctctcggccctacctcaacgcctgtcccaccgtagcgcacctgcctcactcaggggtgaaccatctatgcagggatattgcctccgctcggctatctaatccgctaggtctatacccatacgagaagtacggttgtacgggggtcgtttcatgcttaacttcatggctcagtccttaattgaccggggacggtactagccttttccagataccacccaaatcctccgtccgccccagtcgaaaacaattgtttaattttgtttctcctttcacaaatcatgtcatcaacatcatggcaatgtggcgctcatgtctccacatgccgcatctcaattacctgcccaagcatatagcatttgataaatatgagtatgcatgattctagaatagcatttttaagcaattgtcatacttgactagggactcatacgtaatcatggttacaaggattttaagggtaaacaataatcaaggcatggcataataacaagtaggatgtttatcattgcatgcaattttatttgtaaacaaaacaatttcgcaattgggatcaatatgttcaaggaatagtgatgacttgccttgctcgtagtcctgcgggtcttgaccctcgttcggatccgcaactccctcgggttctaaaattacgtgcgaggaaatgatttgaattcaattagaattcaattaaaatctaaataactcaaaaggtcgaatgtgaatcgatctttttatattgactacaaagtttgcgaaaccactttattcgaattgttggatcttttaacctaagtcattttgtgatttagaagtacattcctaagaattcaacataattatttagctcttaataaatctaaactcctaccgcgaattgattacttatagagattaccaaaaataatctataattatattaaattttgcaattctacgactataattaatctataattaaactctaattattttaaattttctaaacctccttattctctctctaattttctatttatttttccttttcttttcctcccttctttctttctcttttccctccctttcttctttttcttttttctcttttttttctttctttttcctctcttcttttctctctctccctcccggcttctttctccccgggcggcgacggcggcggaacgagggaaggggcggcggcttaccgacggcggtggcggcgacggcggcgcaaggcgaggcgacgcctggcgcggcacacggtgcggcgcggcggcaccgagggcagcggcgcggcggcaataaggcggcggcgcggcggcacgaggacgaccctgcggtggagaggaaaaaggggaggaatagggaaatggagtggggaataatggagaggggtgaaggtatttatagggaagaggggaaagagagacagagaaggaggggggtgatgcgacgccggcgcggggcgcgaggcggcgaggagatgggcgcgcggcgacgagacgggcgacgcgacggcagggcggggctcgaggcggcaaggagacgggcgcgcagcgacgggacgggcgacgcgacggcggggcggggctcgaggcgacggcggcacgcgcggcgcggcagcgggatggcgacggcgacggcgcagcggcggcggcgcgcggctcggagcgacgacgggacgcgacggcgacggtgcgcggtggcatggggcgcgaggcgacgcgacgggcggcagcggcgcggggcgcgaggcgatgggacggtggcgcggcgacgggatggcgacggtgacggcgcggcagcggcggtgacggcgcgcggcagcgacggaagcgacggcgacggcggcgcggggctcggggcggccgggcgcgcgcaacagagatgggttagggctagggactgtaattgaacccctggcggcagatgaatagtgacttttcctattttatccccattttagcttatttcttatataaatttgattctatgaatcctaaattttgcataaatgaagtttactccatatttgtattattccacccaatggatccactctagattaattttactcatattttatttttatatcatttacttgattttaattagagttaatccttattccatcgcgtttaaatctaattgatacgaatatggccgagataatattttatttatttctatcttcacataatctttatttttagattataatttaattatttctttaacccatctagttttagggtttattcctaattaattcttctttattcgcgatctatgaactccgaaatcaaaatccaataaaatcatcgaacaaaatcggcatgatgcaatttattcaaaaagtttttgaagacccatatttttggagttttgatttttgttggtcaaattttcagggtgttacacttggcttgttccaagtatgattataggtaaccagagtattgctggttttctaattcctagtatgctcactcttgcagaggctggctttgttagaagaatcacttaaaaaggttgatacatctgatccctttgctatatgtggaattatcgatcaatattcgcaacaaccatctctgaaagaaaaaagtgctctgaataggtaagcgtgcaattgtccagacattatctattcatgcatgtcgagcttattctgcttcctttgtgtaccctgtaaaaatgaggtatccttgacaggtgggatattctggttcacaccaagttatcctgtcgtataaattcttttggcatgttaaacttagattgattaatctacaatttttaagttactaatagctgcataaagttccatagttataacatccatataaagttcatgcaggaaactctcctcaatttggggcgtgtttgacctatttatcttctccaaacaactttcttttgggtcctctctaccacaagccctagatagatagactagtccttttgaaataatattagcttgtaatggagggcaggtggagaaatgtaaggaattggaatggggaaatgtagggaagcaacagcatgcacttcccacatcttgtgtctcctttcaatagatggatgggcttcaacttataaaaaagcttggtaacggttgtctggcctggctttaaataagccgttccctatgccctaacctgttacttgtgtgttttctatattctcctcatctttatggtcagtggcttccctatgccacaatctcgttacctttagatcatttgaactcattttatgtattgcttttcttaatctggtttgaaggccaagaaggcttatctttatgcattgtaacttggaaggacttattttagtttgtcaaggagattccatttgttcctattttattgcaaggttttgttttctcatttcattctcagatcaacttttattgcctaatccatgtctgctacttccatcattttgattccaggctggaaatcatcaacaaatgcttttccaaaagaacagtagaagaaatcatagcctctcttgtgagttatgctaagtctttgctttctatagactcaccagttctgttgtgctaaatttgatgtgtatcatgttaggaacaagaggctccaaatgttgctgatgaatgggttgcttctgcaatccagtccctgaggaaggcttctcctactagtctgaaaatatccctgagatcggtatcctctcaaacatttccaaagcatatgtctttatgttactcgagtcattctatcttggtgccttcttatgcaaattattgtagtgtaaggcattactatttatttagacccatcaatcctttatatggtttcatatgaccagtatttatctttctcaagtgcatacttcatatggctttatgaactgaaccctactcctttgtgttggcacaacagatctgccctatagctaaaaaaaacaaaccttctaggcttagagcttttgcatagtcaaattgcaagtatgggcataccagttctaaaagctttggaaatgtctttggaactagtcgtcggagggaaaacaaggattgttcactccacagaagagtacgtgtactagaaaaggcagccacttaaaaacgccaactactttttttaagccttatttagtttggttgcctacgcttgatctctggcgtgctatggcaacaccccctgcttgcttctttctgctcgacatggagcttgcagcctccccacccttgcttacaacctattcttaatagaaccgatctgattttcactacaagaggaatttcgtgcttctgccggatcctccctatctcctgatcgagcttgtgtatgtaaatattgcttagtagggcccatagtagtacactgtttgggacagagtcagtgcccttctcacatccctacgagtcgtccagcagaaactgtttgtttagttgtatgtacaactagcagaacaaagcagttagatggttcactttgtataaccactacaattttgacataaattagtgttatggttaatttctagccttttaaaatcttgtgacctatcctttgggagttccgatctttttcgccaggccgacggcgaaggaagccccaaccaattttattaagatcaagaggagtaacgtactatttacaacaaacatggctgtttagggattaccctaacacaggaacacaagtactgtttacaacaaacatggttgtttagggatcaccctaacacaggaacacaatttaaaagctcagggcaggccctgagtcagggagagacacagaactggttgctggcacaacagggcagccctctatcagcgccaaggcacatcacacgcttcagtgatcaacattcctcccaaacctgcatcacgctaagtccattcttctatgatgcagccgacttacctcagaggctgatttgctgacaccgtcaaacacccgagcgttctgttctttccacatcatccaagagattagagttaccactatgtcaaatgggagttccaatctcaccatgagcttcgaggtgtcaaacctccagctatcactacctactaaagtggagcttagtctctaggaaaagtttgttttgcccctaacattcagtaggaaaggtctttgttttactgcagtatacgtagtttgtgagacgctagccatctgtgcccatttatgttcttagctttctgtatttactgtgggttcagataagagaagggcgaacacaaactgttggtgaatgcttacgtcgagaatataggatggtttgccatgtgatgcgtggtgacttcagtagagacttctttgaggtaaatatctatctacatctcccaatgacatgttcactcaagatgaacatactttgaactattcaattcctgttgcagggatgcagggctatattgttggataaagatcgaaacccaaaggtcagcttgttaatcttgtttgtcagaaaattcgttctccacatgttgtctaatctggcatgggcatagcattaaatctaatcctgacatctttgctaattgcagtggatgcctccaaggttggaagaggtgcacgacgaggtggtggaaaaatatttttccaaagtcgatgatccagagtgggaagatttggacctacctcctagacgttcccatggaaggaggcttgttcccaagctttgattcaatgaaaagcctcttgtgaaaaactgaagcctttgttggtgcttctgaataacagacagatcgtccccagtttgagggatacatggagacaagcgatgaagtttatttataataaagctgaaacatattataggttaacaattttattagcaaattagagaagtccctctcatagtctcatgcgatgcttatattggtatcgctattgtgcttttttcaaggtgtgaaggtacgcttcaagctaaagcccagctgcattcaaacggcggcccatatgatactgctatcaggccatcctattgggctttgaagctaccttctgcttgtagattccaggtaatcttttatatattgtataaaagaaattcacaatttcataagtttgcaccgtgttgttttttatagtaaggcttcgaaaaggttgtaagatccctagtatcgtgtgagtcttgtaatgcacttgaactgacggcatttcgttgatgaaatgggagaggtccactctctttgtcaaaactaaatcagtaaatcataagttccctttcaaacacttgcggaaatagcaatataacatccccacgttacgcaaaattttttttagagaaatcgtaaaagctaagacaagaaacgagtagccataaacagaatccaaaatcgtttgccttggcttcatcgaacaatctaaatttcagagccttcagctactgaagaaaaagataaagacagtcgtagtagcaagcaacagcatgccacagtacagtagtaaattttggtctccatcgtacccagccgagggaagccatcgctttcgctggctgcttttaaccacaccgtagcagccactcattttttttcctctacctataaatacagcacacttcacattttctagcttaatattgtaatggtatcataattaagtatgcttctacagaaatagtcaagttcacgagcatatggaaaaagtcttgtgtctctttggcgtgtatgtagccacgtcaaagatgaaggtcttccttttgttttatcactgtcttcaccccggacatattcttcttttatcttctctttttcactgtgtgtggttcagtttttccttcctttagctccatattttaatttgatgattcttttgccttgaccatatgaattacttggccatgcatcatccatcacatgcttagtcgtactgatagatctcaacacacgtttgagattgaaccatgtatagttgagagcctaattaatcctgcttaattaccctatatactaactgcgaccatatatatgaccggtgaattggcatgtacttgtaccgaactgattaattttaagttttaggacaggaagaggcaggcccaaccactagctggaccagcatgcatgcacctaattcagttaaacacacttgtatacaggcatggcctcctcttcaccaaaaacttctctgatatttccttttcagcgtttggtcctagcttcaccgttgatgtccctctcatttatcaccggtactggttatgcacagtagtagtagcttgtattttgtgcaccaacttactagaaaaattacacaatcttttttttattacacgacgaacgcacacgaacacacatgcaacatcacctcacactctgcatatgtgcccctaatatattctccaagagacgcatatctgatctcactaaaattttgttgaaagtccacccgcatatgcgtaatattcgtggacactagaatttaaatcctggtggatgaagtcatgcactcgtaactccactactataccactaaggctctgtgcgttctggggagatagaggagattgtgtctcgttttacgcgcgcacgcttttcaaactactaaacggtgtattttttgcaaaaaaaaattctatatgaaagttgctttaaaaaatcatattaatccatttttgaaatttaaaatagttaataatcaattaatcatgagctaatggctcacctcgttttgcgtatcttcccaatctcctcaaacacaccctaagtgattcgaaaaaaaaagaggcaatttgcttctatatacatgccaaaatatgtgtgcacacccgtgtataaacaatacagtgccaattaatactctgtaagattaaggctgagtttgtttatgctgatgacaactctcttgttttccgataacacgttttccaactgataaaatgatatattttatttaaaaaaatatgtacagttatttttaaaaatcaaataaattcattttaagtttgtaattattaataattgattaatcatgcgtcggggattgaaattttgtttcaaaatttccgaaatttcggaacacccccccccccgccaagtcaatatctcagacatttccagtttttctcattttttttgtgaatttagtttaaattcaattaaattcagttaaattgtgttgaaatttcggttataccgaaatgacataaatcgaaattgaaaaccctatcatgcactaataattaattcttgtttttcaagccgccaatagctccagcccaacagcccaagcgaacccagcctctctaagagcaaggtcaatagtatagccaactactggctccaaaacatctatagccaatctaatagttcattcatacaatagttaactataaaaatatactacaccattaatattcggtcctacctctcatacacacataacagcttggagtccgtgttgcagccggctacaaatctgtagcccgctttcttctctctcttctcttttcttctcgatatatggttatagccggcttatagcatgctattgtacctgctctaagagagagcttttatgaggctattatactttcagagtgactcaatgactcatctcattcgaatatatacggagctaattaagttgtcagctaactgcccgtgtcatcatttattacttcaatgatctaacaggtccaaacgtcatggtctgataaattctttaggacttgtgttagaacaagagtaaagttttgatacttgagagcgtaacctaaccggaaccaacgttttaaatttccctcaaatttttatgatcactggctctggttggaaatgatccaacgagaggcgtacttttaattattgtctatgctatactattactacctccatcccaaaatgtttgacgccgttgatttttttaaaaatgtttgaccgttcgtcttattcaaaaaatttaagtaattattaattttttttctatcatttgatttattgttaaatatacttttatgtatacatatagttttacacatatcacaaaagtttttgaataaaacgaacggtcaaacatgtttaaaaaagtcaacagtgtcaaacatttagggaagtagggagtatatgctaagtattttcgtttgttgcaagtactaattaattatagtttcatcaaagatataattagatatataggacctgtctccgtcatccgtcgaccctagtttcgagtttaatttaatgttaaattgcacatactagtatactaccaactagctagttcatcctctaataaactttgtgcaaagaggaaagatggcagctcactgcttgcgcttgagaagcaactagattccagagagctttaacgaaatctcttggggtttgcagagaaaagtgcatgtggacatacatgtggctgttttgcacggaggatgcagggcaagtaatgaagaaattaaacatagctaatcaattaagctagctcatctgcctttcacgcttgtagatcttgtgatattggagtccggctgggagacaatgttgacaacgtccgtgcactgcaactctctttgattgctgatgactattggtactggcctgtgtagtcctacatttatcctagcagtgactgctactgctagctccctgcaactgtcctactgtttgccaaaaggaaaatttcgcattgattgataatatactctcaccgactcatcaccatcccataatatagtcatttatcccgaaatataactactactactaacatacttctccatgtacttaatcataactacatatatcttatttaatttatttgtttacttactcatctcaacaaattatacatagtctgttatttaattttattgaaaaattttagaggaggttatattttgagacaggtgaagtagttttgcagtactgctgtactagcaggaatagctaatgccatattggtaccagtttttacgagaagcagtacttgccaggagaagtgatgattaattagtggagttactgtgactaatggccgttcaagatcgatccagtcaattcatgatagtaataataatttagctaggtcccccctacatggatactcgatcgatcgatcactgcgtaaattaattaattagtagagagaagatcctgcgagcacgtacgtagaagagttttaaccagttaactactgagttttgtttgtgtggtgttaaagtgctaattagtcaaagtctcgctggcttgccataatgcatcgatgcatgtgggtcgcgtgtttggccaatcaggagctgcgaatgacgtggcattatatatatacatatatagtacaatacgttctagataatgatacggtctccaaaatacatatttgactatattttttattataatatgtacaatatatatacctttttatttttattatagtattttgtaagataaatctatactccaaactaaatatatttaaagttattgataaccatagttataaatatttaccttaaacttattcgaaatgtcgagaattatatatgatattgctgggagtactccagtataagccaagtcagccgacatccatattctatagcctctgcttttgctgacctgtcaccattttgttttttctttagtttattatcgatacaatgccggtcttaaatattaattaattatgcccagccatcgttttctacaaagaatgtagtaataagaatagtaataaatgcatgtacagtacttggggtgaaattaaacaattgtcatgcatggattcggtttgtcgtttgatagctagttttatgctgggctagaggtagatagctgctgcacttgttcttcgtcgaatcttcgtagtgaaaccagtccatcggacttgaaatcataaatcttgataggggtactcacgtttaattattctttcagtgacaggacatcgccagcgagacgctagtggtgacttcgtgaatctaaaaatttgccgcgttgtgacttcgtgaatctcaaaatatatcgacccagcctttcggaagcattaatataggagtgatgtgtacatgtgtatgttcacgtagaaatgaggtgtacatgtgtacgttcgcgggtgaatgtgcgtgttatgagtatatgtatttgtaaaatgtttttttaatataaataaataagaagtgactactcttgttgctgacgtgcatgtactgctgctgttattttaacgtattgcatgtaaagattgattcgcctaatactacctttgttttaatatatggtactgttaaattttttataaacgtttaactattcgtcttatttagaacttttatgtaaatataaaaaaataagtgatgcttaaagaacatttaacgataaatggagtcataattacatagctattttgaataagactaatgattaaacatatctaaaaagtcaacaacatcatatattaaaaatgaagggaggtcaaattaagttgtggtgacgaatgaacatgagtaatcccgcccattgatcggcatcattcatagtagggcaaattttgctacgggatattgtgacttcgcagttttagctgtaggacacggcacgaagtgacttttgggggaaaacactcctaaaggttggatatttgctggtggacaccgcacccattaaaataataatttccggttgaaaaggagagag

SEQ ID NO: 68800 - DNA, 585 bp, Oryza sativa
aacatgcctatattagggcgccgcatacgcttttgtcatataatgcacaactgtgttattattttgtcttcaactatatgtttagtttgttaactaatcacatagttgggggctacacctaattaggtgcatctattcgatgcaccatattctttttcttttcgccctttacagtccacttggcaggttttggcttgaagagttagaagtactcggattattatctttgagaaggctatgatggtcgactgcaaaggactcgggggctactgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggac

SEQ ID NO: 68801 - DNA, 9010 bp, Oryza sativa
ttcttggccggcgtcggcacgggggtcgtcgagcttggtggggatggtggcgggcgcttcggcaacgggggaaagaggcgaggcaacgggaacctcgaccgggggagaggaggccggcggcggggtggccttgggccttgggcgccgggacggatgccttagtggacttgatgggtgacgcggtggccgaagccggggtaatgggcgcctgcggagggggccggggtggcgggggtggtcggcacagcggcgggtgtgggcgcgtcttcttggaggagaccagtggcatggtagtcagttctgccccgggggcgggcggagatggcggcatcgatgtcgagagcaacctcgtcctctgctccaacctcgccatctccgcccctccatcgtcgccaacaatagagctcctcacttgggacgacagcggagagacggtggcctggatctgcggggactagaacggcgcgcgacggacgggcgggtgggtgaagaatggcggagcatgcaagcgaggcaggaggcgggtgttaacaccaaaattcctgcactggagctaagtagatctcccaggccagtgtgtgtttttcgcgtcaacagcgggtagcgacctcggcttggcggggagaccgtggccgccgtgaggggcggcgatgcggtggttggccacctcgggtgccgctgtcccgagctcccccgcccggtggcccaagcggtgaacaagttccatgagcttgcccgccaccgctttgctccacctgccgccccctttgctctgcttgttgcttgccgcgactccgcctgccgtcggtccacgcaccgcccctctgctccgcccgccgcccctttgctccgccttgccgccgctccgctcatcacccctatgcgccgcccacccccgctcgccctcctccttcagtgcagaactgcaggggagagagagagggggataaagagaagagggaggatgacatgtgagatcacatgggcctacccttttttattattttgtgtgtaattgacatatgggttctagggtttttttttaattatttttccgggatccaattgccacataagtgccacgtcaatgccacataggacgaggacctagttaaaggagccacgtagatgccacgttattcaaaaccgggcacaatactgtcgagggatctcatctgcatggttttataagttaggggatgcttatgtccggttttcaggagcgaggacgaaaattagaccggcgacaaattgaaggacctaaagtgaacttattccactataaacccctttctacgacgaagttaaaagggaggccgtgcatgatttacggtagtgtaatcattaaagccttgtttggttaatctcatctacatgtaaattagaagatttggggaagaataattcgacacctattgagaattaatctctctgaatactctttaatccctccctcacgggaattgacataataaggtccaaaagaaagcggttcacaattttctaattgtaggatgaactaatgtggtcatattatatagtcattataaattacatagttcagaatttccatcatgattaccgaattccaacggcacccaaaaaatagttcctttttattttttccaatatttttgatatcattttcgtttcagcggcacctctttataaaaaaaaaagttattgaaatggtagaggctattttcctatcgttttcaacactttatgtaccctcatcctaggcgggccatggttcaatgtttttggagacgtacgtattttgtcctttgttttatttcatgcggtaatttggacaaagtgtgttacaaatgcaatatacatctgtaaatacttggggacgagttcctgctgaaaagaaagggagatagcaacctaagagaagatgagcttcttattatgttattccagagaaaattaatcagaaacggtgatgaacatctttccaagaatggtggggggagacccctctcgatctccctctcctttcactctttccctcctcaccttctccatctttatgggtaatttccagggatcttttcgaccacaaaacagaaaagatcccctaaaacaatacaatacctactgaaaaccaccaaaagaaaaaaaaaagaaacaagaaaaaaaaagcagcagaagaacccatcctgtcggccatgcttgtacacttgagtgtacactcatcccatgatctctgaaactgccatcaatcgactgttctttccgttcatcatcttcagggattcctctgctcagatgattggttactcacactgttgaatcacgagttgtatcttgtatctatatatatatgtgctgcttgtgttcaagagtgcaaagttgttgttgggcattatgttccttcagttcagaactttgcactccagatggcgctgtcgttctccccacatcgttgatggacctccttcatccgatccgccgatttgcagatgccgctgcagctccagtcgaacgacgcggcgcacacgttgcctgcctgcgccttccattcgcaatctgcagtagtgcgaaccatttgaaaaatttgtaaccaacagttggctaaaatatgatcagaagttgacaaaagaaaaaaaaatgatttgaaatttcatcatgcatgtcaatcagcagggtgattgatcacgtcagtccagaactctaagctcatctgacaacgacaacatttcccctgtaacagtttgctaattgtcctgtaacacctaccagtctctgaaactaatcaattgtgtacgtgagcatacatgactaaatgacgagcgcaatggccaatttagtccattacagtatttaaggtgaaatgaaatatctatctaagagcagctgtgacaccttcagagagaagagaagtggccttgttagaaaaaggtccgatgtctagtgtcctgacaggatgcttcatgattacaaaaaacaattgacaagcacatgtttgtgacagcagatagcatacctacttagtgaagttgactgacaaccaccccaaactacaaacgcaactgcactgtttcaccaaatgattcgatacatttcgtaatataaaatatgataaatacagatcaagtaagctgtattcagtccgactaccccatactatgaagagttgactgacatgtcaagaccaaacaaggatctggaagagcaaggaaatcagttcaaaagatggtaaggattttaactatacctggttgtgtaccgcagcaaagcctgcgatcatcgacgtgttcgacgtctagacctatgaaccatgctcctaatgatacatcctcattagcatatttgtggagaacatgcctgaaacatcaccatcatccatggtcaatgatgggtagaggttagataaaacatattatggtgtaatcaacaaagaaaaaccaaatctgaagaaatttcttactggttgattgatatataagaagctagatccttggagattgcatataactggccggttgcatgacggaagtacttgttcccccattcgccgaatttccagtactcgggctcatggtatcttacacccctgagaataaaaaacaaattggtatttggtcagctgtttaaaacatcaaggaagacatgacaacaacatgggacttacttctgagccaggactggaccagatttcatgcaaccaatgtaagctcgaggcttcgaccgatgcttagccaatatgttaccaagagttgctgcaacatttttatatctgattattatagtatcactataacaatatctaaaaaaattatagtatcacaataattgagatggaattttccagtaaaagggttttaagcttgtgctttgggagtaacatctctgaagattacagcatatacgatattttatcaactttgagtgtacaatttgtaagccaaatacatagcagaaatttaatgtaagtaaaatatatgaactaatcaaaattttagcagaaaaaacacttaatgaagggatatgatgttagatcagagggtagtaatgcacacctatatttacatgtacatcatcatccactttaatgtagtactctgcatcccacatggacaaggctgtcacaaagaacgatttcgtctttgcagccaattccagatacccttcaacatgatcctgagtgatcaaaaaatattccaagatatttcagctttacagacaaataaacaagccagtaatactgtactatatgccagctagagtaagtcctatggtaattaccaatctcatgaagtcaccatgtttcctatgcttctgcgtctatagctctatcgagtatgccaccagatgttgcgctgtcaatttagaaaggttaaaatttcagattctgtgagctcaagatatcgtcttctgacattgctgaatcataactggtactaactcttttgtctaatataatagaaactctcccttaactattgtccatacagatcgcccaaagtacatgttttcttgcactaacctatgaccaatgacgaatcggatgataattcccttttcttcctcaagcttccttcttttttcacctgtcgcaaacacagaaacaatatcaggtaacatgttttactgtgggaaaaaaaattctccatgcaaaagaatgtacaaccttgaggcatccacgtagcacgaagtgaatctcttcgtttccggctgctgaatgcggtgttgatgccaatgaccatgaagtatctccgtttccccgtagattctgatagcggcgctccattgagctcagactcctcctgtgacgcctttgctgatgctaactccatttctaagtttgatattgttttgtccaatgccctgataacaaaacagattcttatgaaccttggacttataaatttgaggttaaaatcagcagcataaaagtaggctatcattctctcaacccttttggtacttactgtatagcatcctgagttcttgggacctctccaattatatctttttgctccataacctgcataatatgcaggaaaaataacgatgctcgtgaaaatgcattgacgacatttgttaattttctcattcttcttactaacagtagaggtcactgtaaatgatgtttgcaaagtaatctgaaaatatttgtgtgacagttaatgcttacacttttcggagcacagtcaccagacaacaggttcatcttgttcacttctagagccgatctcctgatgatctcttttggttctggcattgtccacatcctgcaacaaatatttttttcttatttcctctgctccaaaatataatcatttttagaatagtgttaagtcaaacatttttaactttaactattaatagcaaaagaataaaaaagattaatcacgtaaaattgatgtactagatttatcattaaacaaactatcataatatataactctttttatttaaaacatcttaatgttataaatattattggttataatagcattttgaagactacgtcaaaatctaaaaatgtttatattttaggacggagagaatagcattttttaggacggttgcggtacttgtttatagtgacacatagagtaacaaccgcaacagagtaagcatttagtaaaagactgcaaattaatgattattctcatctcatttctttcgaaaaaatattattcgcatttcacagaaagatactaagtgcataaacttcagtgtaaaaaaaacagaggttgttgtttgctccatgcttggctgctggctgcgacctctgctgacgtttctgtagccatgacgtttccaactgtatttttcactgtacaaactacccaaggaaggccaaaaaagaaacaaagggcaatgatgccatttttaaccttaccaaattttaataaagttgtcaaaaaaatggctacatttagtttgttgtcaaattttgataactacataagaaatcctactaaaattttggccactatgctaaaattttggtattgtcaaaatttggtaagattttttttggcatcaaagtgaacaggtccaaaatttactgacctccactaatggggccatggcaactgtaactttcgtccaggtaaaaaagcagaagtgtactggtagcaggagtatacgttgctactgtgttgtcggcgacaggtatacgttgtatatcaggtagttagcgataaatgtactcagtatccagttttacccacccgtgccgtcggatcttctcgaaataaagaagcgtcacatcgaccaggcaagtacgctacgagcttccaagaactcacccacatttagcacgagcaaagcaggatcgagcctttaattcgagagagattttgcccttttaaatttcttccagagagctgcttcttctgtaggagtacgctacagcaacagcttagagcagaggagaggagatgagagtacagtacgccagctacagttgtttgttgttctttgggggtgtactctccattgaccaggagaggatgagaaaaaagagcagcagaggaacgcaagaaagaaaccaatagaattcagagaatttttggctgaacgaaccgaacggagaggaggaggcaaagagagaaaagcgaattgctggtaggatccgatcaccgcgggacaggatcaattttgcttttcttttcctttttggaatggaatggaagatgaaaaaaaggcgtctaaattcacccgtacacgaatggacgaagcaaaaaagcatgcagaaaacgaaggcgatcaaactgattgcatcacgcaagattattcaacaccaaaccaggacaaacctgcaggagcaagaagaagacgatggaggaagcaggggggcgtacctgttggtgaagatgaggccgatgcagaagctggcgaggcagaggaggagggtccatttcttggagatggtgccacggagcaccagctcgtcccctccgccgagcaccgctgctccccccctgctcttgttgaagctcatcttcacctgatctcttcttcctcctcgctcgcctagctctctaatcagtctccaattcacacgccctcacctatggatcctgtctccccgatctcggagacctcatgatcacactccaagaaccagaaatatggtccctccaccctcctgctcctcctgctgctcctctaacttttgtcaagatcaagtcactactcactactactaatattacctttaatttcctctctctctatctctgtgtgtcaagattctttggttcttgaagccgcctgctgccagtggcaggtgcctttggggtgaaggggaaggctgatatggagatggagacgagggaaaggatgcaccaactgcgtgcgtgctcgcgcgcgtgaagggtgtagagtggagtccgggggagggaagggatctcggcgattcttggtggcgctgctccagatttattcggccttcgccacttggtccggtctggacatctccggccagcttagcttagcttagctagtttagcttcttttaagctttagctgaagtagtaggtggttaagttaggtttaaactttggtctcctcttgtggggattattgtagtggaagcgccattaatgagctgatgtggtaattaagccaggctaaggtgagtttggagggtgaaatggctgttttgcccccttattttgtgtggtcaagtcaatggcatgttcaccttgcgagggtcagtagtactcagtagatcaccacccccatgtgttgagggaattagatacagttgtggtgctacaccccatgaggattctcttgtcatgttcagttcaaaaatggatacctcttctatagagcatgcgaccaaacttctgcagttcttgaaaaaaaaaagagcaatcatgcaatgctgttatgtgaaaatagtgtcatcaaaatttatcacaaaaaatattttagtattaatttgaaagcagtactacctctatcccaaaataagcgcagccataagtttccgtgtccaattgtaattgtccgtcttgtttgaaatatttttatgattagtatttttattattactagaatataaaacatgaatagtattttatctgtgatttatatttttttagttttttaaaacaatttaaaataagatgaacgattaaagttaaacacgaaaaatcatgtatgcatttattttgagacggatggagtatcaatttgtgccatcatcttttactacgcctctccattatcttttactccatgacttgactgataagccatgaaaatgaacgaaggaaccaaaatagtttgataatttatatgagaaaacttttgtatctgtgttgattttaaaagtaaatacttaaaaaaaataaactaatatggaaaacccttaaaattaactctaacttaattagattttcaaattcaaattttcgctatgactaataagccaaaagtaaacagatgcgaccgtattcatgagcaagctaagacttgcggactcaacgtgttgccagcgtgcctaaaaggatggtcaataattcgattaaattcactaaaaaaatatatgacgataattttctaacaaaaccgtgccaattattcactacaattaacgtaaatgtaaatggtaggatgcaggatagtgcatctatataaaagttaatcaatttatatattatatattcaccctttaaaaacatgtacaaagttggtgtctaacgggtcatgtatatgtccttggacaggtagactaatcataaattcgtagtcaagtcacctgtagaaattgtacaaacagtgttttcttgtggcgtactttttgcccatgttagcaagttcaggccacacatatatgctagctagtgaggagtatataacaatgtacagtaataaagagccatcgaccattaattgtttatctctacttttctttgtaatggagcaaggtatcttctttgttgcaattgtttttggtaaattatggacaaagggatctagttcctttcttcaccgcttgcaaagtatttattcttggggctgcaggaat

SEQ ID NO: 68802 - DNA, 2701 bp, Oryza sativa
cgagtgtcatatctgtccatctttttatctacctgatgacgccgtcactatctactactccctccctcctataatataaaaaaaattaactttttcttacactgtttaaccactcgtcttattcaaaaatttatgcaaatataaaaaatgaaaagttgtacttaaagtactttggataataaagtaagtcacaaataaaataaataataattttaattttttttaataagacgaatggtcaaatagtgcaagaaaaagtcaaaatccctatattatgggacggagggagtacgtacttcgttcgtctcaaaatataaacaattttaacggaataaaatacatccgacactaatactataaatatgaacatgttacaagtctaggtagttttacgaatatgaaaagttaaaaattgaactaaccaatgtatgacattgcttagttcaaatttgcactatctactacgaagtactatcctttttctatatgacaacgtatgaaagtaaatataggtagtatttaataaattgagttttggtattgaataaattttacaaaactacatgtattttgtacaatttatcacgaaattacagattcagtgtctccgtttatcacaaaactatatatgctttgtacaatctatcagaaaattacatatttaaaaacttatttcataaaactatagattttatatagtatatgtagttttataaaatttactctttagtatttattatcggacattttctggctaatcatataatatgttgtacggttaggtagccggagtagctaacactaatttttgatatccaatcaaatcaacctctgatcccaagttcccaacatctgaaaaaaaagtaccccctctgatcccatcgattaagccgcaaatgaaagagtttgcatgcatcgatgcaccgaaactatttaggccctgattagtttccgtaattttttttatccaatcatattaaatatttggacacacacacacacacacatatatatatatatatatatatagtattaaatatcgatctacagtatggagaagggacacatatatagagtattaaatatagatctacagcatggatagggcagatcagcagctaatattagcttgtgagtatttgttaatttaatttgatataatcgatcacgagaggtgattattaattaattagattggatacacaacaacgtaccgtacctacttaattaattaagagtagcaagcaaaggcattgaatgcatgggtgcaattttcatattgcatggtttggcgacccccccacattgcaagagagcacgtgcattcctatggtccatacaaactactattactacacacatctccatctttctatcatatcgtgccacgtagccagcccatagcggatctaggaagaaataacaggagagtacgaaaaaattagataaaactacaaccccttcctatttactaaaaacaaaaaattttaataaatgcttcgtgaggactctcatagttctcacaccaatagtggaggctggagaccccgtcgcccctgcagccagctactgatcacatatacgaaatatatgtatttatatattcaccaaggttttaaatctctgactattagtcactatctctagtactccctccatttcgaaatgtttgacgccgttgactttttaacacatgtttgaccgttcgtcttattcaaaaaatttaagtaattattaattattttcctatcatttgattcattgttaaatatatttttatgtaggcatataattttacatatttcacaaaagtttttgaataagacgaacggtcaaatatgtgctaaaaaataaacggtgtcaaacatttcaaaacggagggagtagtagtttaaggagagtagctatttgcatgctctcatgtataatttagatattattagacactgtaacctcatttagccgctattaactgtttgaaagggtctatacttaaatgttttagctcactatttaaaaccgggatatccacaccaatgtatgcatatgtattttgtacaggaaaaaaagcactggctctaaacctcatcgtaaattacaaaaataaaaacctacaaaaaaagaaaaagggaaaaatatactgtagtactttgtggttcggagaataaaattccaaccctgcgtgacctcattggaagctgacgaactctctctaaccaacagaaggcccacgggaatcccggcctagttctttccaggcccagataaactaaaccgagtttgggccaagatcttggggtggaattgggcccagaaagagcccaaaccattcaaactcgcgaatttaaataaccaaacaaatttagaaagacttttgaaacttcggagtagctatgaattgaagtaacctacgtgtcatgcaattgacaagttcgatgcaaatttgttgaacctattttttttcctttttttttttcaaaaaacgtacatcgtgtcccgtgttaaaaaatctacaattccaatcacggaatcacccccttaaacttgttagcaaacacgaaaaacaaaacagaaaaaaaaaataagcaggagttggagtttaaatctctgaaccctatccatgacctcatttgagaaggcccacgtcttgtatagtttaaccccatccacggttaaggataatgacttcaaacatggccag

SEQ ID NO: 68803 - DNA, 3916 bp, Oryza sativa
gtccggtcgtccgacccggacgccaccatcgtcgccgcgccgccgccgcgggcgtagtcgagcgcccacacccgccgccctcgtgctcgtcgcgctcccagaccggcacgccgcgctccacgtcgtactccgtcacgacgccgtcgtagtcgccgcaccccacgtgcgacgccgccaccgcctcgccgccgccagggcgccaccgcacgctgctcagcttggccgggacgcagatgcaggcggcggggctagacggctcggcgaccctgtaaatccggatcttccgggcgatgccgccggtggcgaggtggcggccggtggggtcgaagtcgaggctgccgatggagtcggacgcgcccgcgagcgccggcgacggcacggtggccgccaggcgaaactcccattcgcacctcggcggcgacagcttgtcctcgtcgtcgggaataatgccggcggcggcgtgttcttgctgcagcgccgcctcgtcccggtgatcctgatcgtgcagctgctgctccccggcggcggtggacgtggccggcgaggaggggttgctcatggaacgctagcttgctcgcctcctcatagggctaagctagctaccaagctaagcttagctcaagctcaagctcacaaccctattcttttcttgattcgagatcgatttttttttggtttgtttttgttgaatttgatttggtggttcttgtttgtcctggggcaagaactagagagagagaaagaaaaagattgtagagagagagagagagagagagagaatggtttggttgaggtggattattaatggagagccacaggagaggagaggagccaatgagaggaaaggtttaggttgcagtgcagggtttgtgtggctgagtgaggctcatgtcgtggctgcatttgcaattgcagattagtacgtgctcctggtaagtggcatggtgaccaatcacaattcaaattcaatgcgaatccaattcaagctggctaatggctatggcttgctgagctgagctggtaggggttagttaattagtttggttaggtttggccacatatacacaggcagataatggtccaagatcgaggcagttacttgtactgtactgtgtcctggttggaatatttctcaccatttattttggttagcagtacatctcaactagtactactctcctgcctcttcttttcctttatttggaaaaaagtcaatcctccttacatgtaatcaactaatttaatcatgcatgaggccgggttaattctcatcatgtcaactattattggtacatgcatgcaaagtataattcattcgatcagtacaaaactacaaactgaaaataaattactccatccgtttcacaatgcaagtcattctagcatttctcacattcatattaatattaatgaatctagacatatatatatctatctagattcattgacaccaatatgaatatagaaaatactaaaataacttacattgtaaaacggaggaagtacttacaatgtcatacccacgagtctcctaacacacacctgaaaagacagatagacgaattctcggtctcactaaatttgtactcctaaagctcacttgcgcgtgtgtaaattcctattgaaactaaagctcactcgcgcgtgtgtaatatatatatgatttgtttattattgacgtgcattgcacattacttgttcaagaaattaatattttttttcagaccaaacaaaatttaatttatacgcagtcaaatgttggataagagaaagctagctgcctgcaaattaattaattaatttaaattttaaaaatagattaatatgtgtcgacgagggatgcccgtagaccggatatagagggtattggggtacgctggtacgaggatctacgtagtacgacatcaagcaaacagaaaacagagattatactggttcaggcccctcggaaggtaataaccctaatccagttgatatgagattatatgattgaaatcacatattacaaagggtataatagaactcgatgataccgtcgagaccgtagtcgagttggttcgactagatcacctggcgacttggctcctgtaggctccggcttcgtaggctgtggtggatgtgttggcggtaagatttgatgccttaggtcctcccggggggttccttttataccgtggtcagttggtctttaagtagaactcggagacatcagaccccacacgatacagtaacgacccggttctgtccgagtaggactccttccatccgtggactccatttctattacacgatgaatttccttaacgtgtacaggaaacatccgtatacacgcaggtataccatatcagtatacgtcgtatatccaagggtagagggtataccttatccgtaattctgacaatatgatttttaaagaatcttttatataacgatttctctttttttttgcaaaaactacatagtttagcaatttgggaaacatacaagcgggaaacgggttcttttgtttcttttgtggttgtaacaaacgcaacctagtatgtactcgaaattgtcaaagtttttgtttgtttagtactaattaaaagaggagaaattaggctttgggggacaaatgaaataaaataaaagatcgatccccattggaattattatatgtatagtttgtatatataggatcgagaaaacagtggagatatgagatggacgtccttactagctggagtagctcttttgttgtatagatagatagatgagattggtggtcacaccgttgacaggtacgcaggcagtgaacgcgtgtggaccagatcgtttccagttcgtacgtactagctttattagttggcgtaattactgtgtcctagttagctaccacttgcaatataaattattgttttggagcatatatatgcaattaactggcatcatatttagattagtagtatatatgaatgcatgtgtgtgataccgcaaccttttttcaggaaaatgtgtagttttcatatttagattagtactccctccgtccataatataagctccgttccataatataagggattttaagtttttgcttgcaacatttgaccactcgtcttattcaaaattttttgaaattattatttattttatgtgacttacttcattattcacagtaatttaagcacaaatttttgttttttatatttgtaaaaaaaatttgaataagacaagtagtggtcaaacattgcaagccaaaactcaaaatcccttatattgtaggacggagggagtagtatatatgaatatatgcatactggtggagaaactatctttggtcggtccggcaaaatccacaatagtcccggatccaaaaagaaccgggactaaagattgtttttagtcccggtaataaaaattttgatctttagtcccggttggtaacaccaaccgagacaaaagatgatctttagtcctggttcatcctctgtcagatgtatgtcagggggccgagaatctttagtcccggttgatgtcaataacaggaactaaagatcaccactttagtcacggttggtagtaccaaccgggactaaaattaaacacgtacggttggtactaccaaccgagactaaagatcaagaatctttactctcggttggtagtactaaccgggactaaaattaaacacgtagtatataatccctatccattattctctcctccacagttacaacttagacagatcgaatctcacccctctcctcagatctatcctctctaactctcctctccaactcctccccttctctccccttcctccttccttcccagccggcttccccttcccatccggcgggccggccggcggcggggccgcgcccggcggggtcgcgcctggcggagggcggcagcgccgcgcgcggcggcgggc

SEQ ID NO: 68804 - DNA, 3202 bp, Oryza sativa
atgtaacgccccgattttcgttcgggattaaaaatcatttaataatgcatttcctagaaattaaataaaaagttaagcaatttatccaagtgaattattgggagaattaaaattttccctttaaaaattattggccgggaatattttgtaatattctttgtgccctaaaatactctccggaattttccgtgaattttcggagctcgagaaatagttttaatagcacaaagatcattgcatcaattaaaataaaacgaaaacaaataaaatcctccttttcctcttcttgggccatcggcccagtccaccccgccgcgcgcgccctcctccttgtgggccggcccaagccgcccctccctctctccccgggacgccgacaggtgggccccacctgtcggacccgtccccttcctccagccggcgccgccgcgcccgcaaccgccgccgcgtccacgcctccaccttctccgggccacgtcagccacgtccgtgtgtgcgccgcgtcccccatgcccactcccctctctctcccgcccgcgccccgcgcccgagatggccgggattcgattttcgaatcccgcctctctctcctcccccacttccccacgttggccgacgattcccgcctctcccggccacgtccggccctcccctcccctatttaagcttccccgtcgctccctctcgctttttccccttctcgccgaactccctcgtgctccccatcgcccccgcgccgtgcaaccactcgccgccgccgttttcgctactccggccgccgctagccgccgctagggtcgccgccgcaccgcgccgtcgccgccgtcgggttcgcgaggctaagctccaccccggccgccccttccccgtcgagtttcgtcgccggaattcgcatcccctcgcgctccggtgagttcaactgctaccgccgctttcggccatgaataccggtcgccgtggttcatctccctccctctaatctctctcttctccttccttagggcaccccgaatcccgtccgccggtggccgtcgtcctcccgtggctcgccgtcgccgttcgccatcgtcttcctccgcgccggccaccctcggtgaggcatcctctcccttctattcccctccctctccctcctagccgccgctttagcgccgccgcccgttagccgtcgctttagcaccaccgcccgtcggcgccgcctttgcgccgccgtctccgtcgccggttgccgtcgccggcaacgcgtgtgcgcgcgccgtcgccgtcgccgtggccgcttggccggtcttgagccgagccgggtcgccaccgcccgtccgatcgaccccgagggcgatctgggccgtcggtcccgtggaccggcggtggaccacccgcgtggtcccggtccacggtgaaccgcccccccttgtgtcgctgaccggtggggcccgcttgccggcgccgcctctcccccttgctgacgtcagcgaggtccatttcctttgtaaaaataaataataattacgcaataaatcgagtttaattctagaaattcatttaaatggctcaaaacttctaaaattcatatctaattcattcgaactccgaattaagccattcaacttgcaaaattcatctaaaattgagctctgcatgtttgtttagtttttatgtactgtttccttggtttttattagagtttttcctcattttgtgtgccagcgtgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatgggatccgggtattacctatctgctcgcttgtgccatgtttacttgatatctgttctttgtcaaccttgggtaatgaatcgactagctcatgttacttatgtgtcctagctagaactatatgcttagccatgcttaattaccactagctcagttgatgggataattacagtattagacctttttagtatcagagtgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctacgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacgggaacgtgtcgtggggctgtgtcttgtgggtacagttgtacacctctgatcagagtaaaactattcgaatagccgtgcccgcggttatgggcggtcgactagattcaccgtgattagtcccaccttaataaatcgactcaatacactgtagttcaggtgggttggttgggcctgttcaacgtggtgtagcgttgatcagtggagattcaatattactttaattactcaacagttttactgttttgctcaataaaatgttttacaaccgcctttatgcaaatagccacaaaccatccttgtatccccttgcacatctgcatcgttggtgtggcttgctgagtacggtggttgtactcagttttgctattattccccctttttcagaagtgtagtgcttctgagcggaagatggagttagaggaccaaggctcagaccccagttgagttttgcctgtggagtggagctgaagccccgctaggatcgcctttttccgctgctgtcgttctgtttcggtgtgaggactaagtgcctcttccgttttacgctttatttacgtttggaactgtatattacttgtcgttttgtgtaccctggctggtcctggacagggatttaatacgcaaaatagtctggaaatttgggttaaatttctgggcgtgacaacgcgttagtacagcactgcacgggtcgagtcacacagcacctagtat

SEQ ID NO: 68805 - DNA, 1203 bp, Oryza sativa
taatgtcatgatttagtatattgctgtcatagtgttacttagcttgccaatagtcagcgaacttattgccaatgggaatgataggaccccttatctggtttgattcatgttagaaataaacagacaagccaatacatcgttttatagtacgaagtaattctatggtttcgtggtccaataatgcttcatattccaggtgtgcttgcacaattcaaacagatgcaccataggaattaatttcaacacccaaataaatactaagatggtgtaaaagccatcccttatggttaactgatatatgatgatcttatggaagtcaagaaagcatctcactggtaaaaataattgaatccctgatttcaatattcgtcgtaaaaaatcaactgacagagaagcatattagaatatcactcttttttttcactactacctgattttattgttttatcctactgtagaatttctaatatatcaattggacaattgagctcacaaagtcagactactaccagtgtaccgctcgttgcacggtttaaatgatcaactctttcaaaattatcaactgcagcaacctggttactgaaaatttcacagacaggaattagtttgcgtgctaaaaacgagtctagaaactatgtcaaaaaccttctttctttcttttttcccccttcttctgaggaacaatgtgccaataacccttctatgtcattcccccacaaaaaacgagtagagggctagaggctccagggcagagagatactcatattaggaaggagagagagagagagcaatgagaacacctgtggcgcgcgcctctcgttgcgcggtgggggggagggaggggggggtcttgaggctactgcccccctgccggtgctcaccagtacgagatcttgcgccgccatctgaagggagacgatgaagtggtcgcggcggcgaggtggccatcgccgtcggcggcggacgcgaggggggaatagagcagcggagcgagtgccacactgccaccattagttcattaccaaggactagaatgaaaatttttttggatcgcaaccaatatagcgatctaatataatgtagggactaaaatggaaaaacgatacaggtgtcgctgccagccaaactgtcaatacaacgaaaaaaacatttgatcgctatacgcgattcaaattcaaccagtggcggtctaaatttctagat

SEQ ID NO: 68806 - DNA, 32017 bp, Oryza sativa
  unsure (1)..(32017): unsure at all n locations
caaaacgacgacaggaggtgacgccggcgagaggaggaaaaagaagaaaggaagagggaaagggggcttgcctccttgccgctttgggaaaaggaggaggaagcgggggggtgacgcggcagagggaggaggagctctgcctcctcttcttggaagctagcgcgtggaggggcggggccgagtcgatgacgacggcgatgacggtggggcggtttggagcggggcgacgacacgggcggcaggcgcgggcaggcgcggcagaggctaacggcggcggcgaccaggcggtcggccaccacggcacgcgcacgcggaaagcaacgggcggcgctgcggtttgagcggcgcggctcgggcacgagtgctgacccgcggggccgagcggctgcgcggctacaggcgcggcatggcagcggggccgggcggcgcagacggcacaggcgcggcacgggcggcgaccacgcggggagctcgctagggatggaggcggggagagggagagcgagggggggagggcgctcgacgcggcttacgcgcacgcgcgcgtggcgcgagggcagagcgagggagagagggagagagagagagagagagagagccggggagggaggggaagatgggccgagagagattcggcccatcgaacccgagggaggcaaaatagacttttgcggaggaattgatttgggaaggatttggattcgggattgaactcgacgatagatcggggatttgagatctgagaaggcacggacactagacaacaagcaaagaaacagatttcgcaaataggatttttaagagataatttttcccgctaggcgccacgacggaacgggcgctacagaccaacccccctaacaagaatctcgaccccgagattcagcacctaagggagcagctccgggaactcggcgcggagaagatcttcttgctcccaggttgcctcatcttcagaatggttgctccattggactttgtagaacttgatggtcttccttcgagtctgacgttctgcctcttcaagaaccttgatcggtctttccttgtaggtcagattcttttccagctcgatattacccagggggacttgctcttctggaactcgaagacatttctttaactgggatacgtggaacacgttgtgcacatctgcgagaccttcaggtaactcaagatgataagccacttcgccacgtctggcggttatgaggtaggggccgatgtagcggggtgctaacttgccggacatcccaaacctccttataccacggagaggcgatacccgcaggtacacatgatctcctttttcgaactcaaggtcacgcctccgattgtcaacgtaattcttctgacggttctgcgctgcctttaaacgttctcggatcagcttaacttgttcttctgctgccttgagtatgtcaggaccgaataccagcgcttcgcccacctcattccagcacaagggagtgcggcactttcttccgaacatttcctcattcgatgacatctgaatgctggcctgataactgttgttgtatgagaactccgcatacggcaaacaacgatcccaagtgccttcgaaatccagggcacacgcacgtagcatgtcttctaggatttggtttaccctttctgtctgaccatcggtctgcggatggtaggccgtactaaaatttagatcggttccgagggcttcatgcaactgcttccagaaccttgaggtgaactgagtgcctcggtctgacacaatcttcttgggacagccaaatctacacacgacatgggtcatgtagagttctgctagtttctttccatcaaaggtggttttcattggcacgaaatgagctgatttcgtgagtcggtccacgattacccagatggagtcgtacccgctaggggttcttggcaaaccggtgatgaaatccattccgatctcttcccatttccactcggggatcggtaggggttgcagcagaccagctggcctctgatgttctgccttgactctttggcaaatgtcacacaaggctacgtattctgcgacatctcgcttcattccagcccaccaaaagtatgccttgatgtcttggtacatcttcgtacttcctggatgaatggagtaggcggactcatgagcttcctttaggatgagatctcttaactccttcttggccggtacacagatgcgtggaccataccaaactgtgccttgatcgtctatggagaaatcggtgtctttcttctcctgtattctttttattaactcttttatcccttcgtcgtctttctgagctttccggatttgcgattctagggtaggctgtactgtcaagctggcagcgacacctgactgtactacggtcagccttaacttttccagatctctgcacaggcgatcttggtcgggccgtatttgatctacattacaataggtcttgcgacttagcgcatcagcgaccacattagccttaccggggtggtaatggattccaagatcgtaatccttgattagttccaaccatcttctctgcctcatatttaactcggtctgtgtgaagatatacttaagacttttgtgatcggtgtatacttcacatctgttcccgattaaatagtgcctccagatcttaagagcatgaaccacggctgccaactcgagatcatgggtgggatagttgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgtagaccattgaaatttcttttctttctttaacagctcggtcataggtctggctagcttagagaatccttcaatgaatcttcgataatatccagctaagccaaggaagctgcgaatctctgacacattcttgggcgggttccaagcaagtacagcctcaaccttgctgggatctacttcgacaccgttgggggagatcacgtgtccaagaaatgctactcggtctaaccagaattcgtatttcgagaatttagcgaatagttgatgatccctgagcttttccattatcagcctcaggtgttcagcatgttcttcctcattcttggagtatatcaggatgtcattgatgaacaccacgacaaactggtccaggtattccatgaagattttgttcattaagttcatgaagaatgctggagcattggtgagtccgaaggacatcactgtgaactcatatagaccataacgcgttgagaaagcggtcttcgggatatcttctgatctgattttcaattggtggtaacctgatctcaagtcaatttttgagaaaactcttgctcctttaagttgatcgaacaaatcgtcaatccgtggcaacgggtacttgttctttatagttacttcattcagggctctatagtcgattaccattctctcagagccatcctttttcttaaccaggagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatactcgttaattcttctggaaatacgttgggatattcacagactatgggcaccgactccaaggaggtgacttgtaaacaggttaggatagaccgactcgcggtaggggtgttagaggtaaagcggacttgctttcctccaggtccttgcaaggtgatggacttttcggcacaatctatctgccctttgtgcttagccaaccaatccatccctaggatgatgtccaagctttgcgagtctaggactatcggtttggctaggaagtcaacttcctcaattctaaggttaacttccgggcatatttgagttgcccttatattcctcccagggaaatgtactatcattggtacacgtaaattttgggttttccaaccatttcttttcacaaaagcttgtgatatgaaagaatgggaagctcctgaatcaaacagaactattgcgggtacggagttgacagagaacatacccatcacaacgtctggagcatcctgagcggtctcagcttgaatgtggttcacccggcctcgaccaaagttgttggaaacacgagaaccttgtccacttgcctgagagctaggacgagactgagctgccgctggagtaggagttctggcagtgctgccattagcatgccctgagttggtgttggtaggattctgagggcactgtcgggcatagtggcccatctggttgcaccggaaacactgaactgctgacggtcctagcgatgacttgaaagaggtaacattgtttggcgcagtattgccactaggggcacgctgctgtggctgaggtgcctgacggttcatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgatccctttcaagaacttcctgatcttctacttgtctgtgtccacttcctcaggggcgtaccgagccaacttgttgaacagacttaggtactcattgacactattattgccttgcttaagtttgttgaattcctctttcttcatatcaatggcgctttcaggcacatgagctgcacggaaagccgtagcaaactcagcccaagcaatgttagtgggttcagggtgtgcattgcagtaattctcccaccaatctgcagcaggtcctcttagctggtgagaggcgtagagcgtcttctcaacaggagtacactgcactaagttgagttttctatcaacatctttcagccaatcgtcagcctcgacgggctcgacggtctgagagaactctggcggacgagacctcagaaagtctgtcagcttggatctattgttgcccatgtgagggtggccatttccatgcgcactatgctgaaaaccggctatggctgcggctaatccttgcaagatttgtgtctgaactgccattaagtgctgcatgttgttttccacatgaggtggggaagggaggcgttcttctccagaattgtgactagcagtgcggtgagagcggtgagactgttccatctctgcattacgggaagctgtgtgatgcgagcggttgctgcggcggggttgctcaacttctgcgttgcgggaagcagtacggtgcgaacggttgctgtggtgagaccgctcattagctgactcatgattttcttctggctcaactctaccttcttcaaaaccgaagcgggctggcgcacgagcagcacggcgggggcggctagccatctaaactcccagaagagggcggggtaagaatcagataagcacttaggagggcaaggagcaaagtaaatagcaactcagatagcacacactaggcataagctggatttttcaatcataaaaacacctaatacaacgggtgtggacaagtcacagagctacgccgagcttgactgtacgcacaccacctaggagaaccagactaccaaacaacacccacaacaaacacacgcacgcactacctcgccacgactccaaaagagttggcggcgaaacaaaagggcctaacacacggacggctgctgaagactgcctcctctactcctcgtccgtctggctgcctcctgtagtcggctcctcagtcgaagaaacgtcaatcggctgacgcgaagggaccggcggaacctgtcgagggccgatagcagcacgggccgctggcggtgggggagctgggtagtcgaatcggaacacggtggaagaaccaacaacacgcttccgcgcagtgcggataaagcgtgggccacggcgggaggaagcaactggggtgtgtccgggggtgtaggaggggctaactgggtgtgggtagggggagtacactggtgagtacggcgcacgtgagctgggggagcgcgggccactaggagtgcgagcagagccgcgggagctgtgggaggacaggtggctggcgtggcagaggcggcctgagtcccaagagacagtgtcaactgaggtgacaccctcctcggccagacgggcctccagagcggcgtagcggcgggcaagggagcggtaagtctcaaggagtaggtagtgctgagtggcctgagcctccgaaagctcaaccatgcgagtcagcactggctaagactcgctgtacggacaagggtacctggcgtctgcatggccagaaggaaggcgtggaagctgccggaaggcagagcccccgagacggtggctgtagtcgtgggccaagcgacgaagcgcagtccaggagaggtcctggtacgcgatctggagagtgggcctggccacagtaaagtggtgtgggcgaaggccggctccgtgtatacctccacgagggtaaaggtacacagagagctcacagcgagggggaacacggtccacggagtaccccgtgtactcgggacacgagaagccaaggaagcgggcgaggtcacgaagctgagcgacgtggtgaccctcaccaaaaccgtgggaactgaagctggcgttcactgccatctacaattttgaaagagggagaaaagatcagtaaccattttagaaacaaactattaaaaataaggaaaccaaaagaagccttagcttttcgcaagtagttttgaacttagtatccttagggtcgtcctaaacgtcgggtttcgccctagggccaagcctgtgctctgataccatcccttgtcacgccccgaactagtcccgaccggaactagcccgtgacgctccaaattaacctgttaatcgataccagtcccaggaaacagtgctggtatcacaggaagacagaatatcacagcaacagaggtctctttaatatagagaaggagtacagtcatgttgggctgcggacagatcccgagctcacaactgcattacaaaagggaagcggaagccaagacttggaccaaacaacacagacgcgacttgggaactaggccgaaaccctaaaactcaacgtagccggcttgctcctggaagaactcctcgtcagcgggatccgcttcatcttcttcagcaactgggggggtagttatttatatagagcaagggtgagtacgggagtactcagcaagccatgggaaataagtgtttaatgcaggcttcaaggaaaggctgttgtttttgcaattgattttatttgaactcttttctgaaaacgactaagtgagtgcttctcaaacgacacggatgagacagtgcgtctcgtccggtcggagtatgtgcaaatgtatcagtctttagaattgatcaagattggcacccggccaacaactttcaaacggccacccgggccaacaactttcaaacggccacccgggcctagctgatcccatcagctgcagattttccaaacatcgatcccctttccacaacagtaatttcccaagcagtagtcaaacaaaactacgctaggaatcacctcacatccacccatgaccgtgggcacggctgttcgaacagtttgttaacctctgcagagggggtacactttacccacatgaaattccaaggaaacggtccttaggtgcaagagcgggaaaccgtacacccggtacgttccccggtccgcggcggcaacggtcggggcggcgccggctagctacggggaggctactcgtgctactacccgagtctaaggggaggaggtggaacgaggaggaagaacggagggaggcactaccgtgcgggcgggcgcagtgatgagagccgacggcgcgaaacgtgatcgtttcggcctcgggccgaggaagaggagggggagggcgcgcccggagtccccttccgcgtccttgctcgtgccggctcctccgacacacgcaacgactaacggcgacggcgaatagagcacgggaggcggcgacaatggcgtggcggcgagagacgaaaacgagggagattggaggagggaggtgcttgggtttataggggcgacaatgtcggtttgggagaggggaaccgacattggacggtcaagccggcgagctagcgcccggctagcggccaaaacgacgacaggaggtgacgccggcgagaggaggaaaaagaagaaaggaagagggaaagggggcttgcctccttgccgctttgggaaaaggaggagggagcggggggctgacgcggcagagggaggaggagctctgcctcctctccttggaagctagcgcgtggaggggcggggccgagtcgatgacaacggcgatgacggtggggcggtttggagcggggcgacgacatgggcggcaggcacgggcaggcgcggcagaggctgacggcggcggcgaccaggcggtcggccaccaccgcacgcgcgcgcggaaagcaacgggcggcgcggcggtttgagcggcacggctcgggcacgcgtgctgactcgcggggccgagcggctgcgcggctacaggcgcggcagggcagcggggccgggcggcgcagacggcgcaggcgcggcacgggcggcgaccacgcgggcgcgcgcacgcgagcaacggcacgcgggggccgattttggggcagggagctcgctagggatggaggcggggagagggagagcgaggggggagggcgctcggcgcggcttacgcgcacgcgcgcgcggcgcgcgggcagagcgagggagagagggagagagagagagagagagagagagccggggagggaggggaagatgggccgagagagattcggcccatcgaacccgagggaggaaaaatagacttttgcggaggaattgatttgggaaggatttggattcgggattgaactcgacgatagatcggggatttgagatctgagaaggcactgacactagacaacaagcaaagaaacagatttcgcaaataggatttttaagagataatttttcccgataggcgccacgacggaacgtgcgctacacttagctcaactagtatacaatgggggaaatcacattaatgcatagacttcaggttctagtgttgttgttggttcaatgccaccgctctggtgatgattaattaaaatatattaaatggtgggctgtgggtgcatggtttggatggtcgcgcccatggcatttaaggaccggttcgcgggaaacccgtacttaccacaagctagcgtgggcaacggctgggcttgtagtgtagctttcctctagctgacgcatccaggcaagggtgagcgtgatggagttcggatgggccctgcgacggcctatgcgacttttggattcacctaggcacgagaggggactgcccactgccttgcgatgagtgggggtaaaacctgaggtgtggtatgtttggttagaggtggttatgcgaagggtcctgacacggcctctttccggtatgtcgtggtggcatatcggcacacgggaacgtgttgtggggctgtgtcttgtgggtacaattgtacacctctgatcagagtaaaactattcgaatagctgtgcccgcggttatgggcgatcgaccagattcaccgtgattagtctcaccctagtttagtctaatggaattgattagttcagatggatgtttgggcctgttgcaacgtggtgtagcattggacagtggatagttaatattgattaattactataaccgttttactgctttcaactactgtttataaatgccagcttgatgcaaaggatcccctttagccttcctttggttatattgcatcataccctccgttccggtatgacttgctgagtacagtgggaagtactcagtcttgctctatctcccaatcctcagagttcgagtatgcgtccgatggtggtttctccgaggagtaggcttcgtccgtgccatcaaggatgcctgtggagtggtgttcccgctgcaatccaagtcaagacttagctccagttatcttttatatttccgctgcatttatataagacttttataatgtttgtaagacgtggatctgtatgtcaactttgtcgtttgtgtaccctggccggtcctggacatggattttaatgcacattctgcttggaattctattcgggaatttctgggcgtgacacccttgatggctacaaggtaacatttacttgtcgctgtgctttgagaagtgcaagagcacaactccactataggaagtacaaatgttgtttatatatcttggttttctcttttctagtgcatagttgtatacaaattaagggcaaaagagacattttctaaccgaattattgactataaatagccatatggcatattaagtgggcccaaggataattttaagcaaaaacaaattcttagaggacctatatggacaaaatgaaacttgaaggattaaattgagctttcgatgaaacttaaaggactaaattagctatttactctaaacttatacttatcagctaaaatctaaattttcaaccttaaatttaattcaagagctgattttgaggttttatcatcgaagtttatttttcagcctttacttttagatcgcaaagaacacgtatataaaggttttgttcataaattacttttcgtttataaacatgccgtttcgcttacgcgtgctccgtaaatagggtactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccctttgtgggttttgcgccgcgtatatgtggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctaacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacgacaaccatacaagtctccgtctgttgatgaaaagataggataagtccccacaaaaaagagagagatggtgcatgtggtatccccttgaggtataaaaggaggacattgcccacttagaagggggatttttcggatccagaacgatcagagagggagagagtaagagctctctggttctccagctcttttgtagcttcttcatacatagatccaccaaaacacaggagtagggtatgacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctcccggtgaggagcctcacgctccgtcaggtacactagccggttttgacaagtcttagcttagatcaccgcaataatctttaagggatgactccctatgttaaccgatcccgcctcagatccgcgctcgtcaccaccggcacaacattcatatccggccgatatggcgatttaatatatgctactatcttccttccaaaatataaggaatataaggagttatattttgagatggagaaagtactagtgatgatgaggaagatacactagtgcttgaaggcttagttgttttgttctttttcccaactcacctatctcgtttttcacatgcacacttttcaaactaataaaggtatgtttttttttacaaaattttattaattcatttttttaaaaaaataactgtaaattaattaatcatgcgctaactggtagtatgtttcattttgctaaattaattaaaattcccaaccctgcaggagccaaacacagcctaagtaaataaagggattaaaattgaaagcgtatctaacagccacagctactagtggcttggtggattacgagtcacgtcagtaggcgatccccggcgtgtgcgatgcgaggttagcttaattagctggtctgtccatgtcgtgccgtcgcggcgtcgccttcttcgccttggcaacggcatgcatgcctccgatcatccgtaaacctcacggcggccaccataccacacgtgcgtacgtacgtccacaccacgcccaacaccgacgacgtcgatcgagctccaatccatccacccccacccatggccgcgcgcttctcttagctggagtaattaaattaagtcgatctccccagcgcgcccccatgcaccaatggccgctcccacgcgccgcctcctcctcctcaaccacgaacccaccaccacccccgcttcgtcttcttcgagttcgaggcaatccttccccacgctgctccccgtttttatcctcttcgtcctcctcctctgcttcctctccatcttcctcgtccgcgacctcctccacttcctctccctctgcctccgccgccgccgcctcctccttcgccacggggaggatcatgactcctcctccgtctccatgcagtcctcagcctcgccgattaatgcccaggcgccgcgcaagccgccgggcttggaccccgccatcctcgcgtccttccccacgctgcgcttcaaggcctccgccgccgcgccggagtgcgccgtgtgcctctccgacttcgccgccggcgacgccctccgcctgctcaccgtctgccgccacgccttccacacgccctgcattgactcctggctccgcgcccacaccacgtgccccgtctgccgctccgacctcgacgccgcgcccgcgccggcgcctcgccacgaggaccccgccgccgttgccgtcgacgtggaatgcgaccggaggggcggcgccggctgaccggtgaacgaccgccgccgtgctggatgacatgcaggatttcctttaattttgttcgcgccaaaattgattttgatttgttttgttttgtttgtggctgcctgcattaccgtgtaaatactcaacgacttgtatcgtccttgtgcattgtactgtcagtatttccaaattgttggaaatgataatgtagagtattccaggtagaattatgagctagtcaccacagcttcagctagctgtttaattcaattgcaagtctgcaatacctgtcaagaaaataaatcaactgtatcaatgtatcagttggaagcttttgcaatgttatttttagccacagaaatgggcggttgccggttggtaccaacaagggcattctaaagtaaggatgccactaattttagagtaatctctctcggtgcatgatttgatacatgagtctatgagaaaaatgctaaccagaaagaggaaacacaatatatatatatatatatatatatatatatatatatatatatatatatatacaggcatataacagttttgctactaattgtcgcacacgcataccacacagggcaatatacgggtctgctttacaggatttatggaagcaagtacataaaagcaccatagcacgcctcaggtgctttgattcaaagacacaacgacgctgcttatttaataaacaacagcgtgtgagaaactgcttgcgtatcagcaagggacggtaaattatttatagaacacctcctctattcatgttctttgcttttaaagatctgtagaagcccatgaacctcacagtgaactctgaaataattagagtgtttatagttagtagttggtaagatccgttcattctcataagaaaacatagaagactatttcagttcagaactatactgaattggcaggtgaattattttctagtaccttcaatctttataaagcattggatagtttcgcgttggtcatggccctccttggcaaaaccttctatatttatgtttctgatttccaaacccgtgtcgccggattcgcactgctctttttgacgcgcgcaatctttgatctgattacgccgagaagcaagaaaaagaacaaagaataacggttagtatacagcaattagatcatgaattgaaacaactgttactgaagatgcagtagtcatgctaacatggttcaactccgatgctagttgatcaatgctattttggaactcctcatccctgtcccttttcagttcagcaaccagattctgcatttggaaggagacaaacattggtgacaaatactgaaaacaacgaaccctgtttcagagcatggaaacattaggcaaagtggagcttacagagaaaatgaagtaaggtgacacattatgttcaatcagttttctgatcttacccctaatgacatacagcctgcacaagtcgaagtaacaacatttgtatgttttctttcttgagattaaagacgctcaaatatactgaattatggggaaaaaacacatgaaagggatatcctactgttttgggcttggttcctccaagatttttttggctacattggagatttcctcttcccatcctgtcaaaatggcatggccttctaggaaggcatagctgcagttgtgaggggttatttatcgccttgagaaacccaattatagtgcttcttaacaacagaatgaacacagtaccagcaatctactacggagtaacatattctcaatacgaatgatacatgcaccttgattgagcagttatatgcattttttgtcaaaagagaacataccaattgcaattgtttctttagaaaatgaaggaggaacatttttttttttgggaatacgcgaggggcgcatctttgtattaagaaggaataaaagtatttacagagcgggccgaaaaataaaaaacacgaaggggacaagatacaggagtggggaggaggaagaaaataaaagcctaatctcccaacgaatgtggcgaccttccacccgacataggagtcaccatggccggtatcgcggctctagccaaccgccaaaggtccgcttcgcccgtgaggaacatagtatgttataaagacatttctccagtaacgaaccatctactttaaccacagtcaaaacgttgtaacatcccgatattatatttcaagaagcaggaaaggagaggagaagcaatgtttgatgttcttttatctaaaaacaagggagggatattcttatgtgcttactttgctttccaagtagcttcaaaagaacgtattgcctgtcggagattattgcctgagctcattgttattctcctagcaatatcacgaggcagatctatgctctcttgcactgcaatgtactctaggaccttgattatctaagatcaaagacatttttcagtaaactgtccagcattgcaaatgcgaagataaaatatccatataaaaagtacctcatcagatgaaggtggcttaagtgtcacaaccttgcagagatgcctgacagcctcaaggtttgaagcatcagaacagcagaacatgattttattgcatcctacatacctccccagaaaccatccaatataatgttgaagatcagatgagagtttatcagcgtcgtggacgacgatcactgcatatatatgaattttaaagtattaccttggtgtaatggtttgagatcaataaagcttcatttattataaaaatatatatgtatatgatacactagtacatcaatgtaacacatataaataccagaaaataaatgaagaacatgcagttgtgtcaagaaagatcactgtttcatcattttaacaaggtaaaatagtgtcctcatgtacctctgcagttggcatgactgcaaatggagtttggtgatgggatggattcattcaacaaagtagtaatgacatgcttctcatagccgtgtatgtcagccaaatttacctccacatgatgacttgaaatcttcactctgatatcaatgtgttttgcaatttctccctacagtgcgagaatggtcagtagtgtttcattttacactttcctctgaaggagtagtagagatttgtaatggcgacaatgtgcaaaagaataacaagtcattctcatgcaacgcgtaccttcagctcgaatctctttgtctgttcctctatctgtgaaacggcaatatgaagcaagaacaattgtgagcttaaaggtttagataattaggttggttaaaccttgtgcaaaagtgagtagcatcaaccttgagattatcagtagcaaaagcatcccatatgagtgccgacaccatgctcctctttccgacggaggtcgggccttcaaatatgatatggttgcattcttgtgcggtaacctggggggtaaaccccttatcagaatgtcaagacggtagtagtatcactcaatgtagtgaaatatttgactgtaaatgggtagtaaggagtgtgtgtgatgaccatcacctggttgtagagctcaagggcagcgtccttgttgcagatgaaatcgttgaggaaattggggcgatacttgtctgcccagatgtacttgtcctctgccgtgggtgtggattcttcagaagtctgtggcgaatccaccatggcgaccgatttgggcaaaacccggacccagatgctccctcctctcccgacggcgacggcggaggcgctgtggtcggagctctgcgtgctgtggtcgccggcggacacttgtggctcagaagcagcttcagctttggattcagccggcgtgtggtggtcgtggatgcgtttggcggcggcggcggcggcggcggcggcttcctctctctccctcaaaggcctcctctcggcgacggcggcattggctacctgcggctggggcgcctcccggcgcggcggcggttggtggggcacggagctaggggcggtgcgggggcgggtgaggggggcgccgcttctggggatgcaagcgaagcccaagcggtggagaccgagcacgagctgcgacggcggcaggaaggtacggtagcgtcgggcgtcgcggcggcggtcatggtcgagcgcgtcggagagggtggtggccgggggagccatgtgggcggcgcgcagggtagtggcagtggcagcggcatgggactgggggtggacatgagatgagagcggagatgaaaccaatgcggcgcggcggtgtggacgaggggagcgagaggaaggaggtaggcgtggcgatcaacgcggcagcggccggccaggtggtgaggtggcggtggcggtggcggtggcggtggatggtgaccggagaagcattttttgccgggatcattcccatcctgcctcctctcctggcgccggcaacgcctaccatcgccatctgatctcggcccaagctctccatttccatcctattggcccacttcgttatttgggccgcctctggttgcatattcagagaggatttaggccggccttctttcgctgttacttccactagttatttaattattttttagagaagttattttattttattttatttagaggagtttcttaattttatttttttagaagagccttttaaataaggaacttccctgtaaccttcgcattacttccactattattctactgagttgcttgatagaccgtttggtaaggaataagtttatgtctctcgctcttgattgagtcacatccctcaatcataaaactaggtataatgtcgcctctaatattaaaaaaccagtgtagataaactatttcagaggtttagaaagtgttttttcgctgacgtggcaggttgaccacaattgacttgctgagtcaaaaggagggacccacatgtcattgattgttctctctttgagagggctaatgtcgcaaaggggatccatgactaacgagtagtgacgtgaccggggaggagttccgcgatgggcggcgacgaagatgggtgttgtgactggcagcgaagactgcagcagctcgcgtgaactaggggatgacaacccatagcggaggacgataggcgataaaacagcgagacccgaaggtagaagggcggcagtgcaacaatgacggggtagcacacacatctctcgctccgacgtgaccctctgccgccgccaccagtctctacgaatgccatcctatcaggtagctctattaccctctttctttttcctatggagatggcggtgtcccaccctgtcccagcttgatggcctacctccccctgtggggcctccgatgccgccatcgatgctggaaggaagccacgtggaaggaagtggcatggaggtggagttccaggctcaaggtgagaggacaacagccaccgctaccatgagcaccactatgcgcgtgctccttgaacggacgatgacagtaactcaatctgcccccgacgatgttggccacctcggtgtcgccaagctcctaccaccgcatggggtctctacatgctccacctagcttctctgcttccatcaccctcggggagacgaccccctccccatcggccgcctccacccgtgagctcccctttccactaaaggaatcaatgccgatttttaaagttgtttggagagggtattatacatgtttttttgttgaggaaggctattcaggaagtagcaatatacgagaaagacaaacaagaggttgtgttcgggcacgcatgtattattgcaagattaattaagtattaactatttttttgaaaaatggtttaatatgattttttaaaacaacattcatatagaatattttttaaaaaaaacacaccgtttagcagtttaaaaaacgtgcgcatgaaaaacgagagatgtgagttgagaaaactgggataagaactcagcctaaaccgtttggcaatgaccggaaaatttgaagttgggcgatgattttacaggccgattaaccgagggcagtagttccctcagcagtgtccggccttggacttgtgccgcacgcacacttccatttccatttggaaaaagtacaccgaaggtccctcaacttgtaatcgggataaaaaacatcctcgaagtgcaaaaccagatatacgaggtctcttaactatacaaaaccttaactatacaaaaccagtcactcgaagttcttcgatggttttgaccccggttttagtctacgtggcggctgagtcagcgtagaacctacgggccctacatgtcaggtgtccacctcaccctatctctttccccttttctctttctctgttcatctctctctctagcggatgggagcggcggtagcggcagacttggcgagcgcgcggcggtcggcgggagagcgcgcggcggccagtacgcggtggtggaagccccctagcgttgcggaggcgggctgcaccgacacggcggcgggagcacgaggcgacgcggcggcaggcggttgtggacgagcgacgattgcgcggtggcctcctgcgcccacgcgccaccgacgttgggtgacccgtcgtggaggcgacaggcgcatgtgaaccagcaacgattgttgggaggcttctagagctctcgtcgcgccgctgattctcggtcatctttcaaagagtggcgtcctccaccgcacccggtagcaagctatcgcgcatcaggtaggaggtatacagttagggtttccccctgattttcctcgtgctccaccgccgccgcgtcgcctcgtgctcccgccgcctcagctgggagggagagagctagggtcggcggccgcgtcaccttgtgctcccgtcgccgccgccgcgtcgcctcgccttgtgctcctgccgccgccgtgtcgccggccgcggccgcgtcgcctcgtgctcccgacgccgccgctgccgccgccgcatcgcctcgcctcgtgctcctgccgccgtcgtgtcgccggccgcggctgcgtcgcctcgtgctcccgccgccgcgccctggcgacctcctccccacgaccccacctgccctggctttgcccgcgactagagaagtgagagagagaaaagggagagaagagggaaaagagagagtggctgacctggacaggctgacaggtggagcccacgcaggtcccacgcggactcagaagctacgtagtacaaaaccggagtcgaaaccatctaaggacctcgggtcaccggttttataccgttaagggacctcgcgtatctggttttgtggttcgaggacattttttatcccgataacaagtcgagggaccttcggtgtcctttttcctttccattttggaaatctgatatcgatgagagttggacgacctcagcagcaaccaattatctgctacagcatgcaggacctttgacttggactgcctccctactcctactcctactcctactcctactcctagtcaagtcaagggtaagctccaagaaatcttctacttctacttctactcctactgatgaatgtattggccggtatatacatgcttcctcatgtatcacactggtggagaaaccctttgtactcccggttcgtaaccccctttagtcccggctatctttagtccctggtgaaataaccgggactaaagagaggtatctttagtcccggttggtgaaccgggattaaagatcgatctttagtcccggttggtaactgttaccaaccgaaactaaagagagggtagcggcagtcccattaggtctccttttctttttttttattattttttagccagagtttaatccctatattttctcccaaatcgagtgggatgcatattcccaaatcaaaccccaaatcaaagtaacatcccaaaacattcacatcacaaatcttaagttacttgtacacacaaatcaaatacatcacaaatctttaaaaaattacacacaaaccaaatacatcacatattatacatctcagatccatacaacaaatcacaaaattatacatctcagtgaatcacaaattgtaaaaaaaaagaaaaaaaaagaatggatgccggaagcgccgcctgccgccgctccccgtgcgcggcctgcgtgcggccccgccggccgcctaccgcgtgtggccccgccgggcgcggccccgcctgacgcgtgcgagaagggaggagggggaggaggcggccctcgctgggcatcggatgcgaagggaggagggggaggagagggccgggatgggaggcggaaggggaggagaaggagatggatctgaggagaggagaggccggttgttgttgaggagattgaggccgattgtggggaggaggatagggaatatggattatatactacgcgtgattttagttccggtttgtaataccaaccgggagtaaagatctaggatatctttagtcccgtttagtaataccaaccggaactaaagtggtgatctttagtcccggtttgtgacaccaattgggactaaagagaattgacagaggatgaaccggtactaaagatcatctttagtctggttggtgttaccaaccaggactaaagatcgtagaatggctatggggttttaaaccaggactaaaccgggactattatggttttggggcgactgagtaaagatcagttttcgagtagtgtcaggtaagggccggagaatgcatcatgattgatgatgatcgatcggctggcagcgcttatatagtactataagtatactatctcgcaatcaaggatgataccatatctccggctaattaatcaatgaatgagggaaagccatggtatatctatatcataccgaccaaatgatcatatgtgcctgcctgtcctgatttaattatatatgacaacattatcaagctcatgcattcggtcggtagataggttggcatgtactaactactgtagtctgtacaaattttcgcactcgaccgtgcgcttgcttagagtagcaattagcaggaacattacagtacttattaagctcgcttggtgctcctcctcctcctcttccttctagaaacttcttccacgcacacgatatcacgtcaacatcgcacccgcccgctcacgcaccgcatgacgtcaccgacggctttggtggcccacgagcgcgtggggaatacgctgcccacccttccccctccgatcccaatccaacggacatcttctttcgcgggaggattaatgttcatttattgatggattttttttctttctttaaaacaattaattatttattgatgatttgtaaaacgggtcaagaaaagaaggcggcggcggcggcggaggagagagagggccccaccaatacccagtagccgccgagccaggcaacggaggccaatgggagcttaacacgtggcccatctgcgggccacagcaatgacttgatcgactgttatttgctcttgacattccactacactaccagcttcttcttcttgtgccttttggaccttctcttcaaacagcagagcacactagctgaccaaccctacaatatactcgtactaataatagagggtttttctctcctaatttcatcacaactcgtttgctccaggctgagataatcctcatctcaaggaaaatccctttctacaaatacagatacaagtcactgaaacagtgttatagtatggctttatagatgttgagaccaggttttattccatcgtttttttttagaaaaaaagaagactattagatggcttagttctctgaaacatactgtactccagtactgaagaacattgagccccaggacaagcaatagccttccaaatgaatttccatttggaacaatccatgtactgtagcagtctagcagatactacaagaagaggttttggttgcccatcccagaatgctgccaatgcaaagccttcagaaatttccatctctattctccaatccacatatgtgatatgtcttatactttccatccatccatgtatgtatgtcgacatccaccactctccattggaaaggcaaggccctcagctacctccaattgttgctcatcttttccatcacccccctcaactttctcaatgttttcttcagtattccctcaggaaagagagattcttcatgcaaagctatgaacattatttctgattatatgtaatctgtagacagcagagagactactctactgctcctaaagaatgctgcattttctttagatgcctttctaatgctgcatatattttttttgggtagtagatgccttcctttgttcttgcatttagaaccgcttcctctgctttagttaggcgtagtaggttagggtggttgcctaacatacatatgccgtctcctcttcttcatcttctcattcttcttcagtgtcaacttcatcaatgctggcattgaccctgcaaatcagaactatggagtatatatatatcacaactctttagtttaataaattcaaccgggaggataattagatgaaacaagagagcaggagcaggatttgctttgataaggctgaacatcacattcacattcacattgaaagcaaacttttagcgagtttggcaataacgtaacggcacttgctttggcagcatcagaaattctgagtcaagacacatgatactgcaaaaaactatcctctgcaattgcctcgcagctaagggtcaacacactgagaaaaaaacacacatcaaaatccatttctgatccacaagaccacattataattaagaaaaaaaggaagttactggagtaataagcaaggatcattcatgccctcttctagcatccatatttacagatgaactgaacaaagtagcactaatcctggtaccaccagttagtagcagccatcacaaaacttaagcaccaccagctacttattatcatcactgctaatccactaggagtattagctacaagtctgctcaaagacatctaaaatttgaaacatctcaaaatgaaaaaaaaaagactatatagaaggttgaacacaagagagagagggagggggtggtcactaattaaagatgtatacatatcctgtctgtatttttaatgtgttcctagtaatggtaatggagcaattagcaatggaaaagctagtgcttttgtacccttccttttcttcatcttcctcctttcctttgtgcaaagctaatggcatccacctcgagaagcaccaccaaaaggcaacaatggtaatggcaatgggcaaaggccgacgaggtggcggccgctttgcaatgcgattcccaattgcgcacgcgctggattcctgcaggtgaagttgctgttggttggcaatggctagtactcgacgatgaggctgccgaatggcgcgcggtgtggaatgcccttgcggcgcttgggcggcagggtgggcggcggcggcggggtggacggcgtgaagctcctcttggcaggggaggtggagttgtcggagtcggaggtggaggccatggcgtgggcgtggcgtagtctcttcctcctggcggcggtggcggtggcggtggcggcggcggtggcnncntggggggagccgccgncgaccttgcagccgagggagcagaagcggaagttgtcaaggaggctgcggctgcagacctcgcagatgttggcgacggcgcccttgccggccttgtgctgggggcgctcgttgaggaacaccacgcgggcgctgttgatgacgtatgtctgcaccccgccgatgtccatgaacctctggatgtccgacaccctgatcacgtcgtggtacgacgaccgccggatctgcaaccacaacgccgccaccgccatggttaggtaggtttggtttgggagagggagactgcaatgcattgggaacaaggaaatggttagtacctggatggtgtggtggtcgcggtggttgtgggcgaggcagagggagcagagcgcggcggcggcggcgtcggcgtcggcggcgcagtcgaggcagaacatgttgcactcgccgctccggtgcgagtcggcgtgcaccttgcactgcgagaagaagctggccgagagcagcgggctcagccaccgcggccactgctctccgtgcgccaccgcctcctcctcctccggctcaggccctcctcctccctgcaagtttcaataaaccaacgcatccgtcagtttcctttcctaaactacaactcgatattagattggatgaaaagaggcagttttgaccaagataatcccctctcctttgaacgattcatgcacgcaattcacagcgcgtttcttgattcttggaaatcacggagaagcgatttttttttaaaaaaaaacccacggatttggcggcgaaaggaatgcggggattccaacgcacagagggaagcagcaaaagcaagaacccaagaagaagaagaatcctttaatcaatctggcgccattgcccatagaaatcggccgcccaatacaacagtaaccgaaacaacaacgaaggggaataaactccagaagcatctcattccttcattcattcatgtagtactacacaagaaacaaggagtaatcgaaaaagaagaagagaacggaatggcgcagcatataaacataccatgatcctcctgttcttgaggcggagctccttgaacggcgactcgtggtcgatggccatcgatcgatcaatcaatcaatcagtcctctcctctccgaatgcaactaggcaaagggtaggaagaagaagaagagagagcggaggcggcggtggatggatggaatggcagaagaagaagcaaaaggaatgaataaaaacagaagaggaggaggaggggtgggtggactcgcggcttttatcgacgagacgagaaggcgaaggcggcttgggctcggtggaaacaagaagaagaagcggatgagtcgtcgtcgtctttgtaggagtcgtccaactccttccttctttcctatccccctcgacacgcccaagtaatttcttttttctttcctttcctttttttgcctttttttttcatcctccttaaataaaccacttgtcagtgacagtaataatatttactagtaaatttatgcgatttgtggctctttcctctatctgagtaatcaatgggcatgggttgttgttgattagcactaatagggttgtttggtagggcacaaaattttaaattttactttaaaagttagatatgaaataaagttgtgaagctatctaaatccagttttaccttatttgtttattttataagagcacttcaatcagtttaattttttttttttgaagctgaagccctttttttatgaagctgaaactatttggttgtgtttcagctctaaaagagatgaagctagagttgaaccaatgccctttctattaggttattactgcttaatttaatttatttttgatgtgaccttaatctcttgtgatggtttgttttggagaacacaaggggaaagtggatgccgaaatggccaaaagcgggatggagggagggcatttgcgcgtgcgtgccgaccagacgagacaccggacgcgctacagtacactacttgtccacgcacgtgttgctctctcgctattccagattgaacaccctattgggtactactagattattagggtggattatcgatttaattattaaaacagattagatattttaactaaataaacactgctcaaaatgagtggtctaaataaaactacaacaggaatattacttaacatatattttttttactaaatcttaacatatttttaacatattttttaagtgtgaaacaaacaatccattttaataattcagtgaataagctgaaaagaacaatgccctggaatcagtttcaataacccagtaaatccgtttcatgaggaacttcagatgaaacttctccttaaaaaaacttaaatgaaaccgccttttctttgtgcagttgtattgctccttgttgctacttggcctcgtctgactgacccgtcatcccgcccaatttttctttgtaaacaaatccatccagcaaaatgatcaatggcttacaagtggcacactaatcaatcaaccatgatgcacctgttctcttcatttccaaccgttgttaatttatctgcttaatcaattatgccacttaatggagtacagcagttcgtcgctttgtttgttactgatgcttggtttgcattgcaattgcggacaggcgcaccagcaccacaaatacaaaaagaattccccagagtatccaaatatccaatccactgctactatttttcctctctttgcctaattgccttgttcgattctttcaacatactatgatcttatattattcttatctgtgaggagccagcagatagatagatagatagatagatggactagtcgttgtactggtgccaattccagtcctaccaccaataatgctgccggtctacaaatgcaaatgcattctacaaactactccaaatgcaaacattatgccattcttttcacacctttttgttcttgttcccctttgaaaaactgcaaagtttttgtttgcactctcctctgtcagtctgtatccaactcaagttcttcttgcactctttgcttgccatggaagaaaacaaagttcaagacagcaaaataatgagagaattttgaaaggtcagtgaaaggaggatttgaatttcgaaaagattctgtggctacccactcaatcaaaggggcatgctttgccggtgcacggggaccgtcggattctccatctgcggccgtgctttcagatgctgctctttcttcacatgccattgattcctcctctctagtatctctcactctctgtctctgtctcctgcttcttcaagtgttgatgattagttaaagcaagcaagcaggcaggcagtggagcccttgaccttaaagagatactcatcatcagatgttaatctaatagtactagtataatctaatctttataatacttatatctagtttagtactactacatgaatgcaatgcagatgcaggagggaacccaggaatgcaggggaggcacatgtgcttgatggattggatggctgctatctgcaacttgcaagaacttcctctcactaatctctctctctttctttcttagtagtacagtacttgtcatctgcaatgcaagccatctaatctactcctaactgcccacttagcctgcactgcatccctgtctgctgctgcttgcaatgctaggttagttggttagtagtttgtgtgtcttgcaaatgtctatgcatgctgcaacttgcacacaccaatgacacatgcattttgatttcaccacaagggaaggggagatcgagagaatgataatgcagcaatttacgtcagagaaaagtgactcctccctccaggtcggcgatgaacttgctgcatctcatggaagctgaaaaggacatgaaatgggcagatgcatgcgtgcactcacaaagctcaaacctttttttatatataacagagggaaaaagcaaagggcaaagacatgtataatttgtagagtagtatgcaatatggcaatggtgctggactgctggtgtcgctgccacttgcaacgagtagctgaaaggaagatacgccattgccatttcccattagccatcgccaacattggatgtgaactagcccccaatttgccacgagtaaaatggtgcctttcttatctctagttggtatcttgtgtggacctgaacctgtttcgcactcgccgttgtccttgtcatgtactactagtcttcagcctgcattctgaagccagataaactgaactagctctcaatgttcagacatatttcagctatttcaccggattatttgcaccacgcctcttaaaatacgtttttctcaaaaaaaaaaaactttcttctacagcattatttgttctaagctagtatttgttaagtttatttctcaaaatgtataatttagagaacttttatcccataatcaagtagataatccggtgaataatgtgtttcaaatgggcccttagattttaaaacaactgaaattctagctcattcagaacagaggataaaaaggttgtatcactcactgctccttcacatgctaggaaatgggtgaactagtctcctcaggtgtaattgcatttcgttttctgaagactagactactgggtccaagtccaaaccggcgaaacatataatacttttcacgtgtgtggtttcacctcagacaaatccaatccaatccacagaaaatggtggattccttgtctccgttccccacaatgggatgatcacaagttggagcacttctttctttttttccaagtttcacaaaaaagaaagcctttggatttttgaagttaatttaatcggttctaaccgacttctaacattgtgatgatggtagccactggaggctctctctgaaagcaacagggaacaaaagctgtgcaagagaaatatcgacacaggctgaaaaggacaacccccaacactgtcatggatgttgccgtgtgacaatgggcaatcaaattgattaattaagaacatttccttccctaaatcagttagttagtgttccatggctttggtttggatgatgaattagtcgtcatcaactcatcatcgaagcaggaatcaaaacaggagagaagaagatgaaagtttcggctttgttgttgacacagacaattcaactgaatgctcacggaaaattcatgctgggagtacaatgatgaatcatcgccacaagagttttgtcaattctgaattaactggagatgcagatgttagttgtatcaatgatagatagattgctaggacggcacattacagaaagaaaagtactcctagtagaaaagaaaacaacggccaattccatgccaatccaatgcttgatatattgatgaatgcaaactgctttgctgattctcatttcctgcaatgccagcccaagtagcagtacattattacagttagatatctgttcacatattgattgaatggtgatccattcacatcaaaactctcccagctgcattgccgtacgatgctgggaaccatgattaagttgtgcgtgttagcctcctccttgcaattagctaagtattaattaactaggcaagtagtttcctgtggtgtctgaataattcctgtgcctttcaaattcaggcagcaaggcagagagagggacaagaatatatttgtgtgtgttgatggatggagattggagaggaggaggaggataaggaggaagaagggtatatgaaaaagcagggaatcattggtggccgtccgttggttgggctgtccaaatgtgctgacagccacgccgatagatggaatggatgccatcctcctccctctttacctaatcaaatttaagcatctgtttcaaaggaaccattaaattttaagcaagtggaggtagctctcggattggccaatggcagccaaagtaacgaaacaatcaggcaggaaatgcctgatgccgttctgttgctgggggaatcagaattcagttaaatttcaagctagtagctcacctctttaatttcaaagtgaaattttcactctgaactagaagtagtatcctttttgcaagcaatgcatcagtgcaccgatgagtgtttactgtgtctgtgcgtgtgttggacgttgatgcgacaaggattaaccgcacacactgtcactgattccgagtaatcatgttaggacaaaatatccacacgctgccgacgaccgagggctggtcaaatggaagacttttgattcttctcttttcccagaagatggagctaaacttctgctagtgttcaaagcctggagagatacacacattcagatcagatgcctcttttttctctactttgctcaggtcgtcgttgccggtcgtcgaaagcaacctagtacaaactacagatagtaggagtactattcacaagtttggggctttttttagaagtacgaagtagtttgtgcatttgtagcatgatgatgatgatgatgctggctcatcgctatgattacatgcacattcatagaccatcctgtctgtattctgcaccgaacgatagaagctacgcggatcaccaccaagaaaggcaacaatcaggccaaacttcgttcagaaaataacaagccatcttgtgacaaattaccttccatatggctaaaatatgtactgggtattatatggtatgaaacggtcattacaacgcaacgacacttttaggtagcatctaagatcccactaagacggttttaacaattttatgaaaaaacattcttgttacaggtgcatatgcttacatgactttagccagtacagcattcacgacataacattttctctatagctccaggtctttaagttttaagttataggaactcctgaacatatctgccaagcaggcatgccgtcaacttattgtcacggcgaatcctgtaacggctgaagaaatgtcacggagtctcgactgtagattgaactcacaggatccggtcttgaagatcagacatgatgttcgatgccaaagatgtcaacttcttcccagtttccccagccatgttcttgatagaagacagatcctgggaagcctacagagataacaagacatcaatcataggtctatcaataaacccagctgtactatgctactcttaatttacctggaaagaaagccggttgatcaaatctgaagcactcagatccacgttggaacta

SEQ ID NO: 68807 - DNA, 9795 bp, Oryza sativa
attttctcatcattagcatgccttaagtgtttttgaattattccctcagatacttctcaagaaagcagacccagatgcttcatcgctcgatgtagagaatctaattgccaacaaaaaggccaagttggatgatattttgagggagtttatggatgctaacagacaggaacagacttctgaatcaccagaggaaacaagcaagccaatggtagacaaaaattctccaagcatgtcaagacctgttcagaccaatgcaaagcaagatgagcctgctttgactctgctgcgaccagcaggaagcaaattgaagcaagatgatcctcctttgactttgcagcgaccagcagggagcaaacccaagcaagatggtccttctttggctccattacgaccggtagggagcaagccaaaggaaaataacacttctttaaccttggtgcggccaatgggaagcagaccaattgtccggggtaaaccggtgcaagatagttggcctagcaaggggagcttagctgccagaagagagtcgagcgatgttggcagcacctcaagaaagaacaatgtggatgtttccttgcggaaacccaccatacatcagagtgatgatgatgaattgaagtcgaagctgaatctgaaaccaaatattgacttgaaaatgaggaaagatatggacgaggatttggccaacatctctcttcttcaaaagccagagctttcagtagataatatgaattcaaatcaagagaagtctgatgctggacctgcctctgttgcttctggagaggataatggtgcagttgacccagaaacaaatggtaaggtacaacatcccaaatgcaacaggccatgatgagctggttcttttggatctgatggattgcaaatttttcaatcttcaggtcttgatgaaagagtagtgattgacagtattaatgatcgtgagtcatctgtgcttcctgatgatcttagtgcaggtaaggaaggcataatagatcagtgactagtctctattcatccatcatactaatgttatgttaaaattttcaagaattacagccatctgagcaaaattttaaccgagaaggcgacccttctgtggtggatgatcaatcagccgtcagcagtaatttctctatgcaagctttcttgcaaggaaaacctaagatgtactttctgatgaaactatgcacttctatttttagcataacattttcatcgcttgtaaaatatatatttgacatttctgcttaactaattgtacttcatgttgttacattgatccaaattgggtgtatcccttcttcttttgagtaactcacgtcattacagtttctcgcatgttggccgagctaccactaatatggcaattactacattgtaggaaagacttagctgttgaaacatttccatctcaagttgatgctgagaagatgaatgccagtgagaataacatgaattatgttgatgatggaggcaatgtgttatcatcgaaattagaggtaatgtgaatttcataatgtttgagcttcagcatcttataggcttattatcaaactcaacaactgtagttcttagagtgggtgttgccttctgtggaatgagatgtttccctattcaagggtcattgagtcatatttcatccttttaattcttctagatattgattataactcttgtttatggaatcactaatgcaggacatcacagagagtgactggacaaggctggagaattatgcaagtaccggagaaaaagttgaggtggagctgataaactgcagctcgaaaggatttgttgtaagtttttgtccagttttagaattagcacctttttaatcaagttataatgaactgatggtacctgacctctatcatcatttctttgccaggtatcactcgattcattgataggtttcttaccgtatcgcaatcttgctacaaaatggaaattcttagcttttgagacttggttaagacaaaagggtggcgatccttcactcttcaagcagagtgtgggcatagaagaaagttttgaggtcaatgacaggaacatagaatcagtatctagctcagattcagaacttgctgtgcaggatcaaggttctatgccatctaaggaaaaatttgaagatcttcttcgaacatataacactgagaaatctaaattcttatcatcatttatcggtcaagtatgaatcttttgttagtctccaaacattcttcagttgaacccttttagctaacatgccattgcttgttttgcagagactccgtgtttcagttgtcctggctgacagaaaatccaagaaaatatttttctctatgaagccaaaagaaagtgaagaattgattcagaaaaagaaaagtctcatggtacttactatgttgaaatgtctattagcttagttcttttgctatgcttagcatggtccaacattttcccttttattacttatttatttgttcggctgcacacactgtttttcttaacatgcaggctaagctcaatgtgggagatattgttgaatgcactatcaagcgatttgtttactttgggatatttgttgaggtaggtctaaccatattttctacgctttttcattcagtatcagcagctaactgtttctttcaaaggttgaaggagttcccgcattaattcagcagtgggaagtgtcttgggatgaaaccttggacccatcagtttcttacaaaattggtcaggtaacacttgttttttgcatggaccttatttttgttgcaatctggctttgttaacagtgtgtgtgcacccatgtgtggataaaggaggagttgcaagttctcatgttcattttgaaactgacatacctctctatatcgtctagaaacttagatacatcacgtgacaatgatcataatgccaaactttctgggatttacagaaatttattttgatttccaggttgtggatgctaaagttattcaactggactataataataaccgcatatttttgtcacttaaagatgtaaaggtacctgggggcctttccccttttccctcatggtggttcagcttattgaattgctgatttcaggctttcatttattatttttgtcatttcccccttctatgcagccaaatccttcagtaggcgcattggaagctgtcattggtgaggaactatcactgggtggagctcttgaacctgcagaagcagattttgaggtttgtgtgacttatggcattatttatcatcatcttgaaatttttcattgtttgtgatttgaaggttatgcatatttagagggcctgaaatctaaatctaatgccctctctctattcaactgggaaaaaccacgtcatcagattgttttctaacttctggctaaatgatgaaaacatgtatagctgctacatggcagttgcatcccattttctgagttatgtataatatcttagcctgtgccaaagagatcgaaactttttgtaggtttgctggtagggcctcctgcatggtctgtgattgaatatgggcatacctgagttttttcccttctattgcaagcatgttttgtcatacagaagttgatagagctctgtatttgaatgcggggagtctgtgctacccaagcctggatccttcctatcttcttagtttgtttaattagttattgttcttcattcaaacttcttttctggatattttgtggacatttctgagagctgtagacatagcagtgaacttgggtcatgcaatgtttgtttcatacgtctgccttgtggcattgattttctttcttttccttatccatccactttgttgcatccttgttttaacactccattatttgatcataattattttagtggcctgaagtggatgctctcatggaagagatgaaaaatattgaggaagttagggatgtttataaaggacgattcttgcgaagcccaggactagctccaacctttcaggtaaaatctaaaatgtagatacgtttcatgttcagcattcacacaattctgcaccttagttgttggaattgacacctgaccttatttcctttttaaatctattgcttgctaggtgtatatggcacctttggttggtcagaaatataaactccttgcacgctatggaaataatgtccaagaggtatggacaattaatgttaaatgcttgatcgagtcacaagctgaaaattgtgtgttgtcattcttacatagcatggactgaactcttgtgcaggtgatggtggagacatcattagacaaagaacagttgaaagaggcagttttagcgtgcacaaacagggtgagctgatgatcagcgtctccgtgctgtagtatttttccttcttttagcttgcgaagcagatggttgtacagaattgttgtggcagtccaattttgcatccttgtagcatgcttttgagtcgtttacacctgattttcttccttttcaagttgaaaataccaggtgatatgtagtcctagctcaactttgtagaggatgacaggtgtaaatcgccttgatacgttactacggaattgcaacagaattcgatttgcatctttcacggtgctagaattaatctaccatatttttgtttgaacaacgtagtaaatgataggtgatagcaccggtaacatggtttattggttaatctgaaatttggaatgaagataaaaaaaattaatgattcatccaactagatattaattatcattaccataaacaggtttgtttttatttcgttttcatatcgacacgaacaactcagcgccaatgaatatactcgctgtgtgggtcacagttgtttcattgccgctccaaaaggttatgtaaggctgggatcatgatataactcagcttaaaaattgattttaagaaattagaaagaactcaaagtcagacggcatattaccattctcaatatcacagcaatcacattccctaattaaagtcattgtaagtatagcggagaaacaaaatgttgaggtagagtttctgtatgaagttggcggtgtcaaacatgataattaaaccactgatgtcgtagatatggttcgtatatagacctatggtttgggaaaaaaaaaagagaccattgaagtgataatttaaatacttaatagtaatagactctttgatggagtattacaacatgcagcagtggcattaatacgccagtacattaattaagttacacatatgcaggctccattttggtttcttttaatttatcgtattacagaatttctgtagccttgctgatgatcacttggatatcatgtactagtaattaacaataggatgcatacaaaagatggcccaacgacaacagaagatgcgtgcatctgacattgtctggccttatttggttggtagtactccaattaattaacaagagatgatgcattcttgtgccttagtttcttcacatgcttggcttcacgttgagcctattcgcaatcttcacccccaacgactcatcacactgcatgaagtaaatgagttaattacatagttagtgcaaattaatagctttttttgccggaattagtgcaaattaatagcgattaagtcatattaatttcaaattctctacagtggtttaaaattatatatttcatataaaataggattaaataatttatctatggattcataaaactgttgtgctaaacatggtgttaatcatgtggattaactaagagaaaacaattaatcattactaataactactccctccgttttttttatatgacgttgattagttcaaactttaactagtagtgtcataaaaacaaaaatggaggtaatactaaattgctggtatgaattacctgggagaggtagttgacccagatggcgcggagctcaggggagaccttggggtgcgcgagctcgccggcgaagcggcggatgaacctctcctgtctatccggcgcccacgacctgtacctctccccgggctgcttgaagtcgttctgcttgtgtatcgtcgccttctgcctcctccccaccacggggcgcggcgtgatgggcgtcggcggcgcgtggcggagcggcgcgtggcgcgatgggtagtagtccacctcctcgtcccggtgcatgaagttcatggcgccgtcgtagtggttgttgtggtgggcgcacttgggcgcgttcaccggcagcatcaggtagtttggccccagcctgtagcgctgcgtgtcggcgtacgcgaacaccctgcactgcagcatcttgtcgtcggagtagtagatccccggcaccaccagccccggcccgaacgccagctgctcgttctcgttgaagaagttgtcgacgttgcggttgagaacgaggcgccccacgggccggagcggcacctcgtcctccggccatgtcttggtgtcatccagcgggtcgaagtcgaacctctcctcctcctccgggtcgatcacctaacagtattaaataattaattagaaggagtactgcggcttcgaactcagatcgtataggcgttaatttctggatgatcacctacctggacgaacagcttccactcggggaagttgccggcggcgatggagtcgtagaggtcctgggtggcgtggctgtggttcttgccgccgacgagcgtggcctcgtcgtccatcaagcagctgacgccgcaggtgggcttccagtggaacttgacgtacctggccttggcgtcgcgggtgacgaaggtgtaggtgttgacgccgaagccgtccatgtggcggtaatcggtggggatgccgacgtcgtcgaagaggaagaagaaggtgtggaggctctcggggtggtgggacaagaagtcgaagaccctccagtactcctggacatgggagcgcgggttgggcttgaaggcgtggatgacgtcggggaacttgatgccgtcgcggatgaagaagacggggaagttgttgccgaggaggtcccagttgccctcgcgggtgtagaacttgacggcgaacccgcgcgggtcgcggatcgtctccgggctgccgcgctcgtggatgacggtggagaagcggacgatgacgggggtctgggcgcccggggaccggaggaagtcggcgcaggtgatgtcggtgacgtcgtgggtgcactcgaagaagcccttggcggaggcgccgcgggcgtggaccacgcgctccgggatgcgctcccgggcgaagtgcgccaccttctcgatcaggtggtagtcctcgaggaggatcggccccctgggccccactgtcagcgcctcgttgtcgttccacaccggagctcccgcgttcgtcgtcgtcgtcttcgtgtcgaacgagctcgacggccggaactgcatgggtagcacgtattactattaattaattaattaattatatacttaatgatcgactagctgaatcaaccagccatgcatgtttgaagagcttgagactaaaaaagaaatattcgtagaatctagtcgataatctaggttatttcaggaagtttctgataatcgaccaaatattctataagaagttaagctctctcttgaatctacacaactagctaaatgaaacctcaattattaactacaagattaagtagatttagtctcactagtcactgagtgactgaccttgcaaggatccatggtagtgggctagtggcagcagcaggtatctgggagtgagaggggtttgtttctgctagctctccagcttgctcggtgagacagcctgcctaaaggttatatagcgggaggtggtgaggagcactgacctccccggtgagcttaccggagaccggtgccacacactgactggtgggcccgggtggccatactgcatggttgggtcccacaggaactggacgaggataaggtgaggtggatgtgggcccccctcgtgtggaaaggaaatacatgcattgcctggattggatgcatggagtgtcatcacttcatcagtgctcactagctgcgtgccatcactgcatgtccatcgtcagatcagatcagatcatcggatcatatctcttcgattgatttcaacggcgccgaattgctgccatcgatagcttagctcatcccctttctcttgatcggtcggccaaagtttgacatgcttgcagttgcagctaacgtctctgcattttctttcttgtttctcagattaatttcaggctgcttaattattctgtaagaacgaggtgctctttgtgctagctagctatggctcagctacaccctcgtttatcataaacatacacgtttctcaaactgtaagctataaacagtgtgtttcgtacaaaatctttttatactatataaaagaatttaatggtgatggtgaatctaccatcatttagagttggtgagatcttctaatgctacataaatacatctttgtgtgtggtttggttttctattggatgtttgattgcaattatgtttgacaaatacaatttctaaatcaagaaattcacataaatcttttaaaatccgtccgttgcagagcacgttactttgctagtctttaaaattttaaataaatttagttttcaagtttataataggtaatactgagtttatcatgtactattcacctgttccggttttcatgccactaactagctcagtcaaactcctttatcgaacacagcccagccagaatgcacccttgtctttttacctagtgctataagaggaaccaattcaagatgatgatgattgatttaccttgtagcattactacgcagttcaaattactaacctttcagattaggtacggtctgaatatgtgatggaagatcgaagcagctgtatctcataaaataaattacagattccgtctggaaactgcaagacgaatttattaagcctaattaatctattattagcaaatatttattgtagcaccaaattgtcaaatcatggcgcaattaggcttaaaagatttgtctcgtaatttcaaggcgaaatgtttaattgttttttttctacatttagtactctatgcatgtgtccaaacatcctatgtaacagcgtgaaaaattttgtttgggaactaaacagaccctgattgtgatgcaacccataagtaattgcaaaactagctagctatctacagcatcatcagcatatatcttggtggtctaaacttctcaggaaacaaaagatgagaaattgttctgttcttagtccacgctgatgataacgataggtgtgctgtggtgggcacaagcttttttctttctttttttttttgaggggaaagttgcttaagatgaagtgacataaacaagattaattcgaggaaaatgtgcgcatctcagatgtgtactccatttatacaaaacccagcaaattaagaaggtacaattatctgacagactagcgaacaaactgaaaattatagtcgtagtactacaaatttgcagtttgtggctgaggggaatctatcccatctggtatatgctgtcactttgtgctagtactgtactatgtactagcctgtagcctctacttttgtaattgaatgagaatatttgaatgttttacaccacataatggaacagctcaaatctcataagatcttggagagatattcttgattactctgattaatgggtcatgtgttgatgcatatatatatatatatatatatatgttaatgaatcaaaacgcatgcatatgtctagattgaatgtgggcaatgctaaaaagtattatattgtgaaacggaggaagtagtagtcaaatggtgctaagatctgggttttcatgaaacaacactagacaccaataatgcaatcggtgggtat

SEQ ID NO: 68808 - DNA, 3378 bp, Oryza sativa
catcctttattcaagcacacaccatatatttaatatacgccatgcatcatggcgatcgaagctagcctagcagctgggaaaggcgatgccgcaggcggcgatggtattgcgggcgttggtgctattgatgtaggacgcgtacatcgggtctctcgcgtactggcagaagcacccgtccttctcctgcgcgcgcaggttggagcagcacgacttcgacggcgcagtcccaaagaagatcgggaccgcgcacgccgacagcttcccgggatcgcactgcaccggcggtggcgcctgcgccgccaccaccgccaccgccaccgtcaccgccagaaccaccatcaccgtcgcttccgccgcccacttcgccattgctcgagctacctagctaggcgcaagaaccgcttggtcaattgattactggttgatgtgatgtgatcgatgcggcagttgactgctgctttggctagtggtggtgtaggggaaagcacgcacgtcccgggtatttatagatgatgagaggtgttgcagaaggcagaccatttcatgtactcctttagtaccaaaagaaattggtttctatagctcagactttatcatagtagtactagtgctacgactgtgttcttcttgataaaatttgttgcataacattataagtattgtaattggttaagagacatcgcaaatacgtgacattgctgataggcaccacaagatttatataagggaaattttgctacaggacactccttatatgtggttttagccctagagccctgcccaaactcacttttgggggaaaacactccataaacgtggtaatttgccagtggacaccacgccgattaaaataataattttcggttgaagaggagagtgaaatcgcgtgaaatatcaaaaatgcccttgggcctacatgtcatctctatcttctatctctcttctcctcttcttgcccacatttcgctctccaagccggccttcggccatgcccgcgcagggggaggagctgcgcacgagcggcgggcggcagcgggggaggagctgcgcgcatcctgctcctcctcgaactcgtcaccatcgtcgtcgtcgtccgccactgccccgctctgcaccgccggatccgcgaaccacctcctcgccggcctgcgtgctgtgccagccaccgccccgctccgcgccgccggtgaagacgggcgacagccgacggagatgagctggatgcggcgggcacgggtggtggcgggcgggggacgagctacgcacgtcctcttcctcctcgaactcgtcaccatcgtcgtcggcagcagtgtcgtgattcggcgattgggatgagagaaaggcggcggcggtggcgatgagtggctcggcgttggcgctggagatgcggtgcgggagctacgacttgctcgcgtcggccggcggcgggaggaagggtgggggcagagggtgagggtggcgaggcagcggggagaaggagcggctgcagctgctccaccgcgcgctgcggctggtgggccgccagagggccggggtgctgctgctgctcgccgttgcctccgccgctgtctgcgcgtgcacggtcgacgaccggcggggagcgacatgtgggcaggaagaggagaagagagataggagatagagctgacatgtgggcccaagggcatttttgacatttcacgcaatttctctttcctcttcaatcggaaattattattttaatcggcgcggtgtccactggcaaattaccacgtttatggagtattttcccccaaaagtgagtttgggcagtgtcctagggctaaaaccacatataaggagtgtcctgtagcaaaatttgcctttatataattagcaatagcgacatccgagataatatgttaccatttccggtgaaaaagatgagagagaaatttcaaaaggacaaaaatacccccaacctcagtagcatgtaacccaggttcaaccaaacgcactcaccgttcaaccccatacctgaaattctcatccaaatctaaccctaggtggttggaggtggcgagcgaccggctctgggaatcgacggggggtggagctgtgaaattggtaggcgtcgacggcattggggatgatgtcgccgaggaagaagttagcagggaagaaagtggcttttttttacgagcattgaggttccattaaagccccacaattgattcccagatccgctcgcccaccgccgccaaagccaccgccaccggctgcctagggttaggtttggatggggatttcggttgtgagggtgaacgattagtgcgattgagtccggttgaacttgaacaagatccaataggccaggccggtttacatgctgttgaggccggaggcatttatgttcttttgaaatttctatcctatatatctttttcattggaaatgatacaatattgtctcgggtgcgctacaaccagttacacaaattttgtgatgtccattgatatatcccaaccaattagatgactttttggtatcatgtggtaaattttgccaagaagaacggtcgtagcactagtacttctatgataaagtcagaactctagatgagatggcagtgaaactactactactatggaaatctactattggtgacaaacaaagtcaacgagttgattattgtaaattattgaaaaataagatgttatgggtttgtactatgttaaacttccttgggtttgactaaatatatagaaaaaatataacatcttctacggcatacatcaaattagtttaattaaatttactattgaatatatttcataaaatattggttttatggttaaaatacagtgtattttataccaacttaatcaacttttaagaagtttcatttaggacaaactttcaactacttataatataggatatagcgtatatatagtttttgcatcgttatataaattcatggagtgctcgagacatcctgctagttgggttaattcatttttttttgtaaaatttgcaaaatactcctgcattgcactgggtaatggtaaggtggatgaggtttgacctcaatgatttatccaagcaccggagcaaaatcataaacatcgacggagtgtaattaccacaaaaggtatatttttgtttgaaacaatggctctacacgttcgggatgtgaacgatgatcttgatgtgtgtgcctgatgatttagcatgggagaaacagatgggtgaacgcctgaattaaatttcaaaatatactgttcattcatttttttctcaaaaatattcggtatgcaaaaaattttacaaaaatatatcgccggtctcgcacaaccattacacgaagatgatgtgggaatgacgtcagacggtatcgcgcactggaagcgcgcagcg

SEQ ID NO: 68809 - DNA, 2311 bp, Oryza sativa
aatgtgcgataccgtgccatgccgatttcattagcgattaattaattattgattaataattatttaatcattaatcaggataattaatcactaattattattagttaattgttaattgagtaattaatcactaatcaaaaggagctgtcagacagtgtcgctcgttgctttagcgagaccgttcggtctcgctattccgttacgcgataccgcccacgacgtcattcccacatcatttttgcgcaacagttgtgcgagaccgacggtatatttctgtaaaaaattttgcatcccgaatatttttgagaaaaaaatgaatgaacagtatattttaaaatttaattcgtgaacgactcggttctttgcgctgtagtcaattgatgaaaatttagactgaggtcattaaatatttttgcatcacacgttttcttttatgaaacttctactgccttagtttcataaaaattgaatttctacctttaaatctttgtcccataaaaattttatgtctactaatgtgggacctaacaaaacaaattgattacatcaaaatttgtttccttgtaatctcctttctttccatttcatctcttaacctcttgtctcaaccttatttttaatcaagtttatatataatgtgtgtgcgtgtactgtgttcattaaataattaaggttaatgtgatcatttgtttatctttataatttgtccttaatttcatagaaatttttttttatggaggtagtatagtgttttcaaaaatggatgacttttttttgcccgtgcattgtataatcacacaatacaatagtgcaacgttttctccagttagtttgcacacgtttgccacgttgagttggccggctgggccagatcagcacgagcagccggtcaagacttatctctctctttctcgctctctcatcgattcttgttcaatctctctcctagctcgtctctcgtcagtgtcaagagaaagaaagggagaaggtgaacgtacccgcatgataattaaacctaaatcgagaaggtgagtagccggtggctgcgggttcgccacctccttctcctcctcccgtcctccgcctcgaccctcccatctccactcaaggtctgtggaggcctacagcggaggacggctaacaaggcggagatagacaatgggcgaagagcggcgagcaggactgaggtcggtgactaacccatcttctgtggatctgggtataggcgacagtggagagagggtgcaattagtgacggcatggccacggaatcaaatggtcccttaaagcgggaccagacccccatcgatcaatcctaagcctgaaggaggtcaagatggagtcgtatatcccatgggcatgttcgactgccattcctacgacagtgctacggctgcagcgcttgtgttgtgcagctgcagctagccttcgtgcagctgtaaaaaatgccagtcgaacagaccctgacggagcgtggggctcctcaccgggagaccgcgcaggcccccctttgccggttcggccgggggctcagggagagattctaagctctctgtatgtggaaggctcgcgagacaggaaacacacaagacacgggcgatgtatacaggttcgggccgctgagaagcgtaataccctactcctgtgtttttgggagatctgtgtataaaggagctacaaagtatgagccagcctctcccttgttctgggtttctaatctggaaaagtcccctccccttctcagtgggcaaggtcctccttttttatatcttaaggggataccacatgcaccatctctctctttttctgtggggacttaccctaccttttcataaatggacggagatttgtatagttgccgtccgagtcaccttctgatgagacgggccacaactacctccactttcgccgggagcaggtgcgacgtggaatcgtggctgtctgctgacgacatgaccggtgtcagaccagttacgtcggtcattcttgtcccccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgtgtcagatcgcctgtcgccacctaacccgcgatctgaccggtctgtgactggtcacagaccggataaacaagtgcactgcactgcgttacatgcggcgtgacacgctcaaccaaaccgcaataaatgtggt

SEQ ID NO: 68810 - DNA, 8230 bp, Oryza sativa
gacgccttggagttgagcacgcacttgtacccctccgacttggccgcggcgggcttcgccgcgaagtagtcctcgacgcagccctcgacggcgccggcgagcttctccatgttgcgcaccgtgaggaggtgcagctcctggccggcccacccggccagatgacgacgcagacggcgaggcagatgacgatgccgatgccgatggtggacatccgctgctgcgccaggtccagcagctggtcgacgcggtaccccgacacggcgacgaggctgaacgtcaggatgaagatggtcacgccgtagtcgaaccgcgccttcaccgttggtatgaaccgcgagaaggtggccgccgcagctgttcaccatgcacgtacgcacgcacgcattattttacttgggtgtcagcgttgcacgtagtatgtgactgtgcaagtctttgtcacggcttacgaaacgagcctaacaaaacaggggcactacgtacggtggaggtaggcttatcaaatacgtacccagtaaaaacagggagccgctgaggatgaacggctcgagcttgtcgccggatttgtccgccacccagttcacgccgagcgcgagcagcccggcgctcgccgtcgcgacggctctgttgaatcccttgtacatgcatccacctgcacacacgcacgagtgtacaaaaacacggtgaggaacacagcaaactgacatgcaagagcatgcagaattcaccacacgacgttgtactactactcaccgacggtgtactcgaagaccacgacaaccgtcatgacggcccacatggcattgccgccgacgccgtcgtacacgggcctggtgtagtagacgatggagacgagggtgagagccaggccgactttgaggctgtgcaccgctctccggggatcgtcggcgccgatcttccacaccttcctggcgaagccggccaccgccgccctgaccgcgaccagcatcctcaccacccacgcccacgccctctcggcgacgccggcctcgtgctccaccgtcaccgacgagccctccggcaccgtcacccgccattccagactgccctgcacctgcgcttccctcgcggcggcgtccatgctgatggcgaccggtacacgagcgccgctgcacacaccagatgggtccctattgtaagcctcgattctctatgtacgcaacgaaaatgcggcctaaatttgcttcaattcgctcgcctttggtaagtacgactgggttgacctctgctctcgttgctttcgtttctgtggcaattattttctggacacacagatatattcctaggaagagtaaagcaagctaccaaagctagtttccaaagagaggaacgtgacaaaggcttctggccaaatgtgatctacctccctatgttggaatgaagtgagaagccatgatatggcttcgtatatatagccatgagagctccggcgtattggactttgacaagggagcacgatcaagggcgatgcaaaagaacgcttgttgcgctgcttgtgtcagccaggcaacgacgaccttgagcacacgaaaggctgggtacctgttagctgcggctaacgggctaaagtgcaacaaccatacagtgcattttggaaagaagattgccgctggaaatatgccgggaagtgggatatcgccaataggacggcgaggtgcggtgacgactatggtgcgatttcttttcaccttgttttgcctgccacgtacgtctgtgcactgttgtgtccctgatctgacttaactctcacttctacgtttgtggcttgtgttcgggcgcgactataaactctctaagctcaacgtgttaccagaattgatatcacgcctgcagcctggtgaagtggtgagggtacatgcaggtacaagcttaagctcgaaaccgtttagctcgttgacgaaaagcaaaagcaaaagcaaaacggatttactattttacttgcgatagatttttgacttctatcatttactttttcgttcgtaaaatctttcatcaaaattcgtattctcgtgtactcaatttacggtcacactcagttacagagcacttatactcagttacaatgtacttatacttagttacatagcacttacattcaattacagtgaaccaaaattatattttacaacagttttttttctagatttacgatttttttttatatatttgtctctttttcttgttatttcatttaaaacgggctatatccattggcatagttattaagaccagaccgaggatcgaaccgctaaggcacacgattcactggtttattggtcggaccaatcaaaccgctggtttaaagcggttcaaatagatgtgtgttataatacatgaacaacatgtgacatagctcgatggttgagacactccttgaaaagaagttcttgggtttgatccctcttagctcttttcctgttttctctaattcgaaactataaatctattgaaagattaataggtagtcccaatgagactttattgcatagtctacgtaggtgataccccgcgctttactgcgggtctacgtaggtgataccccgcgctttactgcgggattcatggataagtatatattaaatattgtcgaaatgatgaaagctgaaatgttgagaaaataatgtgaggaagataatttggcacatacttgttgatctttataatataatattgtagatgatgtgtcatgcttacatgggttttaaataggttataatagtaattgctagtgagtgaatatgtggcatgcttgcatggaattgcttacatgggttttaaataggctataatagtaattgctagtgagtgaagatgtggcatgcttgcatgggattttaaatgggttagaacagtaattgctagtgagtgatgatgtggcatgcttgtatgttgagctttagcttctaataattattagtgggtaccaactatatagaaagtatagattgtttcacctgcttcctatttgaatgacctccaataattagcagtgaactagaaaatggacaatatgccactctattcgtgtgatttcaatgaaatgccacatgctagaggaacgaaaactggagtcctcatccctcttgggttttcgaggcatcaacggtatatgaactaaagtccctaaccctcctaggacttcagggcatcaacagtacatattcaagagacagacaatatctatatactcaagagatttatattatctacatcttcgaggtgtcgagaagagagtcgagatctatatgatctagctatgtcttcaaagagttgaagatacaacttgcaatttttggcatctccttcaagctatgttcataactccttcatcaacgacatcttcgagaaactcgtccaaatcaacaagaaaacctatgacttggccattggagcggccaaggattccccgggcatgtagtgtgccccggatcacggagcccgccccgaaacaagttgcaagcgactcagggccccaggctagggcccaagcacaccctctacctgggctctccgtggagaactccgcccatttataggtaatggtgggtccggaggataaactttgaccaacaccatgatttaactgcagagtgcagcaacctggaaagcagctcaaccgcatgcttcaaggacgtggcatcgcacgcgggctcccgcatgcccacgtcaactgaaggaataggagggacgtgacatgttgcccctcgttctctcccacttagtctcacctcggcacctcgtggaggctgactgatggcccatgacagccgggcatagactttcttgcatgcagctccacttgtcagccgctaggtaaagttggcatattttctaatcaattatcttaagtttggctaagtttataaaaaaatataataatattttcaacacaaaatatatatattatgaaaatatacacaatattatatttaatgaaactaatttggtattgtagatgttgttaatgttttctataaatttaatcaaatttaatcaaatctaaagaagtttgattcagaaaaaagttaaaacaactttgcctgtttcctgagagatatggaaaaaaaaagaaccaaagatctttcagcacaaggagctctcggcgtctagcccattctccaaagtcagcgaggaggccaaaatgtaggcactcatggatgctagaaagctcaccgcttggttaactttgtcgctagaccggatctccggtcctaacttgtagatattttgtctctctatagttttctcatgctcttttaatgaaattggtggctcatcaatttgtttaaaaaaaactttgcttaaatcaactagctaccactacatccacaatcatagcacctgggacaatacacaacaacatatatacaaaatatatttggaattgctgaagatgccgccgcaaccatcacatcttgtttatatgaactatggttgacctaaaaagagttaggagcatatgattactgtacatgttagctatacttaaacgctatggatttaattaatactacctccatattttaatatatgacgctgttgactttttgtccaacatttgaccactcgtcttattcaaaaaatttatgtaattatcatttattttattgtgatttgattcgtcatcaaatattctttaaacatgacataagtattttcatatttgtacaaaaattttgaataaaacgaatggtaaaacgttggttgaaaagtcaacggtgtcatacattaaaatacggagggagtagctatcagttagctttatcattaacatcaatagagagcacaaatgctatgttgctctctttttcaacaatatcaatcatttatcactcgaagcatctccaagagctttgctagatggctctccaagaaaaaatttgacaaacttgagaaagtaaccctccaacacccttatcaacttgaccaaagtcctttccctgttggccaaatctgatcagccaaaatcgttggccatctatgggccctaccgtccgaatctcccctttcccctccctcgccctccctactctctcgcattgtctctccctctcctgcattgctcacttgcattgtcgcctccctgttcgagtgcaatgccaccacctccccttccgtgcgcagcgccgccgcctccccttccgcgcgcaatgccaccgcctttcctttcgtgcgttgcgtcgacgcctccccatccgtcgtagtgttaggccaacaacaacactaacttggccttcatccgctaaaagtagcaggtggcccatcgcatccctgatctcccacgtcgttgtcttccgccttgccgacttgtcgccccctccttctccggcctccgagcgccatcatcacccatcctgatttgcagctattgtagaagagggtttagacactggcatgtggacccataaaatttagagagtgagagatactgttggagcacacggaaaatatagagaagaactttttaactagctagcttaccaaatgagcaaatagaaatcaagtttcgacaaggctctggaagatactcttagctaggtcgcctcttgacacccctatgtatccatacatcattggtacttttcccttgctagatgagttgcaacggatggcgcagcggcggccgtgcaaggcgcatgccgtcgcactccgcacgattttcccgtcaattattataccggatggaaaagagaaggaaacattcgaagacgacctagctagagtcatagagcaaattacctagttccaagttccaacgggattggccatgaaccggaaaagaaccagagctccactcatctaggctctagcgtacttcgtgcgcgcgtacgaggccggccgggtagtggcagcagctgtatccaacagatctagtactagcccgctagcgcggccgaaatatcacgcgcgcgcgacgcgcgatagccaacttgcgcgcgaccaaccggccccgccccgcttgcaactacaactagtacttaagctagaacgcgatagatagcggcttctccggaccccatggccatctccatcgtccttgcttgtcaccaacatcatcgcgcctccgtactacgtactcctcccgcactttggcgtacggcgacgccgccatgattgctagctctttctctcctccggtgaatgcatgctcactggtcagtgttgctgggtggactcgatcacgatggtgtcagtggcgagcacactcgggcagcgcatcaccgtcgccgataaggacgctgcgtcatccgtgcatgcgcgctctctaggtacgtagtgaagagatcgatcgacacagaatctttgctttgctgcgcactactaattcacgaaacttccttcttcggtagctgtaaaatatcagtgcaccggtgtatcctgttgcgcattcgacttcacccaaggagctgagcgagtgagagtggccgtaactattacctgcacacaggtggttgcattctcaactgaacagtcgcaaagctatggcactcaccggactgcccgttctggtagagtcccagatgaaccggcaaaatacggcgagcacgcaaggtgcaggaaaacgcaccttaggatattctctgctttagacagagatccccgttcctctttatgttctgaatcgtacgttctaaagcgagatacacataaaaacggcaccttccccggtttctacatacgtacgttatcgattttttagagcggaatggataacgctgctagcgcctagctgtggccactgcccacagcggcacacggttcaaagtgaagcactgtcatgcacattttcgagccaccaaattgactcactccacactagtatatgcaactgtaccagtacaagttgtgttttacacccctagtatagtctagttccttttcttttctacatcaaacaactttgcgctgcacgattgtaataagaagtggtgaccgatcgaatacctgcatctttgatgtagaggttggtttgatttctactagtatcatcaaagaaaattgcttgtgcaaagatataatggatcataaatacgtcgaactttccaggcatcacaatcagattgttcgaactgaattgacgccacgttctcagcacaatcagcagcgcgtcgtatcgtatgcgtgcttgcttcgtgcgcgcgtaggctgttcggcatttggttctacactgctacggctaccgtgtcggagacgcgtttttccggcttcatcgatgggtgggtgccaagcaccgaggcacacagcatactaagctgctctgctcttctatgattgttcaattaattgtgccctggcgctgctggaacacagccgaactgcttgtgcgacttgacaaagcgcagcaactaccgaataatgttcgcctcatccctttctcgttcagataagagggccatatgcctgtaataatgtagcgagctctttttgaaaatatacgatggcattcaagaattgatcggaaaaaaatggaggcacacatgagtacatgacgtgttagaattatttactcatgatccaatttacttagcttaacacatactttctccgtactcgtaaaggaagtcgttttgaacagcgatacggtctccaaaacataattttgacttcttgtttctataaaaactagcatgatggcccgcgcagattacgcggctagcatcattatattttctctcatataatagcatatatattttctcattatatttttcaaatatattaaaatggcaacataattttaaattttgcaataactttacaaaactactaatgtgtaatattcatattatattgtattacgtgttagttattaattatttttaatatcaaaatttagtaatttgtaaattatatatattcctatatggactctagactcgtcttttaatatttatttttttaattccgaattttctgtaaattgtatttctatatacactctatgctcttcttgtaatattatttatttttatttctgaatttttattatttctaattgtatttctatttggactctaaaactcatctttcaatattctttaatttttaatttcgaatttcagttacttctaaattatattcctatattgactttaaactcttcttcccgtgtttttcttaatttcgaattttagatatttgtaaattatatttttatacggactctaaactctacttttaattttattatatttattccaaattttag

SEQ ID NO: 68811 - DNA, 12997 bp, Oryza sativa
catgaaagtaacattttccttattctgatgttctctttttttccttctgtttttgttagaaatttctggtcacactgtttatctcctgtatcaacagagcatatatttaattaagtctatcgccactttctcatctgttctcattctctttaggacaattgatgacttctgaaataaagcacggtggaaagctatcctgtagcggcatggattctgatggcccccatacttcacttatacatggtcttcctgatgagattgctattctttgcttagcgagagttccacggcgatatcataatgctctcaggtgtgtctcaaagagatggagggcactgctttccagtgaagagtggcactcttgccgcaagaggaacaatttggatgagccttgggtatatgtgatttgtaggagtacgggcatcaaatgctatgtacttgctcctgatcctacaacccgctccttgaaaattatgcaagtcatcgaacccccatgctcgtctagggaaggcatttccattgagaccttagacaagagattatttcttttgggtggttgtagctggctaaaagatgctaatgatgaagtattttgttatgatgcctcatcaaattgctggagcagtgtagctccaatgcctactgctaggtaaatatgatgacaaagtttacttactggccattaacattttttttcacgtgaagctgttttatgacatctgcacgcattttgacttgcctcaattgttttcaggtgctattttgtttctgcagctctggacaagaaactatacattactggtggactaggtttgacagacaagtcgccaaattcatgggacatctatgatccagtcacaaactcttggtgtgtgcacaagaatccaatgctcacccctgacattgtaaaattcgtggcattggatggggagttggtaactgttcacaaggctgcctggaacagaatgtactttgcaggtatatatgatccattgtgccgcacttggaggggcactgagaatgaaattgccctatgttggtctggatcaacagtcgtcatggacggaacgctctacatgctggagcagtcgctcggcacaaagctgatgatgtggcagaaggagacgaaggagtggatcatgcttggtaggctgtctgacaagcttacaaggcctccttgtgagctcgtaggcattgggagaaagatttacattattggaagagggctgagtatagtgacaattgacctggatactgtcagggcagatggattcttggtgtcctcttccacaggcccattggtggagcatgacttcccacctgagagatgccgggttatcagcatctgaaggcatcagcttaactgtatattgtccggagaaaatgtcacacatgtgaaggtgacatgggttgattgatgcacatatgaaataaggcaatcctccaggcattgtttactcgagagagtgcccgttgctaattggtgtttaattgtttgtagtatttttgctgtatctccgacttgtgcccgtttgctgtaacaaacgaagtctgaggttcagttgtttatttcacacctatacatattgagataataacttgttcataattcacgagtgtgatgcgtcctgtgattgttatgtgtgattgttcatttttcttgcatgctgatggtgtatctaggcattctattgctgatatgttctgaatttttcctgaatgagttaggctgtgtttagttctatttaaacttctaactttttcatcacatcaaatgtttagacatacgtggagcattaaatatggacgaaaaaaaaacaattgcataatttgcatgtaaattgcgagatgaatcttttaagcctaattacgttatgatttgataatatggtgttatagtaaatatttgctaatgatggattaattaggcttcaaatgtgtgttcatacgctcaaaattattttgctaaaacaactaaacacggccctttagtttacagataaaattgaagtagctaagttctgacttatctttgagccatataagatttgtgattgaaattttataaattagcctgtgacgaaacattgattttttaaaaaaataagaaaatgatagtgggatgaaaattttaaaacttagccatttaagtgatgaaattgaataagaaaatgatagcgggattgaaattttaaaaattagccatttaagtgatgaaattgatgttttttaaaataaaataaaaaataattatcagagccaggtttcgatcctgggacctgtgggttatgggcccaccacgcttccgctgcgccactctgatgttgttgttttggttaaaaactgtcaactaaaatacaatacgaatgctgtctttttccaggtccacgcagaagaaatatagaggtaggaatatggtgccactgccaatctgccgtggaccaacaaaagactgggttgggtaattatggttgcctacccatttgcattgacagtgacatagggaggaaatatatacttcctccatcccaaaatgtacgacgccgttaactttttttaaaatgtttgactgcttgtcttattaaaaaaaattaagtaactattaattttttttccaatcatttgatttattgttatgtatacatatagttttacacatttcacaaaagtttttgaataagacaaacggtcaaacatatttaaaaaagtcaacagcgttaaacatttaaagaatgagggagtaattcacatgctcacagcagcattggtaaaaggtaatggtttggccatccgcatcaaccacccgtgctagtaatcttcacgctaattaactgcacagcaacttctgtttcttctcttattttttttttgtttaaattttctttcagttcttctgtccaacgtccaaaagtccaaacatgccaaactcttcaacgcacatacgtacattcctgcctaagtagctgttaaactgtagccgtatgcctccatgtgtgtcgatgtagggtttaccttaccgccggtaaccgtgtggttaccgtggttaccggccttaccgcgaggtacggtaatacaataccacggtaacctccttaaatttaaataaatttaaaaaataatttaaatttttaataaattttgtacggttttttactgttaccgcgcggcgccggtttaggaaacccttgtcatccacatagatgcacacattagtagtactactagtcttctcgtcgtggatgcttgttccatttgatcactcgttcactcacgtctcacgtttatatcggggacggatagctacacacatcaaactaattcatttgcttctctctcaaacaaaaagaactagtaattcatttcatttgctctcactaattgccccgacactccgaaaacgttgcgacgaacgcccgtacgtcttgaccaaatccaaacgaacaacgatccagcaccaaaacctcatgaataatccaatccaccatttatcttcatgcgtgccattcttgacccaaatttgattacaactcgatgcaattttttctcatgtttcgcgccgcctgtcacgcgttacctgcgttcccataccgccagtataaatacaacttctcgaatcttttcttggagaaaattagtacttccttttcctttttttacaatataagtcattctagcatttctcacattaatattaatgtgagaaatgctagaatgacttatatcgtgaaacggatggagtagtgatcaaatgtaacagtggctgaaagtttttaaccaattaaatcggagtcttgtgaggtctgaaatgtgcgtgattaatcagtcttgtggcggcaactttagtttaacccaagtccaattcggatcgcgtaattgacaagctcgtaatccgagtcggattcgatggctttttttgcagaaggggtataaacagaggagaagctcgacgtcgccatcgatggccgcggtggtgcagacgaagcagctcaacaaacagaccaacccttctccatcgccctactagaagcgtgaagagctcggcctcgccggcgactgcgagcgacatggcggcggcggcggcggcggggaggaggaggttctttccgccggtgacggcgtacgacgcggcggcgggcgcgaggcggacggtggcggcggacctcgacgggacgctgctggtgtcgtcgtcggcgttcccgtactacttccttgtggctctcgaggccggcagctacctccgcgcgctggcgctgctgctcgccgcgccgtggctcctcgcgctctacgtcggcgtctccgaggccgccgccatcgccctgctcgtgttcatcacgttcgccgggctgcgcgtccgcgacgtcgaggccgtggcgcgcgccgtgctgccgcgccactacgccgccggggtgcgcgccgacacgtgggcggtgttccacggctgcgccgagcgccgcgtcgtggtcaccgcgtcgccggccgtcatggtgggggagttcgtgcgcgagttcctcggcgccgaggtggccggcaccgagctcgagacgttcgcctccggcaagcggttcaccggccgcatcaaggccgtcctcgtcggcgagaagaagcgcgaggtcgtcgagaggctcttcgccggcggcgacatgcccgacgtcggcctcggcgaccgcgagagcgaccacgacttcatggccatctgcaaggtacacttcatggcctacgatccaaagctcgaaattttcatcatttcttgaattgaatcaatcacacatgaacaaaattgaagttttgcatcatgtggccactaataatttaacaattcatttagaacgccaaaaataaaaaaagaaaatattgtgaaattaattgtggtaggaattgcacgctcgattgttcttcgagtgttcatggcttcgatccgattggctcatttgtggtagcacgagtagcaagaatatgtacgcttcttagctttttgccttttttttttgttgaattgcctttttttcccctcttttcataggaaagatcaagaaggctctagaatttacattatggttatgcaaaacttgtggccaaaactcaatactgttggtaccatcacctcctttagtaggcagttagcagttgcttcctatttatttcgtcctttttaaaaccaaaaccccaaattagtatgtactcctatattcaaatattgtttgctcatgctgacttgttatagtaatatcattatcattgatcactttactcatatagtattgttttctttgcatcaattaatgtggatttagtactctctccatttgcatttactctgaatattgactctactgtttcaactttgaccactagcaatttttaattggttagactatcataaactaaaatttcatgcttacattcagaatgcaacctagcccatcatcaatatttgtttttatttaacgaaaaaaaaagaagacaagtgttcaaaatgtacatatgaatatactccaaagccagatatttgtaaaaattaggccttgtttagatttaacttttttctttaaacttttaacttttctgtcacatcgaatttttctacatacacaaacttccaacttttctgttacaccgttccaatttctccgaactttcaattttgatgtgaaactaaacacagccttagtgtgctaactctgttttggcgccaaattgccaatgcgcaggaagcctacatggtgcccaagaacaagcgcgcgccgcgcgccgccgccgacgagctgctgtcgcgcgccatcttccacgacggccgcctcgtccgccgcccggagccagcgagcgcgctgttcgcgctggcctacctccccgtgggcttcgccgtggcgctcctccgcgtgttcctcaacctccccgtcccggcgcgcctcgtccgccacacctaccgcctcaccggcatccgcctcgccgtgcgcggggcgccgccgccgccgccgcgcccggggacgccgggctccctcctggtgtgcaaccaccgcaccgcgctggaccccatcatcgtgtccatcgcgctgggccgccccgtgacgtgcgtgacgtacagcgttagccggctgtcgacggcgatctcgccgatccgcgcggcggcgctgacgcgggaccgcgcggcggacgcggcgcgcatcgcggcgctgctggaggagggggacgtggtggtgtgcccggaggggacgacgtgccgggagccgtacctgctgcggttctcggcgctgttcgcggagctgacggcgaggatcgtgccggtggcggtggaggcgaggcaggggacgtactatgggtcgacggcgagggggtggaagttcctggacccttacttcttctacatgaacccgcggccggggtacgaggtgacgttcctgccggcgctgaggccggaggagacgtgcgtcgccggcgggaggagcgcggtggaggtggcgaaccacgtgcagagggtgatcgccaaggagctagggttccaatgcaccacgctcaccaggaaggacaagtacatgaagctcgccggcaacgacggccgggtcgccgccgccgccgacaagcccaaggccaattgattagtccatccatctttctaaagatggcaggccacctaccagctgattaggccacttggcgcccctaagttggtatataaatctaatgtcatttgagaaaaagaaaagagaaaaaaaagcggctgtcatacaacggaatcccgttttcgaatgggatgataccggttagttatcaggttttgatacttaacctgtattatgcgtttctaccacgtatcaggtaatacttgcgaggtattagatgatatctatcaggtatcatacgattcttatcacgtagagggtgatacttgtgagatatcaggttctgatacctaaccagtatcaggagatacctatcaggtatcatgcgattctaccacgtatcaggtgatacttgtgaagtatcagatggtatctataaggtatgatgcgattcttaccacttagaggatgatacttttaaggtatcaggtcctgatacctaaccggtatcgggtgatacctatcaggtatcatgcgattcttaccacgtaaaaggtgatacttgtgaggtatcagacgttacctactagatatcaggagccgagcatcaaagcgtcgtcgccggtggtcccaccgtccacgtcccacgccggagctcgtcgccggcggccacatccttcatcgtccgcgccacgtcggaactcatcgccggcggccgcgtcctccatctccacgccccacgccggagcttgtcgctgacgaccgcatcctccaccgtccacgccacattggagctcgtcgccggcggccgcgtccttcgtcatccacgtcccacgacggagctcgtcggcgatggctgtatcctccatcgtccatgccacgtcggagcttgtcgctggtggccgcgtcctctgcctagccaagtatgtgctcgtcgtgctccgcaccgacggcggcagcgagggcagcaccttcgcgatctacttcctcatccaccggcgaggagctcgcggtcgcggggcagtgtgtcgacagggcgggcgtgggcgccgcaacactactgcccatgtcaaccatgcgtgcgcactggagcggctcctgtagaggctgctgctgctcaggacgtgcatggtcaggtatcgctcctctttgaataagcaaggagacaaaaaggatcccgtccggacggaattccggtatctagcattccaaaaaaaaggggccatgacaacagtaacatctggaggattccaagtaacaaacactctcatttctttgcactgcttcaacaacaacatattctaattaagttctcagctgaagcagataatcgatatatgagaaaaaaaaaactggcagcccaaaggccaccaaaactcagcatgcaagggaaaagggaaaacaaaatatttagcttgtgcaatggatctcccattagaggacaagcaaatcagaaaaataattaaaaaaaggtcaatttgatggtttttgaaaaatgatattttgctattacaattttcataatagtttgatacatgccactagtttatatttttacccgtaccccaaaaaatgtattttatgcagacctattgaaaactctcatattactatgagaactgatatggatcccattatattttctttttgtgactgtaattacaagtaagtgccacgccaaacgaaaactaggtcaacgtgccatgtagatgccacataggatgaaatcaccgttcaaacagccgagaaacttgatttgtactggttttgatagttgagggattttacctggttttatggttgagcggtgtaaatgtaactcaccataattgagagacctaaagtagactttttccttggaaaatatggcctggaaaaggattgcggcgtctgtgcgtccatattagatgggcctgattggtcgctgcggatgatatttggacagacagaattcttcagtactcacaagctaacgccggtattgcaaccccacaaataaacatccaaaaatttcataacacaatatcctctcaaagaaaatgaaatctttaacacaattggtgattacgtgacgcaagtacgcaacgagcaatcacgaactggcgttgacgagtcgtaggctggaatgctgctgatctcaaattaagcaggcagaggcagcttgctgatctacattttttcggcgatacctaacaccttaatcttcaggccatatctccagctaactgtctattaatttgttcgttaattagtactcctgctgtagtatgctagtagcaaaagcgaagcaacgacgagctgcaaagcaacctgcaacttgcaagcctctctgcaattcttgcgacccaaaccaatactgacactactactaatactgatcgatgatgcgtcaaggctcgtgaggctgctgcgtgcaaggaactcgtcgtcgatataattattgctgcaatgatccctgagcaatgtgctcccaaaatcttaggactgattctgacagattcagtcgtaatcagcaatgcgtgttgcaatcttactcctgtgtagtaacaattagtgcagatactgcatgcgtgttactgtcgattacattagcagataaacagcctctccatcatgtcaactgcatgccttctgaaacaattgatgtgatgtactttttacatgaacgaattcctgaattcctgatactgtcaactgtcaagcattgtggcctgatgctaatgctgcgaaaagttttatgatactactagggttgtgtttagatccaaactttcaactttttccatcacatcaacctgtcatacacacataacttttcagtcacatcgtactaatttcaacccaaatttctaactttagaaggaactaaacacagcctagcttctctagcacagcagcatgttcacttcttaattagtggcatctgaaccatgtgatttttgaaagtgaaactattattaactgatcgagttgccgagataaggacagctccatgttaaggtggggcatcacattctccagcctttcaagcaaccccaaaccatgccgaaaacacacatcttctacaatttgtgagattaaatgtcagggaaccgaaattcagtcatgcagatgtggattcagccacattttacggatctgaaactactgcgactgatatgtcagcactctttgttttcgtactagcctgcacaaacctctttttaagttaattcagtcggtaccagatgtcagaaaagttcctttgaattaaatctcaagatgtcaccagccaacagaccaaactgatcttctttgtatttttcgacttgggcaaatgtttgcccatgcaatgccatcaaaactgagccgcaaattcagttggtcaagctgaattctgttactaattctgttccgatttccactcgagcagagaaatagaaccgtaagtagtagtacaatacgaatttaagcggaatcagctcagattccacacgaggacaaattcgtattcgagctcgaaaaggcaaaaagaaaccaaaaacagaaaaaaaaaagaaaaggaatccggctgtgcttggattgcattggaagcaaagttcgtttaaaaaaaaaaactaaaactaataaaccagtccgtttcaaacaccaaaaccgcgaacgctataaattcggagggaaaacctctccgaatctccaaactcctccaatggcgaccgcgcgcgtctccctcatcctcctcgtcgtcgtcctcgccgcctccgcctgcgcggaggggctccggctgccccgcgacgccaagttccccgcggcgcaggccgagcggctcatccgctcgctcaacctgctgcccaaggaggccgggccaaccggcgccggggatgtccccagcgtggcgcccggcgagctgcttgagcggcgggtcacgctgcccgggctcccccagggggtcggcgacctcggccaccacgccggctactaccgcctccccaacacgcacgacgcgaggtagatttcgaatttcgaaccccaaattagttgtaaagtagtacaaagttcttgctctctcttttttttttcttttggaaattttgggttgagtgtttgtttgttggatggattggggcgttgcttgcaggatgttctacttcttgttcgaatcgagggggaagaaggaggatcccgtcgtgatctggctcaccggaggccccggatgcagcagcgagctggccgtcttctacgagaatggcccgttcaccatctcgaacaacatgtcgcttgcttggaacaaattcggctgggacacggtaacgatccatcgattcgataatacgttattgattgcatcatatgtttagtttccttagtatggtaacgactcagacttggtcataatattaacttgttaatgttgcatcatcgcttgcaagcaatcttgtggtgagagcaacatgaaaaaactattttgaccattgttgactgaatgactagcttggttaagcaagcaatagtgaaaataatgtccgtttcagagtttctcccggttgaagtcagtaactgttgaagggggaaaaaattattgtctagaatatcatccttgctatcctccgttaccaaatttggataactgttaccaacttactatattgtgttcctcactttgccttttagtgtcttattagttgaagaaaaccatctggggctagaacttcattgttgctatctgttaggttgttaccaacttaccatatgtgttccatttgactatcatctcttatgccaccacaatagtctttgttaagttttattgctttttacatgaactgatgcacgacagcagaagtttacgagtttattgaggacaatgtttccctacatagtattgttcgttattggtgaacattaattcctactatgattttttagacctttccaactagtttcatgatgagtttaacaatggcagtggtcattgctgcagtcagttcacatcttacaatgatcaagcctacacaccttttggttcctttgtatccaccccttctgataaaactttcttcatgcagatttcaaatataatttttgttgatcaacccactggaactggatttagctatagctctgatgatcgtgatactcgtcatgatgagacaggcgtcagcaatgacctatatagctttcttcaggtactactctcaacccttgtaactgacgtgcttgcctttttctctttgtttcatcaattccatgtgatatctgattacactatataggcttgttcaatccattcctttacaatactaaatactaataaagaaacataaatgatctccaatgtaaagtaatcatagcaatatgtttgttttaaaactgcaggctctgctcttaataatagttccatttcacaaaataattatttgcatactctacttgactaagtaactaacagtcaacagtctggtgtgcctaattattgctttcatcctcaatttgtggagtggttctcttacctgatatgatgctcctgtaaaattaattgctacaataccataggaaatttccaggttggaatttggcattgcttacatgaaaggatgtacctaacatatttgactggatagcttcattaaattagcggtagtagataacttccgaagatttagcaccaaaccagataatatgcacggatctctctaaagagttgtgtattgatctgagagttgattattttgtgttgttgacttcagcaaaaatgtagagtaatatgtagtatttgcttgattcccatgtcaggtgttctttaagaagcatccagagtttgcaaagaatgacttctttataaccggagaatcttatgctgggcactacattccagcattcgcaagccgggttcaccaaggaaacaaagcaaacgagggcattcacataaacttgaaggtatgatccttacccaagtttgccatatcttttaacttaattgcttctttgctattttacacagttttacctatttttcttgtagggttttgcgatcggtaatggcctcacggatccagcaatccagtacaaagcttacaccgattatgcattggacatgaaccttattaaaaaatcagattacgacaggatcaacaagttcatcccaccatgtgaatttgcaataaagctttgtggtcagtaccatattctacctttgagcaaaccacatatatctaactgcattgaacttcctgaatgattaatgctggcagaaaaggttgaaaaaccatttagggtataaatggggttcattacagttctctatatttcagctatgagatagtgcatttgtaataacaccctaaggtttcttcaaataatgagaactgttactcacacctactgatttttcaggtaccaatgggaaagcatcttgcatggcagcatacatggtctgcaattctattttcagctccatcatg

SEQ ID NO: 68812 - DNA, 8176 bp, Oryza sativa
ctagttataaatcttgatctcatataattatagttcaattgtaaattaggattattcattgtaaaattatgtgatgggataatctgtaaccataatatgattatcctaaacaactctaacatacaaagcatggataattattaaccttttctaatttattgtgacaagtaaaatattttcataattaaagcaaagcctccatcaataaaataataatacaaatggttccctgcgattaattgcttgatcccaaatccatccgacgacaacagaacctctagtatatgaccattttatttagatcaatgcatgtgtagccataatccttccatagccattagctagactaaaccacatattagccagatatgtatctcgtttatactacgttggctagctcctaaatagaccaccatgacaacagaaagattaagaaactttagcccttagcatgttggaatccatcagcaagcgcgaataatatgagcaaccctaggttcgacctcatcaaatatattttgtttgtgcatatttgattgttgcttgaatattggtttttcttgcgtattatagaaattgtgtatcgatcagtcgtaaggcaacgtctacaacttccaggaggtgaaggttgaacaataattatatcaagaataaggactatcatgcgcaagtcatcactatgacatgataagatactatcatgcgcaggaaagtcatcactattccttgaacatgttgatcccaattgcgaaattattttgtttacaaataaaattgcatgcaatgaggaacatcctacttgtgattatgccatgccttgattattgtttacccccttattccttcgtaaccatgtttacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccatattgccatgatgttgatgacatgatttgtggaaggagaaataaaactaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctaccgtgggacaaccgttgaggtagggccgagaggcgtgccctacatcggtgtcgccattggtaggactgccatgagtgtgtgagagagataacttaacttgaatcttaatttaatatgtgtatgagacttccctttcccgggagcgccagaactcctctcactgctagaaacatggacacttagagtgcatgaggatttaagttcatggagcgggtactgccaatgcgaggttatcgaaaagctttgtcgtgacgcgtctcatgtgttgggacgaggctcatgtgttggacaattgcggagtgcgagtaaagtgtacatccactgcagtgtgagtaaaccaaatctattcgaatagccgtgctcgcggttattgagcaccgggacatgtattatacttggctagactctagattcttaacttgtgtgggatgggatattgcatgatgatttttatgctgatggagccacttcctgagaggagggaaggtggacgtcctcagaaaaccatgacgactcaatggcgggaagctatccttgggatcacaatggatggtggacagaaccatcgttgtttaatgtgaacattggtactaaaatttgatcagtctatgctagattttaggcttctgaaaagaattgcaaaacttgctttgcgcaaaagaaccgtggctattccttaaaataccccctctatcatatgcattattgttgtggtggcttgctgagtacggtcggtactcactcttgctatttatacatcttttaagagagtgttgaagagaagcccttgtcggtacgcttgcgtatccaacaagatgatcggagtgcggtctggttctaggtctcgttccccagtcgactgcctgtggcatattaaccgggcccttatattatttggtcttccactgctgttctctgatagttgatgggctacctggccctaatgtaagtatttaactcttttagcctgaattcattcgtgatatgttgtgattcaactatgtatgtgtgtaccaactactgattcagggattggtacagataaacacagaagatttccgatttacaaaatcggaggtctacatagacagagcaggagcttacgcaatcagcaccattggttagtgtagcctacgataggaggtgcgggctgtggttgatgacgggttcttctcaagtaatcatgattgctggtaatatagccgccgtggtggctatgcgggagaggaagacaaccaatcttgattggcgtgcttttttatttgacgtatcaacatttgaaattcaatgttttatgcacgaggagagaaatattccaattagaattggactatatttcacatttttatttttattatgaaaatattgtagcggttggaacttatgtgtcatactcatacatagaaatgagatgtttcaaattagtttggacaatggttcgaattttagtttgtttttttatgtttcgctccatttctcaagatgttttatctgtgtctctcttatgttactttattgcgtactagtttgtcatccatttattttaaaatgtcataattacttttttttcacaatgtataattaatgctacagttatggtcaactgaaataattacagtttagcctgatttttcataaaggcccccacattataggtgaaacacactgtatcattcttagattgactacgttctttttagcttatttatcgaattattaaaacaacttgtctattccacgtttcaaattaaaaatatgtttgcaagaaagtttcttctaccgtattttttagattaattgttttaaatatatgttaagtttattccttagaaatctaattaatcaacgaatgtgttgctagcaattacttcatccgtcccaaaaaaaaatcaacctagtactggatgtgacatatcctagtattacgaatctggacatacctctgtccagattcattataccagaatatgtcacatctaattctacattcgtttatttcaggatgaagggagtatgtaaattgtttccaaacaaatcggtgaccgaaatgacaacgacacaaactcgatctagaaagagcaaagactaaagagcgacagggacagatgatccattgataattattgtacatccgacgtgacgcgaggcggtaaccggaaaatgatatgtgatgcaactttggaataagttcaccttaggtccctcaatttgtcaccgagttctaaattcgtccctacatcacaaaaccgaatacaatgcatcccacagcttagaaaaccatgcaaatgaggtccctcgacagtattgtctccgattttggctaacgtacgcctacatggcactctattgactaggtcttaatcccacgtggcgcttacgtggcaattcgatccgaaaaaataataaaacccgtgagacccacgtcagctacacacataaaaaatgatggtacccatgtggcctcacatgtcatcctcactaccctcttctttgtatctatctttttcttttctttttcattcttttttcttcttttgcttcgcgtccggcgcttggtgggagcgccgtgccggcggagagggcggccgacgggagcgccgcgagggaggcggcgagctcgtcgggccggcagacaggagaggagcggcggcgctcgcaggccggcgggagggcgggagaggagcggcggtgcgcggggaccggtgggagggagcggcgtgcggaggccagcgggagaggatcagcggtgcacgctggctggagggtgggagggaggggagcggcggcccatgccacgccggcggagagggcggccgatgggagtgccgcgagggaggaggcgagatcgtcagggcggccgacaggaaaggagcggcggcgcgtgggagccggcgggagaggaggcaacgcgcagcggccgacgggagggagggagaggagcgacggcgctcgccggttagcaggagggaggtaggctcgccggcctctccgccctggttggcatgtctcccccctccccgcctgtccctcatttactttttagttttgctcatttattttttttcaggatttaactgtcacgtatgcgccacgtcaatgacacgtgggacgaagatctagttaaagaagccacataggtatcacgtcagttaaaccggggtcaatactactgagggatctcatttgcactggttttgtaagttggaggtaaccggttttccgtaccgagtatgaaaatcagactgcgcgacaaattgagggaccaatagtgaacttatcctgcaactttcagccaatttacggccttattgtctcaggcctaaccatcttcgtttcggaagaagaatctcggcctggaaaaggcccggtccaagaacgggaggcgagacggaccagcgacgcgtctgtgcgacggcatgtcctaaccgcgacgtgagcgcctttttgttgaccgtgcgtgcgaactgtcgcaagatcgcccgtgcatagacgccaatctccggatttgctgtcgtgaccgtgccatctgcggtgaggcggtgagcgacacaagcatttctctatcgtacacaccacgcctctccaggatgcctgcaagaccagtacaacatccaagcacaataagaacagcactcgcccagagaacacagcaaattaaaccaccgatatccgcttgatcgcaccacccatttttacacttttccgcgcgtgtacttacactgcctgcgaccgccgcgatcagacacatggactgcaccaaggcggagacacggaatgctccgaagtggcagatgacgatgccgccggcgggaggcgagtcgtcgtcgtcgtcgtcataaggtccggccgagcgtgcgcgggcacggctggtctactgcgcggccgcgctccaagccaaggtgtccggctccgctaagaaggtttggaagattggcacggacgatccccggaaggcgacgtacggcgtcaaggtgggcgtcgcgctcaccctggtctccctcttctactacgtcaggcccctctacgacggcgtccgcgggaacgccgtgtgggccatcatgacagtcgtgctcgtcttcgagtacaccgttggtaaaaaaaaactacaatttgcgtgcacaaagccacaaagtcgcaactcacgaccgtgcgacgcaccatttgattactgccttattgagtttggctttgcttgcttgcttgctatctttggtttgcacgtacgcgtgtaggtggtagcatgcacaaggggctcaaaagattcgcggggacgatgagcgcggccgcgctcgcgctggggatgcattgggtggcgagcaaatccggcgaaacgttggagccgttcgtcgccagtggctcggtcatcttgatgggtacgtgtccaacatcgtcatggccattggcgtagctagggggtagtcctggtgggctcgggactacccccgaatttggcccagggagccccacccccccaaaaattttagcccagacttaagcccaagaagccagcccaataagaaatgaaaaattagaaaggctagggtttggagttcgctgcaacccgacgctacttcgtttcgcacgcgtgtgacgaccgcccatgccgccgccgttcctcctttcccggcctcgccagctcgccttgccctcgcattggttccgcagctcccacctctcccctgtcgttctttgtccgccgaggcactgagccgctgccgtcgttgacctcccggctgctcaatccatggagaggcggactgacggaggttagtggcgccgtcacgccgctgaaccgccaagcgccgctggtcgccggcgccgggagcccaaggcccctggccggttggccctagttgattgccgctcctcccccttgccctgcctgtgccagcggctgccttagtagcctatgacgaggtgagtttaagtgctaactggtgaattgaagctatgagcctatgaaatcaaatagatgtatatttctaactgtgatttgtgcatcagttagttagtgaatgactgaatgtgtgacgttgacttgctatggaatgtgaattagtgaattagagctatgaactgtgatttgtgatagtgctaattggtgaattagaactatgaactgtgatttgtgaatcactgaatgtgctgttgacttgctgccattttattttagtttgtaggatttctttggcaaattaagtagtagttttgataaggttggttcgagaaattggaacaaatccgacgcacttgacaaacatgtagggttgtaacaagtaaacacaataaaaaagcttcagagaaattatttatgaaagatgcaccaattgctatatttctaattttgtatggccttttctctaaattttgatctgtatatgggatttacggtgattgaaaaattttagtatgtgatgtgaacttgtgatccatgaagtaggactacccaacaaaaatttcctggctacgccactggtcatggcaacatactactacgtatgttgcagctactgcagccaccttctcgcggtttataccgacggtgaacgcgcggttcgactacggcgtgtccatcttcgtcatgacgtacagcttcgtcgccgtgtcggggtaccgcgtcgacgacctggcggcgctggtgctggacaggatagccaccatcgccatcggcgtcatcatctgcctcgccgtctgcacgctcatctgcccggtgtgggccggccaggagctgggcctcctcaccgctcgcaacatggagaagctcgcgtccgccgtggaggcctgcgtcgaggactacttcgccgaccccacggcggcggcggccaggtcggaggggtacaagagcgtgctcggctccaaggcgtccgaggactcagcaggccgcgcgatgggaggcccccgcacgggcggttcggcttccgacacccgtacgaccagtacgccaaggtcggcgccgcgatgcgccagtgcgcgtgctgcgtcgaggcgctcatcagctgcgccggcgcgtcgtcgcgccagcgagccccgcccccgcgtctcctcggcgatgcgtgtacgagggttggcgcgtggtgcgcgcgggtgctcaaggaggcgtccgcctgcgtcgccacgatgacgacgtcccggggccttggcttcgccgtggcggagatggacgccgccgtgcgcgagctgcagagcgacctgcgggctctcccgcccatcctagccgaggaagcgtcggagacgtcgctggcagaggtcatcagcacttcaccgttgctctgctgctaagcgaggatcgagggcgtcgtccacgccgtcggcacgctggcgacactcgcggggttcaagccggccgacgatgctgacggtaccgataagccagaagccgaggtggcacgttcggacgagtcaccgcctcaccggaaaatctggcaaacacgcaccttgaacagagtgaacattttagcaagtgacaaaaaggggtacaagctgctagtaggtgtcaaagcagaacattttagcaggattccaatttcaaaaccgtggtgcagaggtgcagtgctgcaccagtacgtatctacatgttcaaacgttggtctctgcttctctgggccttagtgaagaactttcggcccaagccaaaccaggctttggtgagaaaatgtacagcccaagatcagatctggacttggacagaaatattaggcgggcctgatgctgatagcttccaggcagcactggtctttctattagcccggtgtctactctctacaacaatttcagtttctaaaaaggaataagttcacttcatgaccctcaaaagagacccgaatctaatccatggccctaaaccgcaaaaccggatatcttcacccccaaactattgaaacgtcagcaaaaccaccctccaaaa

SEQ ID NO: 68813 - DNA, 28590 bp, Oryza sativa
gcgcctctcctccccggcgccgaaccaccgcccgcgcctctcctccccggcgccgatgccgccgtggacgccgtcacccgcgccgctcctccctggcactgacgcggccagccgtggacgctgccgcccgcgccgctcctcctaacgacggccgctcctcccgacgacggccgctcctcccggcgcccctcctcggctcctccccttgtttgctttctctcatccccaaagcccacgagctaaacgagctagctcgagcttgctgacgagccgagccgagcttggtttctagctcgttaggataacgagccgagccgagctagctcgttatcctaacgagccagaccgagccgagccgagccagctcgacatccagccctagcccccatagcattgtaatatgagagcaactccaatacaacttcggcgcatcatcacccttttacttttctcgttttccgacgagttcttcgcaagaggtaacccgtctcaatggcctgtgctatcggggctaacatgtcgttttagacgtgttaggctcgatatcgcgagtcattgctatcatatgtcttgctatattagattagctaaggcatctaccatcctgaaaagtgtctaattgcttgattgtctagactgcatgtttcttttcatattttgagatgcatcatacctagtcatgcttagaaccgtgcaatctagcctgcaattaagcataataaggatagtatcggggtttcggccgatcttacctaatatgcatgtttcactctccttgtttcatgtatattcgccacttatatagatagatcttttgtataagcatatcaagttttagtcagtgtcggttagattcctacgccttcatgcttgatttatgtttgatatgtttatatggatcaatctgcctatataagtttgtactaaagtattaactagtacgttatctctcttgctctaaatactgtcacattggctactttcataataccgttttaaatcaatctgttaaactctatagatagtattacaggcgattgggagtgtttagggtttattattctttgacatatccagtccatagccgatttggtctaactatatcggctgagaccatcaacgatatgctatcggcctatcggcagatcggctatcggtcaattgattctgcttttattctttcttgctgattgcaagatcaagggcttgtttggttggtgacctgactgacttgcctgagaaaaatccatgcctgtgtggtagaaaagctgtgttttattgtgcctgattaggcatgtgtgatgttttgttgtttggttgaaaacctacgcctgagtgaatatattatatataaacattttgtttacttgagtaagatgttgacaagtgttgatagcagtcatatcaatgaagaatcaatgggggaggattagacacatacccacgcctgactcaggcgttcatttttggtggcctgagtccggcacccttgcctgagcatggacaccattcagggaagcaaccaaacactactacttactgctctggctagctccaggccaggcaaatactcgccagggcagcaaccaaacacgcccaaaatcagctggcatgtccttgagacactcgaggctagccttggacctgcactggagttaaacagatctcccagacagccgtgttttcacacaatgcacacgtcgcatagttggaaagtctgtgactttgtaatctttccgaatttcagacccggttgtgaagcatcaccaaatgaacaacctgcatttgttgggccccctttctagcattccttcgtaccaaacacgtaaatagaaaatcctatggagagagtaagcagaaaaatttgcatcaccagatcatttccactagaacattagaaacactagtgacttgtccgtgctaacgctacgataattttaaataatctttcatgtatagcgtatgttatgaattaaatttaacatttgcaagaatcctatatacctatacaagtcatccccactaagtgcaattaaaactaatttcctgtgctgtggttgttccacgtcatcccaattaaatctggccttaggatcgagcttgaacgtgctagatcagtcgatggaagcacagcccatgttcctttctttcctggcccatctattcatcgacccattaattccagcccagcgagtctcctgtcacacgttccccattctcattagcaagcatgagcgccgccggtagcaacatcaattgaccaccgcctttccacatcccctttttctgacgctgcgtttccccttcctgcaaccatcgatggacttcctgaactgtgtctagaatctgattcgaccgcatggcaagccatccacacactgacgttgtgacatgaggaaccgataggagatggccatgctacgcttcgcttggtggtttagtttcatttgtgagtcatagatcccctaatgcatggatcactgtatggttatataggatttgatccctaactcacccggccaaattacttttatcttttgtgaagatgcttttcgtttgatcacttaaatcttctttcagatgttagtttattttgattgcttcgagtaatcaacgttgcaccggctaattgattttttttctctaattgctttgctttgtaggccatatccccaattcatggatccgactaccattcacaatttttgttttcttatcctgcagggttgattggatgggttcatttgactctagatgagacaatcaggtatttgtgttttagtaagcaattgatgcaaatatcaaaatgatctacttcgcatccacttagtcttgcttatgttccttttcttacatgttaatattatgtgcatgaaatgcaccttttgttgtttctgaatttcctggcctccatgtgcaccttcaatcgaattttattcagttgctatatatatgcaggtcacttcgcaatcctgcaaatacttaacgattggttggagaaaggtacaacccacattaataggagtgcaacaaggaagtgcttccataagtgctcctattatcctccaatcttgataagctccttttctgcaaatgttcctcggactttgtaagcagaaaaggtggattttttttctttggttaggctgttcgggatggagctgaaatacatgagaagaactaagagataaaacagaaaatgtagatgcgggaacaagaacaggtaggtgatgccttaattattgtcttattattcatttcagacggtgtatgcaattgtcaaacttgcgtctacctgcagctatactaatccatatccctttcatgaacatttcttctttgatcctttgattatctgtgttctttatatgtcaatttctaaatatcttggtaggttgctaaattttaatcctaatgggatcatgttttggctgcttggtgtctaaccacatccatctgttatttatgtcgctgagcagcgtgcccaggatggctatacacaagtcgacttcaagaaaatgtgaagggctaagaatgaggtatttttcttatccatttagtccgttgaatatgtttgtggtaggtcctctccatactaataaagacaaacatccttatctgatacgtactccctccatttcaaaatatttgataccgttgactttttagtatatgtttgaccattcatcttatttaaaaaatttaagtaattatttattttttccatatcattcgattaattgttaaatatacttttatatacacatatagttttacatatttcacaagtttttttaataagacaaatggtcaaacatatgctaaaaagtcaatggtgtcaaacattttaaaacggagagagtatattgtttgatttgatttaatttatagcacctgcatccatccaatctaaacggacaactaaaattttcgacgagtagtatatagatattttcacctgtatgtatttagcagtttttagaatatccgttgcagtgcaagaccacggattagtcttaattggaggtttagtttttactgtggctaatattttgcactgttgatcgactgtctgttcctccacatatacgagcttagataatagtagaattattggttttaacttctacattttctctcatgaactttctatttgatttttatttgactttccaattaaccgataaatttttactgccaacactaacatcaattttgtgtataagtactacagtgttttgtgatctaaaatcatgtagagaaccacagatagtatatatatttaaaagttatactccctcctttcctaaatgtttgacgttgttgactattttaaacatgtttgatcattcgtcttattcaaaaacttttgtgaaatatgtaaaactatatgcatacataaaagtatatttaacaatgaatcaaatgataggaaaagaattaataattacttaaattttttaaataagatagacggtcaaatatgtttaaaaaagtcaacggcgtcaaacatttaaggatggagggagtacaaatcatagttataattcatattatttctttatctgtgtttcatatattgtgatgcatcttatttttcgctcatatataccgcagcaacgcacggggtattatctagtttgattatcttttgaagaatcaatgcctagactttgaagttcctaaaaaaaggataatacatagaatccagacgaccgaaattctagtattagatagacgagtttctgatttattgtttacattgccaccttaaggacactattgtcaggttaaggtatgtcagaatatgagacaataggatcactgtatctagaatttctaccatcatatgtgaacaacataacagtacaatagttataattctttttttacaaaatcaaaacataaaaattattatagtaaagacttattagccataaagctcatgtcattcatcaccgtacatctacaatactcaacaagtctaaaattacaagaagctctttacaccaaacttacactttcttctatcaaatgaccacccaatccaccaccataaaaatacgagaacttcttttagtcttgaatgcccagtagaatttctatagaaaaacgcgcatctgctgcttgtcacagtagattggatttgacaaacaactaacaattctatccgacaacacacatttgctaaagcacaatacatgttaagacaactcatcattgatcaaataaatttgttcaagtgtcattgcacctggtaagagctgccagcctactccatacatgcatattttcttgcttgtagaactgaaaatagaatcgttcattattacatgccagaggttgttactatggttgcaaacctttataaataattttaccagttaattaacaaacaactttaatttggctcctagaactaattgtaattatacatgttctaattttactacacttcagctttctaaataacaatagcaaggaaattttactcacaaaatacacaccagtgaggaaatacaatctaactgtgatccttgtaagtgctatctactgtccacaaatcgtatagagaaatgcaccttttctgcaatatatatgatatatgagatcaggtattcaggtgaagaggcaagaataacaaaggagacctgcaccttactgtacattatattgtgcatgctgaagtatcaccgaagcacattatattgtgcaatatcagatcaaaggcaaagaagctcaccctcgacaaaagaacctaaaattcagaccataagttcagaaggatcaccatagtaaacaatatgtaaaatccaaaaccgatgttagcaaccatgtttgctggtcagacccaaggcaaacaggccactgaagacagactcaacgttaccatattcataaataaattttgccctttataaccttgagggtacagtgcatgtgaatattacgttaaagagcaaacgctatcaggtaatggtgggaagggaatataagcaagccatgcatcagcttgcctgcaatacatgaataaactgaatgcaggagctcggatgcatgttagtatggcaagtcagtcttatgaagctgagatgatgaatggagcttttaagtctaaaccacaccattcactttgacaaatgtgcagtattactcatgacctgcaattaacctaaacgacaatatgtggttagaactactcaaaatacagagttccttacaacctaagtgaaatgctgcatacaaacaaacaaattttctcaaacaaaattgtaataatgaacctaaaagaatttgaaagagctagcacacttatgctcctgaacctttttttttttgcaaaaagtgcagaacacaatgggtcgcaattatgctcggaatagcaagattaaacacagcatttccaatcgcatgcatagttattcaaatttatccagtacaaatgaaggcaaatgcaggggggaaaaattagcagaaattccctccgctgacctcagaaatggccttctgctgcagcctgcataacacatttcagcagcagagaatcacaagttcataactatacatctagcctaagagtctatcaatgatgaataaaaattgatgtggttgatagaaagaaccacccaagtacaaatagaaaattgcatcaactgctcattaattacagcgaaacctaaatctacgggaaatagcacccttgatctgggagcttaggctagtaaaatgcatacaagattatgggttaaaggtatatggtagcttttgtgccttgttaatgaaccagctatatacataaaatcagcgctgccaagctaatcatcaatgaaaagtgaaataaaagggagaagacatacatgcttgatgcttcataggacatcacatttatggtcatattagggatggggatcagctagaaggtggatgggtggtggagtagggtttttgtacctcttggcgttcaaggcggaggcggtggcagcatgccgatgcaggagtccgcgactcatcagcgtcgcagatcggcgaggcaagggatggagtcctggcggtgcgtcggtggagcggatcggcgaggcttgtcgatggagttatggcggcgcggacgagatcagcgaggcggacacctaggcaatgacgcagatgcagtccctagcgagctacacctcaccgactataccctgaatttaagaaaaatggagaactgaacacaactggatcaaatagcttgttctaatatgcaagatgaaacacataaatattttgtcaaatatcgattcttttaaaacagtcgtaagaaatttcattaggagaaattttatgtatctgccaatgttcatgcttatgctctaccaactgcatattagaagtcctgacccgaactgacggcaaactcaaagttcagtagacaaagcaaaccagttcatcctttaatttctccaaagctgcaagccaagaaaagccccaaattcctacctttcttgacatgctcaaggcaacagcaaacacacctttcttgcattgcatgagacctataaacctaaactctacatagcttcatggacaatgcaaacaacttggatctttgcatttctaatcgagcttatcaccccaaaggcagccatgtccggaatgggatcgagcaatgctttaccttgtccgcagcggtacagaaggcggcgcaagatagttggtggtggtggtgtcgaaggcgaaggcgactcgcgacgcggtcggcgggaggcgctcgctggagaggggcgcgggcgttggaggcttgtcgtgacgcggtcagcggggaggggagtcggaatcgacggcggcggcggcggcggttggcgtgagagggatggcgcgaacaacgcgcgcggcgcttgagacggcacgacaaggttgtggcagggaagagagaaggaggtggcggcgtgctctgtaggttgggcgaggaatctgggaaccgaaaatcacgcacgcagcgatgagcggttgaaggtacgttgcggtgattttcagtcggtgtggactgccgccgtcgcacgcattcctccccgtccacccccacagccgacgccgcacccagtaccgcggcgcccattcccccctccatccttccccctagctgttcgccgtcacgcacaccaccggctgcccccagcacccgccgacgggccgcctcgcattcgttcgcggccgtccatggaggccgccctcggactcctccgtgcgcgccaccggtcgccggctctccctcttcgccacccggcgccgcggcggacgtccaggaagcctcaggagtcaggacctccagaggggagaggcgtgcgtgattttcggtgtgcacggtctcatactgggtgaccccgcgtgcgtgccctgtcgtcggatctaatgcgctgaatgatcgtggaccgttggatatgtgacatgatgaattatgaatgagtaaaacaacttgttgaattatagagcagcaaaagaatagatagattatagggtagactagtgtatcttcctcatcatcattaatactttctccgtctcaaaatataaatccttatattccttatattttggaatgaagagagtagcatatattgaatcgccgtaccgcccggataggaatttgatccttataggtcctctaagaatttgtttttgcttaaaatcatccttgggccacttaatatgccatatagctatttatagtcaacaattctgttagaaaatatctcttttgcccttaatttgtatacaactatacactagtaaagagaaaaccaagatacataaacaacatttgtacttcccattatttcaacatgtgcaaaagaaacttgagtctaatggctattgtatacacttgcaagtatataatttacttttgttttacataaatttctatgcattatctataaaaaaaattcattacgcatttttttgtcttatatatgtgaatgagggggtataagtgtcattcatcaagatatttgttggttatgtgggtcccactatttttatcttatttgagtgacatatgggccccatatctttgttgtaattttttattttccaattttattttttcagatcaaactgtcacgtaagtgtcacgtcaacaccacgtaggacgaaggcttaatcaaaagatccacataagcgtcacgtcagccaaaaaaacggagtcaataacatcgagggacctcgtttccactggttttataagttgggaatgcaatgtatccggttttctagactgaggatgaaaatcggactagacgataaattgagggatctaaggtgaacttattcctaccggaaaacgcaggaggaaggccttcgggctactagccgggtgaaagggaaggattgaaccgtgtgattttgtgacctttcggtagttttctctgttaattctgattattcactgatacacaacgtactaatatatatcaaggtatctgtgtggataagaggaggaacttttgatctctacgagcctatctccacctcaccctcctctctctatctctcctctgggtctaaatgggggtcaacggcatagttattgagaccggaccagtaatcgaactggtgaggctctcggttcaatggttcgctggttcaaccgggtgaatagttggtgtaacccggttcaatactaatcaaatatattaatcattctattagaagtttagaacacaacaagcaaggtagcctggttgttgggagagagttaactccccatggggtcatgggttcgaatcccacccaagcgttttttccctcatttttcccccactagcgcgcgcttcccctttctatcccacattcccacgtgccgattcgaccggttcaaaaggcggttttatttccggtttgacagcggtttttcttcaaaaccgggcggtctgaccggttcactgccgattcgattgcatgccggtcttttacctggaccgaaccggcaagagctttggttccagttttttccggtctgaccgccggtccggtccggtcttaataactatggtcaacggcgacgcaagatagtagcaacggggtggacgacgaggcagcaaggagggagttgcggcgttctgaccggttcactgccgattcgattgcatgctggtcttttacctggaccgaaccggcaagggctttggttccagttttttccggtctgaccgccggtccggtccggtcttaataactatggtcaacggcgacgcaagatagtagcagcggggtggacgacgaggcagcaaggagggagttgcggcgttctggctgcagaggaaaggatcaaggagagggagccggtgagctgcggcgacggaggaggaaaaggagcgggtggggaaggcgacgagggatctctactacatggttttgtaagttgagagatgcgttgtatctggttttctggtctgagaatgaaaattagactgtgtgacaaatcgagggacctatggttttcctttccggcacaaccaacattggacaaggccgagttcaaaaaaaaggaataagtccactttgactcccttaaaaatgacaccaatctaatctatgacccctaaactgctaaaaccggtgtaaattgactcccttaaaaccagatattttgacccctaaattgctaaaaccggtgtaaattgactccctcggcggttttgaaaagcggttttgctgacgtggcgtctacgtggcagtgttgacctggtctgctattgacgtggcgcttaggtggcattagaattaaaaatatgcatgtgggacccatttgtcattcgcatggaagaaaattttgtggggccacatgtcagtctatcccttcctcatcctccccctttctctcccttatctctctctccctccccattcggcaagcggcaaccacagccatttatgccactggatgagcgctgccatggccgtgccttaccgcggtttcgtctcgtccttctccattcccagcaatgcaaccacaaccgtcaccgccgttgtgcggccgacctcgcgtggtttcgctacctcaaccctcagggcactgcccaccaccgcaccaccattcccgaccactccaacctccaaggtcccttttgggtgtgcagcaaatgaaaaggaaaacttgattccttttcgtgaaacgattccgccgctcacacttcttggtgtgcatcaattattccttttgggaaaacttgactttttttttttaaaaaaaaaaagaaaatcatctggctgtggagtgtgaacatcaatgttttctccttccctttcatttgctgtgaattcaatcccctcctcacgaacactcgaacaccatgaggactctctacaagactcggactccaccgccgcattctcgcatggcttagccgtattctcgtttatctctaatgggtcctccgtacacatgacctaaccaaatttttcaacgaattttttccacttttctgactagccgatgcgtccgttcttgattcttgtacgtattcctcattcgtgctgcatagtgagcagtagagattcagactttttttttgggtttgaggatcagagaattgaggggagtagagattgagatcagagaattcggcggtgacggcaggtctcagtcagatttgggcggtagcggaggagctccggcgagctctctcctaggtggccgccgtccccggcgccgtgaggtggccaccactgaggtggaggccaaagccgcggtccgccggcgcgcgccggtcgtcgttcgccaaagacaacccccgccggtcgacttcctccacgatgccgaccctatctcgccgagtgctgcctcgccattgtcgactcctccactccggggaccgccactccagctagctcctatgtcagctcccgccgccgccagccgccaccactccggcccatgcccgccgccggccgaaggggagagagagaaagaaagagagaagggaggaagaagaaagagagagatgacatgtggggcccatatgctagtaggccccataattttttatgtgtgtgaatgactaacgagtcccgcgtacatgtttttaattcaaatgccacctaagcgccacgtcaaccccatagactggtcaataccgctacgtcagcgccacgtcagcaaaaccgctctataaaaccaccaagggagtcaaattgcaccggtttcaatagttcaggggtcgagatatccggttttgcggtttagggtcatgaattagtcatttttcagggagtcaaagtggacttattgcgaaaaaaaaacaatggacaaggcccaaaagcccaaattgcagtgcgtggttgtggttggcccaaacaagtccttcccgtaatcgcgttcgtcatcatctatctcctccaccgcctgatcgcgccgccgccgtctcttttcacctacaaaaaccctaagcccaaaaatctccatcccccccgcccccagagatcccccaatccactcgattcgatccaatccggcgaggtacaggatgctgccggggtcggcggcgccggcggctgggagcggcatgttcgtgccaacgcagacggtgggcacggtgctgtgctgcatctgcggcgtggcgatgcagcccaacccggccaacatgtgcgcgcgctgcatccgcgcccgcgtcgacatcaccgagggcgtcccgcgccacgccgccgtcgtctactgccccgactgcacctcctacctccagccgccgcgctcctggctccgcgccggcccggagtcccccgagctcatgcagatcctcctccgccgcctcaaccgccccctcgcccgcctccgcgtctccctctccgccgccgagttcgtcttctccgagccccactccaagcgcctccgcctcaagctccgcctccgccgcgaggtcttcaacgccgtcgtcctcgagcagacccaccccgtcgagttcaccgtccacgatcgcctctgcgatgcctgcgcccgcgcccagtccaaccccgaccagtgggtcgccgtcgtccagctccgccagcacgtcccgcaccgccgcaccttcctctacctcgagcagctcctcctcaagcacggccaggcctccctcgccctccgcgtcgccgccgcccccggcggcctcgacttcttcttcggctcccgctcgcacgccgcccgcctcgtcgacttcctcgccaccgtcgcccccgtccagacccagaccgccaagcagctcgtctcccacgacaccaagagcaacgtctacaactacaagcacaccttctccgtcgagatctgccccatctgccgggaggacctcatcgcccttagccctcaggtgtcccgcgatcttggaggccttggacctatcgtcctctgcatcaaggtcaccaatgccatcgctctgcttgaccccctcaccctgcgtgtgcaccacctcgaggaaaagaagtacagggtctacaacttcaaggctgctctcaccagcaagcagctcgtcgagtacatcgtgctagacatcgagcacgagtcaccagagattaccattgacggatctcgctaccagttggcttatgcccaggtcgcccgggtctccgactttgggaaaaacgacaccatgttcaccgtgcggactcatcttggccacctgctgaatcctggagaccttgcccttgggtatgatctttatggtgccaacttgaatgatgatgacatggacacagctatgatgcgccacagtctgcctgaagtcattcttgttaagaagagcttcgccaagaggccacgcacacgccgatggaagctgaagaggcttccaatggaggaagatgctgtaaataaggccaagggggagctagagaagagggctgatgagtatgaggagtttctcagggacttggagcacaactctgatattagattccagattgatctatacaaggatgaggactacaggtcggagatggcatctactattggtgatgatgttcccactgtgccgattgaggaactaattgaggacctaagtcttggtgatgatgaggaggaggatgaaggtggggaaggcaaccaacatgctgttatggtgggatgagttaatatgtttacctgtgctgtgcttctgccttctggtgatggttgctgccaaccgcagatcataggtctgaactgcatctgtttaatccgtataagttttgttctcccctttacttctataagttataagttttgttgctaaattgtttcaacttttgctgtttctcatgatagatgttgtatcaccttatcctgtatctggtgttgcagcttggcttaaattatatttctctattcttattgtctgtgatatgttgttttcttgccatagtgtggctgatcacaacatatcttaaaatagatgcattgtttgatttccaaaacatctagtttggtgtttagattgtgccagattcatatttttactatatgtttttagtccccattatgtggtttgcaagcgtggaatatgattgtggatttatgctgagtcatgactagagaattgtaggtatgacctgaaaacgtctgccatgttgagtgtcactccaataaattgattaaaaaactaataaagataagtgtagtataatatcatacccaggagccatgatgagacaataatgtgcatttttagtgattgcaattcaactgctgctgttttatcaggcacttcattcagactatgcctacatcgtgcaataagaggttagatatgtagagttgatggacagaacagatggtgctccactaataagcgatgagtactggtttggtaaaactttaataagttaagaattttacggatcttttttttctattactttcacaaggtggtgctgttctcaaacctaatgacttataatcgtaaaaaaaaaaaacttagattttattcaaacattaaacttctgtttacccttgatttctccgcacttccatttatcatgtagcatagcaggctgtggacttgtatccaacatttctgtgtgagtagtttcttatgcttcagaatttttagttctaccagccgaaaagtttacatatttgtgccattttgatatctataattatagttctacattagagtctacataagataaaagttccactgagctaaggcatagggaatgaacgtgcacttgtctattattgacatggtgaattgagtcatataaaattcaccacccatgcccctgtgcctcttgtattttggaactgtggattgtttcattcagttctctggaatgaattgacccaacagggtgcactgtatgttttttgctcctattcattgcctcttatttatttacttatggtgtagttttattagtttcaatagtaccagtagatgattcaagttggaatgaaacttgctcagcatgaaatcctatttttctgtgattgtgaaattagaaatgttgcttggtgataggtgtacatccgttccagtcgggccatattctgtatattccaagttttgtgtagtactatatattttagcgtgtaagaactagtaatgggcccttttttatgtcatgcacaaatgcatttgtttactttgagcttttgtcaataatatacatgcgtggttggtgtggtccgattaacaatcatctgtgtttgagctcaaaggtatgatctctcggaaagcagagtttacaaatatatatagagctgcgcatgcttagctttgagtttcctgccttcctgggcctgatttgttggccttgcgcgggagtggtacgtgacttggagcacacaaacaaattgaaagctttgctgcttctttcttgtgataaaattcatttttttttgtgtcaaagtttacattttggtgtggtgtggagaaacccttgccatttggcattgcgtatgactaaccctgatgtgaagagaagttttcgtttcaaaatttggaaacatgtttgttgcaagttttgatctgattactagtactagtactcgtgctttacaaaagtaggagtattggatagaccattgaattcctgtagcagagtctattctgaaatcctggaatctggacatggtgcttgccggttcatttcatgtggacgccatatcgtcctgcatccgaaaatggtttgcttcgtaggatcgttattttgcttgttagtgtgtcgtccactggctttaacgcaccttttgtgaattgtgatgattcacttttggagtacgaaaagtcccatcattcagctaatatctacatccatcattcagtttaggtactagtagtgactcgtaaacaattgtcgcagcaaaatggaaattgataccaaactaattttctcatttatgccgtcgttacattgttcttccaacaagtattaatccgtgttatatactccagtcacggacttgctacatgaacgaaaagcagcagccgggcgatgatagattacatcacggctgacgtgtactttgtccgggagacgagtagaaaaggacaagttgtatttcttcatctttctttggctcgtgccctacagtactccgcggctgcctgccaacccggtaatcgcagaggcaggtcatcgtcggatttgatcttgacggctgacccgtcccgccggcggtagctgcagccagtgcctcgccccccttccatataacaccaacctcctccgcgatcgcaatcgccaccaaccccatcgagaagcagacgccaccaccgcgattcgaatcgccgccgtctcaaactcaaaactcacaggtaagttcccctcgcattgcttcgatcttgcctgccctcgatccctcattcgatctgtcgctttgaatcaagatttttttgatcgcattttcatcagatcgatcagatcatgggggacgtggtcaaggacctggtggcgggcaccgtcgggggagcggccaacctcatcgtcggccaccccttcgacaccatcaaggtcaagctccagagccagcccacccctgcccccggccaattccccaagtacgccggcgccgtcgacgccgtcaagcagaccatcgccaccgagggccccaggggcctctacaaggggatgggtgcgccgctcgccaccgtcgccgccttcaacgccctcctcttcaccgtcaggggccagatggaggccctgctgcgctccgagcccggccagcctctcacggtcaaccagcaggtcgtcgccggtgcgggtgctggtgttgccgtctccttcctcgcttgcccaactgagctcatcaagtgcaggtagcttttactcaccattgcgtgctaaattcctttcatctggtggtgactgcactgttcattttcactctgagggtgcctgagctttgcatcatcgtctgtacaatagatcaataggaatcccctggtaatgagcttctctgaaattgccctttcctgcacatatcattcttcaccatcagccatgttactgcgatacactcgttcaagtgcatttcacattttcgttactgcttgtcacttccactgcattgtggctttttttactcacgccactaaaagttaatctgtggacttattttttcctattgagaccacagcgctctagatcaaataattccagaccaagtttcccgataaaattgacctttttacctgaaacaggtctgttcagtgcagacttgcagtgctcccccccccccccccccctcccttcagcagcgagcgatacacttctgcagtgtgcatattcaaagggaataaagacccttgtgctttatatgctcttttgtaggtttcttgtgttttctgatttctacttgatagggatatatgagttttgcgcctcagttctccagagaaaatgacaccacacccttcctgttgaacaaccatatacatatgttaaatgctgtaaaatcaaatcaatgttgtgaactgccgcagtgcagtaacttatttaggttgcgagtcgtcgtaaacttgtgcagtaggctcattcaaacactgatccttgtgctttataggtttttttaagtgttcttatgttttgtgatatctccttggaagggagatgtaaaacaacaaattgaataatttaacagtcaaaaacatgccttttactcctattctatcttgtgtatgtccttgaaagggatatatgagttttgagtctcaattctctagacaaatgacatcagactgcgttttctgaacaactgtcctttttatcacaagcatacttctaaatatgttaagaaccatagatggttgctctatcaaatcaatattgtgagctgttgcaacacaatacttatttcggttacaagtcgtcatacagttgtgcagtcggcacattcaaaaaccatatcatgtgtattttatttgcttttaagtgcagctcttatgttttttgatatctcctacctgaagaattttataacagtaaaaaacatcagtttactcatattccaatttgctttacccatttgcaggttgcaggcccagagtgctttagccgaggcagctgctgcttctggcgtagccctacccaaaggaccaattgatgtggcaaagcacgtcgtcagggaagccggcatgaagggtttgttcaagggccttgtccctacaatgggccgcgaggttcctggcaatgccgtgatgtttggtgtgtatgaaggcaccaagcagtacctcgccggtggtcaggacacatcaaacctcggcaggggctctctcatcctatccggaggccttgctggggcggtgttctggctctcggtttaccctaccgacgtcgtgaagagcgtgattcaggtggatgactacaagaagccaaggtactcagggtcagtcgacgctttcaagaagattctcgcggccgatggagtgaagggcttgtacaaggggtttggacctgccatggctcgtagtgtcccggccaatgctgcgacattcctggcgtatgagattacaagatcggctctaggctgattgattgctggttccaatggccatttctatctcttatcatggttgaaacaacaaccaggctgtgcagttgagggggggaaaaagcagcagtagcagttccaatcctgttttgcaagtttatttcatctgcaacattgtgattcaaaacattgaagtatggaagatgcaacagcgagcaagatcgctggctctgcattttttgtctgcctgtatgtataataatataagcctaacatgtgtggggtgtgggtgtggagtgagtgtagctgaaagaaactcgtcgtcttgtcggaatggttggcctggagtggattggccatctgacggcgatcccatggtgaggggagtgagtgatgctgtctgtgatggcgattgggggtgcgtttggtgagtgagtgagtgagtggccctggtgttgcttgccctcttggcatccgaatcacctctcctcttcttcttggtctgaatttttttgattccctctcaactagcatctttttaattggctgctattgccacagcccttgtattttagtactgagacctggggctctagttgttttgagccagttgagctgctgcagctttgggtgaggtggaggtaggaggcggcggccgctcccatccttccttcacctccatctatctccaagctcgatcttctgctgaatagtaatttatatttcttcttccttgtataatttcagcttcatgtttatcagttgggtcgatgatgcattggcagaaatctgtgtttcatgttcttcttcagttgttatgtttgactagcaaattggactgcagatcttcagatttgtggggggtggtaattctagcttatcatctgatctgacgtagaatctgaatgcctgtgtggtggtatttctttcgctgaatcctgtaaaaaatgtcggatttttgctgaatgataaacgaaacagatgcaaagattcatgcagtggagtggagaagagaaggaataaggagaagccttgaactgacttgcaatggtgatgaactaactaattgactgcaggagaggagatgggtgacgtggccaaggacctgacggccggcacggtgggcggggcggcgcagctggtcgtggggcaccccttcgacaccatcaaggtgaagctgcagagccagccgacgccgccgccggggcagccgcccaagttcgccggcgccatggacgccgtcaagcagacgctggcggccgaggggccgaggggcctgtacaaggggatgggggcgccgctcgccaccgtcgccgccttcaacgccctcctcttcaccgtcaggggccagatggaggccgtgctgcgctccgagcccggcgcgccgctcaccgtcagccagcaggtcgttgccggcgccggcgccggagtcgccgtctcgttcctggcctgtcccactgagctcatcaagtgcaggttcgttttcttctctcctgaggaatctgtctacaagaaagaaatggtgcctgactgactaactgcaaacgtgctgcctaattaaccatcccaaattgaattagcctagcgtttccgcaattgttatgtgctagtatatatatcaatgtgaaatgacaataaagtttctcatcagtcaataatattcagttttctttcagcaaacgaaacaaagagaagatattgttgagtgcatatttgttttctgaaaaattggagtgttgacttcataaaacagagtgtaatatctttaagcagagagcggaataagcatcttctttttaccatgtctactcccgtctccatgcaatgtttgcaacaggaatgctgcattcgttcatcgatgatagtctgattatctgatagaccaaaccccttaatgcttcctactagttcctagtagtgatcattactcaatatttgttctcactttttttaaaaaaaaaaatccatcattactcaatatttgaacaaacaattgcgtcagtacattactgtacacttacagattgagctccataatctgctgttactgcattatagagtagtaccatgtatcgaatctgcatcttgtgctgccattctcaatgtacacctcttgctcttggcatcacaatgcactaaaagtgcagaaacatacgagttacgggtgaatccaatcatcttgtactgacacttagctggttggtttgttgtggtgtcaggttgcaagcccagagcgcgttggcgtccgctgctcctgccgccgccgccgctgccgcctctcccgtcggcggaggcgcggccacggcgacggcgagcgtggcggcggtgaagtacggcgggccggtggacgtggcgaagcaggtgctgaggtcggagggcggcgtgggggggctgttcaaggggctggggccgacgctggcgcgggaggtgccggggaacgcgctcatgttcggcgtgtacgaggcgatcaagcagtacctcgccggcgggcaggacacgtcgtcgctggggcgggggtcgctggtggtggccgggggcctcgccggcgcctccttctgggggtcggtgtacccgacggacgtggtgaagagcgtcatccaggtggacgactacaagaaccccaagtactccggctccatggacgccttcaggaagatcctcgccgccgacggcgtcaagggcctctacaagggcttcggcccggccatggcgcgcagtgtccccgccaacgccgcctgcttcttggcctacgaggtcactcgctctgcactaggctgaactcatgtatcattacatcctcctccttcttgacccttaattttcttcttctgattctgattctgattcttgctgtcatccatctcatctgtggatgtaagaacagtgtaattctgtacacacaaatactatctttataaaaatttcctagatcacacaaactctctggtttagtggacttgttccgttggtgaattgttgatggtgagctaagcatggtaattctgtgatgctgttcggatgaatcgaaagggaaaaggggtctgcggagccgcatgcacatatatactccctctatgtatatccagattacagtattaggttgttttcttttgaacggagggagtacataccagcggattatataaactaggcagtgccgtagtaattaaccatcgccatcgccatcgagctcgtatatatcgtcgtcactctagtacctgtattacgtactccctccatactcataaagaaagtcatttagaacaatgtttaagtcaaaccttaagaatataaatcatgaataactcttaaattgttgagtttgaaaatgtaaagattatatgagtagatttgttttgaaaaataatttcataaaagtatacatgattacatgtatcacttttcaataaatatttttatagaaacaagaagtcaaagttgtgtagttgtttaaaataactttctttacgaggaagaagggagtacgatcgatgaatggaagctaaagctcaaacaacaatttatcgtcccatgaaagactgactctctctcttttgtggactttcttttgcgttggtacttggtaaggatgccgctcacgcatgcagggccataaattgtttggagatgactaaaaaccgtggttggctagttaattcaactcttgttgatgcagttctcacgaatccaaacggaaagggacgcttaacggcttaagttgacatctcatcagaggcaggcagctggctctgctttcgtcaggtaccacttaaaagataatatatattttcatttaattaatctagcaagacaggatggggtggtggcgcagttggctagcgcgtaggtctcatagctaaagcgagtgatcctgaggtcgagagttcgagcctctctcaccccaactttttttccgcttatttttttttgcaactccttaatccttctgtgacacaaattacatttttattttccttttctccaacttcttaatccttttatgataaaaattaattccacttaatttggaaatccttctgtgacacaaattacatttttgttttccttttctgcaacttcttaatccttttctgataaaaaaatattggccagtttgagattggtattagaccattcccaatagccatgatccgaaactgaaccagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggagaagtcgttggcgaagtcacaaggcactccacttttcattataaaaccgataaaccagaaaaagatggattattttgcgaaagaatctttggacccataaaaagcagaatttgtgcttgtggaaattctcgagcgagcggagctgaaaacgaagacgaaagattttaccaaaaatgcggagtagaatttgttgattctcggatacaaagatatcaaatgggatacatcaaactcgcatgtcccgtgactcatgtgtggtatttaaaaggtcttcctagttatatcgcgaatcttttagataaaccccttaagaaattggaggggctagtatatggcgatttctcttttgctaggcccagtgctaaaaaaccaactttcttacgattacaaggtttattcgaggatgaaatttcatcctgtaaccatagcatttccccctttttttctaccccaggctttacaacatttcgaattcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagttttttttgattagacgcatgcaattggcgaaacattttattcaaacaaatgtagaaccagaatggatggttttgtgcttattaccagttcttcctcccgaattaagagcggaacgaaaaggattttccctgagatggtaaatgaaaacgattagccccatacgaggtttgggaataagtgatgagcaaggaatatacgtctttctgctaaagaggatctattaaactcataattcattagatctttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctaaatggttaaagcgcccaactcataattggtaaatttgcgggttcaattcctgctggatgcacgtgaaccggaacgttccataagtctattggaactggctctctatccatggaatctcatccatcatccatacataacgaattggtatggtatattcataccataacataagaacaataagaactcgaattcttatcgatactggaactcagagcataggagagaaagtcgatttatggatggaatcaaatacgcagtatttacagaaaaaagtcttcgtttattgggaaagaatcaatatacttttaatgtcgaatcgggattcactaagactgaaataaagcattgggtcgaactcttctttggtgttaaggtagtagctgtgaatagccatcgactgcccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgattcaatttgactacctctacaggatagacctcaacagaaaactgttgagtaacggcagcaagtgattgagttcaggagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagacccccgggggaaaatagggatgtctcctacgttacccataatatgtagaagtatcgacgtaatttcatagagtcattcgatctgaatgctacatgaagaacataagccagatgacggaacgcggagacctagaatgtagaagatcataacatgagcgattcggcatatttggattactttcctatatatccactcatgtggtacttcatcatacgattcatataagatccatctgtctagagatcgtcatattcatctagaaagccgtatgctttggaagaagcttgtacagtttgggaaggggttttttgagagaaaagaagaatctacttcaaccgatatgcccttaggcacggccatacataacatagaaatcacacgtggaagttcgagcctctctcaccccaactttttttccgcttaatttttttgcaactccttaatccttctgtgacacaaattacatttttattttccttttctccaacttcttaatccttttatgataaaaattaattccacttaatttggaaatccttctgtgacacaaattacatttttgttttccttttctgcaacttcttaatccttttctgataaaaaatattggccagtttgagattggtattgaactgctccgatttgagaattaagtttggtatcgagctgttccctgcgaaatcaccgtggcaggagtgttagggccctatcaatgatatatgcatgcatgcatgtaacctgaatatgctgggataactgaagccatgcatgagttgtcaaaggtcgaaccggttgtctattcagtgcgatcgatcgtttgttggccattggcttagaaaggagtttcagctacacatttttgcacttcatcatcttgcaacttgcaatcatccactcaaaaaaaaacgtacataagcatagttccccaccaatgtttgcatccccaataatcattatgcctttctcccactactacttccactcctacttcagaactaacctctgaataatctgaacatccgacctagtactcaactactgagagattgcacgtgcgtcggatactcagagattgctttgcttgcattgtaatctctttccttgatgcaaattgtttttgttaggccctctttatttatgcttaggtttattggcttaaacttttaagtcagtttattggtttatatgatttataagccggtggatttaatgtcctaagtttagtggtgaagtcatacatctacctcatataagccaaaaaaaaaaacttctccaacctagcttttggcttaatagtgtttgagtgtcttatggcttcaaaaaaagccaaacgaataagttgcttgtttgtttatgcttagattttttagcttataagttagcttataagcctaaacaaagagggccttaaaacagaggtggaactttgttctatttttatatttagaataagagaattaacctaatttataagaaaaatcaggcaaccatttgatgcaaattgttgatggtctcacaacatgtaatggccaatgggacatggggcttaatttgaaacataattgttgttacatattatctgcttgattatacagacaaaataaatatttttatagattataaataaacttaacaagtagtaacttatagcaagctatagtagaagatttttgttttcgagaaagaaaacaatcggttccaataattaaggctaagatgagtgagctagctcatctggctgtcactggctgagctgaaactgaggcccaggagagcagggagtcttttctggctttgatagacagtgccatgtgagggtgcaaccgcctcctatcctactcccctttaatacccttcccttatcttctctaccaccacagccgcggacacgactcttctgcgatagccgcatactccatccgtcaaaaaaaaaataatctagacaaagatttaacctcacttaggacaataaatctggacaaccttatatccagattcattgtcttaaatagtgtcacaccacctaggttgtctttttttagatggagggagtatgtagtaagagtcactgacatatgaaccctagaacgagggaggctcacatattagtctgcactactgcagttgcctaatataaatcaccatgcctaaatgttaacaaaaaacatacttcttttgtaaatcaccatacctaatgctgctttcattgactaatgaaactgccatgagttttgatcagcttgctagctgcaatgctgcattgttcattcggagtgcacatccttttttggaatctcagacaagaagttggcatcaatcgaatcgctgtgaaaagaaatgtactgttcgccattggctttgactgtagctgcggtcgcaacgcaatgttatgcgctgacgtggatgaaagcacaaggaatctggtgagagaggcgatgtatcgattcgattatgaaaggaaataagacgaatggagatgcagagattagtcttttcagtgatgccatatcgctaatgaagaagcaatgggattggttcaaaggggatccccactaatggcaagtggagcacctaaatatactttgctgctcctaagcactctctgctttccaaccaagaaatttgcctctcgaatcttttgatttttcatatgtagtaagtatcttgaactgatttgtgcgcatttttccccctccatttctctctctttctcttggaaaagtagaacaacaaacaaggaccaacttgcaagctttttctccttcattgtctgaatctttaagcatatattaacctatcgatcgatggcattacattatactactacatgatatggcttctggaaggaacacataaaaggcagaacaaatctattattaactaca

SEQ ID NO: 68814 - DNA, 1816 bp, Oryza sativa
caccacccctagcggcgtgtcggcggtgaggctgagtacccactgctagagcagcggctgacggccaacatcactagagtttgaagagctagggcgccgccgaatggctggagaaaggatatagtgatggtttgtttggggagcttctaactgctgcaacttctctcagaatcagaagctccgcaaatagaccaacttttggtccagattctgagaagatgtagttgtagaatccaaaagctcccctaaaaacttttggaacccagcttttccagattctcaaaaactggctaccaaccagctacttctcagaacttaagctcccccaaactagcctagggagggtagctggagagggccgggatttccggtcactggcgagatggagagggagggcaaccggaggtgggaagcggattcctgggcattgctgcagcggatcaatgctgatgggaattcgtcaaccgaatgggaacgagagagagagaagaggaaaccgatggtctttctcaccaggtctctctcctcctagccttatggcctgagaacgtgcgtcgtggactcgtgggtgcatatgcacgaaatagtatttccgaagcgcaaggggcttctttgactgattttaacaatggttattgcatgtgttcatatgtgctttgatgcgtcaagaatattaaaatcattttaggagaaaagatatataattgataaatactagtacatcgtatggtagagtaagctgctgaaagtgcaacatcaaacatggacatgttaacatattgaaaacgaatagccatgggtaggaacaaaaaggagttggagaagaaaaaacgatgagagaagagttggtagcaacatttagtaggtatcacattgttttatttggtaagaagaatagtttagatccaaactgtaaccaaaacagtaatgaagttgccaatcaacttataggacacaattttttttggcaatctaaaatggcctgaatttgctgggattttacgagaaatatagcacaagttgcgttcatgaaaagaaatatagcacaagttgcgcgaggtgtctacaaatcgggcatcaggcgctgttccaccaagcagatcgaaaatatttcaatcgtttaaaaagctaaaacacaaacaaatcactttatgaaatattttgttacaacgtatgaaacaaatagttttcaaaaaatcgggtgctgtttcaccatatataaaacaatgtttcagcaaatagcgaaaggatgtttcaattcactgcaacatttgatctatacatagtgaaatattacgagtacacttgctgaaatattgttggtaaaacaaaaattaaaacggattactttaatagaacattttcataatatgtgggtaatttgttgcaacaacgcatgtggtgggacacgtggtgggaacggcacagaggaccaggaggaggtgcgggaaggggctggcaccgatttttatggcgctgatcggacaaccgatccccaacattttcgcaagttgtgttcgcgaaaaaaaaaatattgcacaaattgcgttcgcgaaaaaaaaaagttattcggcgccagtaggcccagtacactctttccttcggccagaatccctttccggcccaactctgagcccagcaccgttgccttgaatcccattttcggcccagcccaaacccatattccaacggtcggggaacccgagcttcaacgcgaaaaaattcgaactcccgcggcggcgcctctctctctctctctctctctctctctctttctccgattcaatggcgactactcgagacctctcggcgatcg

SEQ ID NO: 68815 - DNA, 20167 bp, Oryza sativa
gtgagagagaacattagaacaaaggagaagataacctcccaaattcactgcatggatccatttcacaagatttgcaatatcaaaaaaatgtaaaatagccagcaactagtcaataattaagcagtaatcagttttcaccatttatgcatgctgtaaaaaaacactatttatgtatatgtatgctgtaaaaaaccttgttactaataaaaattaaagatatcatgtatagcataccacaaggcaaattgataaacaatgaattccagcacatgtgcatacaacaaaggagacattagtacttaattggaaacaaggagatgcaggctatcccatgaagttgaataataatcaaaatagtaaaaaagaaaagaactaatacaagcaaggacaaacctcctgaaagagcgtgaggaggcaatcctgttggagcttcacaggtggtcatcccaacctgttactagtccagacaagattaaatatgcctcatcgcattttggagttctttgggatccaatgcttcacacagttaagaatctatatcctgcaaaacacttgtttttagcaaattgaagtagataagaacaatttctttgacaaccagatcagcggacggagaaaaaccatacaagaatgttatgtttaaatgtttccaaaaaaactaatcccagcaccattccaacaaaaaagcaatatcatgttgtatgcacatatgagaaatgccaacctcatcagagtgactttgcatatgctgcttcagatgagctggcttctggaaagaagcaccacactcttggcaggtgtggtcaccttcatgaacaaccttttccccatttgacttgtagatttccgatttgtccagttcttcctatagataaatttgaagtgagggcatcagatattcatataatgattcaaatggataagagcagaaggaattgacaaaagcacaaatatattgattgatggacctaaactccaatcagagaaccataacggtcaaataactcaatttaattaatacagtccacattgtctttaaaacataaggcataatatggcccatattcctaaaatatctaagtagttttataccttatgatgagcaaccatgtgagctcggatgagacattttttggacctaacaaccgtgcaaaattcacacttgtagcgccttatatccctgtgttgtgttgcttcaaccctcatgtctccatcaatatcatctccagagcacatctaatagtaggcaaatcagatagttagaaattcggcacacataaataagtcatttatatataaaaaaaagtaaacaagtaaaacattcagaggtagcgatgtagtcagcaagatagctgtaaaatgaggagaagtccataacatgaactgggacgcattgcagtctttactctttttttgacagagtgaccaaacaaaatacaggtatagcatatctgcaggtcgacatctaaaataaatctctacaattctgcattttcaatgaaataacatcagtgtgttacaactggctatcactaattggttaatcaaacaaatcaaaacaaaactatggtgccttgtcactaacaaaaagaaaaaaatatcagcatatcatcctcagttcggttagaggtcatcaaaggaaagaaaaaaaaaggacaatatgtgtttctagagcatgtgttctccatcagttaacactaatggagatggtatgggatccatcttgagatgcctagccatgatttccaaggtgacataaatttcccttctagcatcatgtgtcttgtcctctaccaaaaattcatggacgacaccatcaacttcaatccaactgcaacccggttttttgtatattttcctactcaacatctgcttcctcatatccaaagcttctttccatctgtttgataaggcatacatgttccaaagaagcacataaaccccatcatccccaggttctctctttataatttccattccagcaatctcagctaatctatcattgccatgagctaggcatgcactaagaagtgacctccaaataacaatatcaggctcgacatccatatgatctatcagagcttctgcttcttctagaagtccaccccgtcctaacagatcaaccatgcatccatagtgctcaagccggggatcaatatggtagacttcacgcattttatcaaataactctctgccttcttgtattaacccagcatggctgcatgctgacaaaactgagacgaatgtcacactgtttggaagtatcccagaccttagcatatcccaaaagagctcaacagctttcctcccattaccctggacagtgaaacttgaaatcatagttgtccatgtgaatgcgtccttcatctgaacttcttcaaatacagaaaatgcactagcaatgcttccactctttgcatacatatccatcagagcatttgtaacaattatattggtggtggcattagatttgcttccatatccatgaatggcacgtccaagatccaaagcaccaatatcagcacaagctgatagcacccctacaattgtaatatggttaggacggtggccctccaaaagcatcttaccaaatagctcaagagcttggataggctgcttgtcttgaacatgaccagtgatcagtgctgtccaagaaacagtgctcttcataggcatctgataaaagaatgacaaagctgaatccacaccaacacacttcatgtaaccatacagcatgctaccccaagtgacctcatcttttacaagcattctatcaaatacagtccgtgcaggctcaaacttgccacatcgacaatacatatcaaccaaagcattacaaacgaccaactcagagtccaatccacaccgaaaaatcaggccatgcaccacgctaccaatacgctgatcccctaatccaccagaggccgagagggcaccgacagcagcaaagccatcagggcggtggccagaagcaatggcgtgagagaacacggatatagctttccagtggtgatctaacttgagatgaagggacatgaggctggtgaaggagataatgtcagggtgggggatttcatcaaacaacctgcctgcgtcagccggtcggccaaactcggcataggaccggaagattttgcaggagatggactgctggttggggtggaggccgtgtgtgagggcctgggcgtggattctttggagctctcttatggttttgcactgggtgagaaggtggtggcaaacgcttctattcatcccccctctcctcaacgcaagaagctctcccgaacagcacaacctggaattagagctaaaattactaggaaaaaaagctacaattaactcatacgacatccacactgcttagactattaacaatttcgtgctgtttcaacgaacactgaccacaagcccagaatctaaacgcacagatcaggatcgatttggttaatactatctcatgcttttaactgctcaaatcgaaagcgaagaattaccaacgcgataaccaaatcgaagaaacatattcctaactcctaagtaggcatcggttttgggcatggtggttgtgtttgcaagcgaggattggatgcccaccttggaatctttgatgcgtttggactggaggagatcttggctgcgacgaggtgtgatttcccgcgcttctccgtgaggaggatggagcggcggcggcggcggcggggagtgaggactggggctcttggttcctcctcgccttcataagcggtcgcgccgaaaccctagagcctgggtgggtgggctttttcgcaggccgaaaatgggccgagcaatttttaagttgggcctgtactgatgggctgacattgctggcccactcgtgacgctcttctcctctggctcgatgacaggtggcccccacacgcggacacgcctcctccttgttgctttccgccggcgatgccattctcgccggagttcgcacgacggcgaggcggcggcgtgcgcacaggcagcggtgaggaaacctctatctccctatctatctatcgccgccgtgcgtttcggctcctgtttgttactgccattgttgatgtttacagtagcttggtggatctagctctagtagttagggatggaaagcaacaagggacactcaaaatgcagccttaaaatttcctctccggcgttgggtagtgttgggatccagcagtggcatggctatggtgcagtagaccttggtgatttgtgttgtacttgtcatagcttcctgtaggactagggttatcatggttgaatctgtagagaacccagaaatttacagggttgatagatgcaacctaccacctggggtgtgatgtggattgtagaaacttccaattacctcgccatttccaccagttatatcaagaacccaagtatcacggtgcctgtcaagttagacaatcttggtatattagaacatagtggttcagatatgtgatgccagcaccattggcattgtaaaaggctatgaagagggccaacacatcagcgatgatgatttacttattctttacctggttatgcatagtgactgctgttatttccttatgtgcggaaccatgattctgagccaccggggttctataatactgttgtctttgttggttcttctttttttttaagctatgtattttaagctccaaaagtttggagttagggccatgagttcttgtttcagtgagctctcttcatttgaactaaaataaatgtttaactcacttttatttcagacgataaactctatattttgcactaattcaagagttggggggcttggagctatgtaacaaaacttaattctttcaaccacacaagcaagttttcaaattgtcaaagttatttgcgaacttaaaaaaagcttgacatctagtagttgattagaataacggtagcctaatgcatacatagacccactacatagctatataattagctaattggttaactgaccaaatatatatgttaagctgtggtattggtggtggactgactacgccaaagcccctagcaactactgggaaacgggcttactatttctgataccaattgaattatgtaattaattttcaaataaatgaactatgctcgtaagttgctgcagttcaacacgctggggctagtaagctttggctgctagggtcactgcatatagaatactggtgaacacactaggtcggctggagggcatcgaggtcatctgaccccggtgatactactgtagatctgcccctcttgtactcgtagtgaaacaagctatttgtgttcatctattcaccacttgatgcttgcataggcaactatacatgtttggaactttgatgatggtgctctgctagcagatgaaaggcctcttgaacacattgaattgttgtagcctcggtgttcatatcttgaggaagaagaggctcagcatggcttgctgggatgttcaacgatgccgccatctcagacatgaatacgggattcatattaatgatgactggtagcgccttgccaccaccaactgcacggtgatcttctccgtctatgatggaattggttccccttcaaatgcatgctctgtcaatgaactctctatcagatcactcgctgactccaagctttttcccctttgcagttgtgcccttatcatctctcttgtagatcaccctggtaacgtgttcaagaaattgatctttagtctgaaattggacaagaatgatgaggtttgtagggatgaagaagctacatgtttggtgtgtgcgctattggtcaagaatcagaaccagtcacttttgtaacaggtaatttatggacattgcaaggtggatggtagagttttttcagtttcactctatttcttctttactactatttttagttccacaacactcatttccttttctttgcgtgagctcattgctctttatttggttcatggtactattaataaacatctgcatgtgcatgttatagattaaacactgaaaaaataaaacattgacaaaattaagaccagacaaataaactatatttggaaagaattggctggtaactgactgcctagctctctataaaaggcctccccaagtcccttcttccattgctgccagcattttgattctgtgtgtgtgtcttggttgcaaaaaccaagacatacacacagaatcaaataataacaaaggtttcctagcctcaaaggatacatatatatagtttccctacaatacaatggagcctgtcaatgatttccaggaaggcatttcaacagagcatgcctttgaggcagagcctgtgccatcattgtcggaaacaataacgccacgatcaatggtggtgagcttcatccttagtgtaactctcagcatcgtcgccatgaaggtcaccttgagctctggcttcattccgtcgttcagcatcccagccggcctcctcggtttttgtgtatcccgtgcgtcgatccgcattcttgactacttcgcagtggcacaactaccattcacacgccaagagaacaccatcatccagacctgtgtcgtcgcatgcacctcgatcacattcaccggtatatagacaatctgaaaatagtagttgatagaattgtgtgcactattttatgtttatctttactataaccgtacttccttacataggtggctttgggacatatattcttgcaatgggaaagaaagcagctgtaggggatgtcaatgcccaaaataacgttgaggagccaagctttgccaggatgatcaccttcctcttccttatcagctttgctggcatgttcatcatcatgcccttcaggaaggtcatgatcattaggcaccggttgacattccccagcggcacagcaacggcgcacctcatcaatagcttccatacacctcaaggtgtcaagcaagcaaggtatcatcaattaaactttacatggaaatgtttctgttggatcaagtactattcgaagccttagattacacaatcaaattgactatttgtgtttgcaggaagcaagtgacattattgtttaaatcgtttggaggaaccatcgcatggtcgctcttccagtggttcttcgcctctgggccgggctgtggcttcaaattcttccccacatttggcctcgaggcatataaacacgggtacgcaatcagacatgcatggatggaattcatcagctagcgtagtggttgattgggaaactaattttgttcccttttatcagattcttcttcgatttcaccatggccaatgtcggcattggcatgatgtgcccgtacatgatcgtgttctccgttttcattggcaccatcatctcgtgcggtgtaatttggccgtacatcgagtcaaaggagggcatctggtacccaagcaaccttgggcccaacagccttaacggcatcagaggttacaaggtgttcatcggcttgtccatgataatggctgactgcctcttcgtcttcctctgcatcatggtccggacaacatgtgccatgatcaagcggcgtcggcaggcaatgcaaggtggtggcggtaatgcgcagccattccagggtatcgacatcgccgatcagccggtgaagagcttcgatgatcgccgcagggcgcaggtgttcctccgggacgagataccggactcggtcaccattggctgctatgtcctcctgtcgatcatctccatcgccgccatccctcacctctacccacagatgaggtacagccatgttgcgctcatctacctcgccgcgcccgtcttcgccttctgcaacgcctacggcttcggcgtcaccgacatgaacctggctagcacctattgcaagatcgccatgttcgcgttcggctcgtgggtcggcatcaagagcggcggcgtggtcgccgccctggtcgccggcgggatcaccatgtcgatcctgggcaacgcggccgacgtcgcgcaggacctcaagacgggctacctgacgctgacgtcgccgcgcgccgtgttcatcagcgaggcgatcggcacggcgctgggatgcgtcgtcaaccccaccgtgttctgggtgttctacagggtgtacaagatgggcagcggcgacatgggcgacatgccctacgccaagctctaccgcggcttcgccatgctcagcgtcggcgacggcgagcaaggcctgcccaggcacagcatgctcctcttcaaggtcttcttcgtgctcgccctggcgctcagcgtgttccgggaggtggcgagccggaaggagtggcgcatccggcgctacatcccgagcaccatcggcatggccatcaccttcttcatgccgccgcgcgtgcccgtcggcatgtgcatcggcagcctggtggcgtacctgtgggagaagatggacgccggccgcgggcggatgctctcgccggcgctggcgtcggggctcatctgcggcgacggcgtcggctcgatcttgctgtccatgctgacactcatgggtgccagggcgcccatctgcatcaagttcttgtctcgaggtgacaatgtcaagttggacgccttcttggcaacactccatgacatgagatagctactagctagctatccatgtagggaaactagatcattttctcaggtgtcaaaacttttgtacatatgtatccacgtcataggggcttgagttaggagtcgtggcaaactgtataatcaagtttcagttcagtctataaacacagtttgatctcctctatcaacagttgcctcactgagtccatggttcaatatgagaatgcgtgcactgattttggcagaacccagaagtttgctttgataaactggagtccacatagattactagtactgtaactgttaaataaacctgataaaatgttaatttctagctacagtacaggaacattgcagagagtttcacaactgaccagtcagtcagacagacaacgaatatgcaagcacgcatgctacccatcttttttacatggacagacatcaaacgccttatttatacatttaattgtatcaagaaacaaatgaatgaatttaagggcatgtttagatcaatttgctgtggcagaattttttggcaaaagtttttgtggcaaaaattttggtattgaagttttgctagttggtgtttagatgcatgtgtcattttactagtaaagagagagagcacggctcccaacgcactatttagcaaaatttgctactctagactcccaaatgacaaatgccaaattaccaacttttgctaccagtatttagatccattttgaccaaaagtgcttctaaaacagaaaacttttgctattttggaggatctaaacagggcctaagaatcaaaggagggaaaacacttttaatcacttgagtggttgttcactcattcattgcatgtcaattcattagttataaaaaacttcaaaaatattgaaaaaatagattattagtatgattttttttctaatcaaactttattaagtttgaccaagtttatagaaaaaattagtagacatctaaaatattaaattagttttattaaatctaacattgaatatattttaacaatatatttgttttgtgttgaaaatagtactatattttttatatataacttgatcaaactcaaagaagtttgactagaaaaaaaatgacttataatgtaaaacggagagagtatgtaacatatcactccacaaattcaaattcgactatttatattgtaaaaaaaattaaaattgactttgaatatgctatttacatattaatctatcttgtcattcttttaaaaagattataacaatttatttgacatgcaataaacgagtgaagtcagtgtcccacttccatttgccattgcagttggtctcacaattgatcatgaatatgcaaagcacgcatgctatcaatcttttacatggacatatatccatccaaggccttaatttgtacatgtgaagtataacaaatgaatttaagaaccaatcagtaaagagagagagagagagtacatatgtatgctacaccagctgcttctcttctacacttacattacaaggctaatatatataaaccaatcgacaattaattaattaagtataatcactaaagaactaattaatcaacctacacgtacgcgtggcaagatcgatggaaggctagcttgagcttgaagtggatggatggatcatggcggcgtgggcagcgtcctgaggaagagctggaccttgtcgttggtggcggtggagaagacgcgcatgcacatgggcgggttgacgttggcgagcgagaggatggaggagggcagcgaccagatgccgtcgccgcagatgaggccggaggcgacggcgggggcgaaggtgtgggcgcggacggggtcgctgcgggaccagaggaagaggacgaggctgccgacgcacatgtcgatggtgaagaaggagccgaggaagaaagggacggccatgccgagggcgctggggatgaagtcctggatccaccacccgcgctgcttggccacctccttgagggcgcagatggcgatggcgaggaggaagaaggcgaggcagaagcggaggcagtagcgggggagctggtcccacccgttcacgcccaggagggcgatcccccggtagatcttggcgtacggcgccgggaacccttcctccatcccgatgttgttcgccttgtagaacatccagaacaccatcgggcttattatgcatcccatccccgtccccagcacctaatcatcatcacacaccttaaacttaaaacaagtattggttggtgcatgcaacttaatgtacaggatacgataaaattcgttcgttgcaacgcatgatagtacttacataaaacttattatgatacaacttaaaattgattagtacatgcagcacaatatattgtacatgatacaataaagttcgtatttgacaatgcatgatacacacttacatgaaaattatttgctacagctaggtgcaattacacctaaatgtgtacacatgcggtttaaatgtttatataaaaaggtcatagaatttgacaagatatattatgatagtataagacaccacaaaaacatacatgtcttgattcggtctacacataaaaaacaaaaataacaaaatttacctgcattgtataagtactattcattatctgatttcgttagttgtaaattaaatttagtcttgcatgtttatttatacacttacattattgcacttgatattactattcttttaagaaaatctatagtaattttaagtcgcaaacaaataacgggtgccatataggagtagaattaaaattttgtccggtagtacttacctggctgacgaacatggagcggggtgaggtgagcgtgaggtatccggtcttgaagtcctggacgaggtcggaggcggtggagacgatgcccatcatgaggccgcaggcggcgaggcccgcgacgacgccgccgtccttggcgccgatgttcgcgccgaagatgaagatggcgagcttgccgtagctgctggagagggaccaatcggtgaggcccgtgccgtaggcgttgcagaaggcgaagagcggcgccaccacgtacgcccacaccacgtgcttgggccgcagctgccggaagatgtgcgggatggcgaccaccgagatggcggcgaggagcacgtacgccgccgcggcgatcgtcgtcgggatctggtccttgaggaacacctgcgtccgcctccggtcgtcgaagctgagcacctgccgctccgtccccgtggcgccggcgaacggcgtctcctgcggctgcttgctggcgccgccgcggcgcttcaggtagaggtcgtaggcggtgcggagcacgatggagaagaagttgaagagcccgtctccgacgatcatggcgatggagatgaacacctggtacccgttcagcccatggaggctgctcttgggtaaccccgcgtcgtaccagctccccttcttgctctcgatgtacggccacatgatcccccacgacaccacggagccgatgagcagcgagaagttgataatgtaggggcagatcatgccgacgccgacgtaggtcgccgagaaatcgaagtagaatcggcggctgtacgccaccatcccgaacgtcgggaacgagctgaacccgcacccggggccggcggcgtagaaccactggaacagcgaccagaggaagctcccgacgaacgacttgaagaggatggacacctggtgcttcgcctggatcgcgccctgcggcgtgtggaagctgttgatgaggtgcgcggtggcggagccgctgggataggtgagcttgtagctgataatcatgatcttgcggagcggcacgatggagaagaggccgacgaagctgacgaggaagaggaaggcgatgaggcggcccagcgacggctcctcgacgttgatgctggtcttggcctccgcctcgtcgaagccctcggcgatcttcttgctcatgccgaggatgtaggtgccgaatccgccggagaaggcgatgctggagcaggagatgacgcaggtctggacgacggtgttctcctgccgggtgaacggcttggggaacacgccgcaccgctcgagcgcgctggtccacgtcttcatgaggaagaaggcgaggagccccgcggagacgttgagggaggggacgatgcccgaggtgaggttgagcttcatgacgatgaagctgaggaacgtgcccagcaccgcgctcaccaccagcgacctcaccgtgatctgctccgaccacgccggcagcgccttcccctcgaacgccttctccgtcgacaccgatatcacctcccgcgtcacctccgcctccccttccccagccgccgccgccatcatcttgattgattgattggttggttggttgattgattgagtcctcgacgacgatggcggcggcggcggcggcgagggctagcttcttccctgggtcgatctctgtccggccccggagacccggagatgggggagatgacgcaaacttgtgtgattagtggctgtgagtaattaaagtgtctacttttttgaaaaaattgttaattactcaactatactagagtaatgccaaaaaatgattgattaaaatggccatcagtagtaatgatgttttgttattctgttgtttcttcttctttcattcattttttccttttttaaaaaaaataacttggaattttttcttgcggtcatgatgtggggtgagtagtggacggttgtcatgcaacatgcaatctcgtgccatttgcagacggctaatttgggccagctaattttggcagtgtgatactttggaattagagttactctgattttcaatcaagtactagagttaaaaaaatagaataaaatatttaatatcaattggtgtcgtggtatagtaggttattacgtcagtctaaggtctcttttcttcaacttcaaacttcaacttcttgttttccgttaacacgttttttaaaactgttaaattttttgtgctacggcgattgaaagaatgtcaaccaaagtagaggaaagatcaagatggacgtttctaaatcggtcgataaaattagtaataagaagtctttaaaaagtgcgcattcatcatagaaaacgaggatgtaatagggttgctgatgaacttactcaacttgctaaacggaccgcatattgcgcggtttggcgtgaccatgcttcgtcttgtgtgatgcaggctctgaagtaagattgtaatattattacataatcaataaagcactcatttccctcaaaaaaattgtttgtgttttggcaaaagaaatctatatataaattgtttaaaaaattcaagtaaatctatttttcaagtttataattattaatatttaattaattacgtgctaatgaactttctcattttacgtagctaaaaacctcactccaagttgagagaaagaacgcagcctaatgcacttaaggtctcctgttcgagtctgggtaacaccatttttactgatgttcttttattttgtttttctttgccaaatcttaaattagcaaagtccactaaatttagtttgcatttcttttcatttttttaacagccaaacattttttcctattttttcttgtagcgaagtccactaaatttaatctacatttttttcttttattttttaacagccaaatccactagattttaatatgcttcgtcatggaccacgaaattaaattagtaaagtccactaaatttaatttgtattttttttctttttttttaacagccaaatatgctccatcatggaccactaaatttaatgttcagtcctatgtacagtaccatccattgttttcgttttttaaggctctaatccattgctttctttcttgttcactctgaacgagactggccaaagaaatcaattgagcagtggctagtggtgtactggtggtcattgtcatttgtttttcaccttaacaaaagatgaactacaaaaagcttttctacaaatccacatgtatcactgctctctcgtcccataaaaaactaatttaaaataagaaatgacatttttcagttaataaatctagatacgaacatattcagatgaaatacttgtaaataaaaaggaaaaaaaaggaaggaatttgaaaggaatcatattgcggtgatagaggagagacaaaagtgcacagctaagctgttttagtttagtagtgcagcagttgcagatctcccctcatctccagcttctcctcgtcgccggagctcgagatggccggcggtgacctgcgccagcgccgggcggtggcggcggctgacggggagggggacggcaagatggggtcagggggagaggaggcggaggtgaaggggaaggggcaggggaggaaggaggcgctggggtggctggagtgggggcgggggtggatgggaatcgtgggggagttcctcttccagcgcatcgccgccagcaacctctccaacccgctcgagcttcccccgctcgacggcgtctccttcgtcgtcaccggcgccaccagcggcatcggcctcgagatcgccaggtccaatctcttatcccttctacttcttctacttctactgctgctcttgccttgcccttagagatgatgggtggttcaattcgggcatgcgaagattctctggatggatgccatcaactcaagatttatcgatagcctttttggtttctgaattccaaataattcgtagtgttctcgacaatatagtgtgtgtaatgtgggcacccactggtacgaggtttagctcttcttttcttctcctgactttaaatgtcatgtcagtttatccaagcctcgctggttggtttgtagtaggcagatacggtagagttagtgaagttcttatttttactatttgatgaatcgttttgggatggcaatactatggtgaaaatagatttatatgtgctaacctgaaatttttggggcttttaactatttgccacttttagatttggcaagtaactatttgccacccctatatcaatgacatgtgggtcctggcaaaaagttaattgccacatctaaatgtggcaaatggttaaatatctcgaaatttttcgaaacaaaataataggggtactctcatacatgttacagtaatgaattggtccttgactgcacttcatcttgttacttcacaagtaaaactgtcaaaaatattcatctggcttcatcaatttggggagcatctttgataggtttccaatcaagaaacatgaaatctatcaagctaatttgccagatatcactttttattcagcgatatttcttattgggaagctgagtcatattattggttcctatataattgtatatgtgaattttgtaaagacttttgtttggttcaatagatttggtgttacatcttctaatgtagaaaagtattacaaatttgaaaatgcctaatcttcttataaatttcacatctctggaactaatacaagtgtatatttgcccttgtgctctggaacaaaatactaggggtactcatacatgttactgaattggtccttgactgcagttcatcttgttacttcataagtaaaactgtcaaaagtcttcatttggcttcctctatttggagagtgccttgataggattccaatcaataaacatgaaatctatcaggctaatttgccagacctcactttttagtcaacggcatttcttatcggagctgagtcatatcgttggttcttatgtaattgtatctgtaaaatttgtaaagacttatgttcggttcaatagatttggtgttgcatcttctaatgtcgaaaagtattacaaatttgaaaacgtgtaaacttcttataaatctcacatctttccctataactaatataagtgtatatttgcccttgtggtcaattcagacaacttgcactggcaggaggtcatgttgtgatggctgttaggagaaccaaattggcgcaggagctcattcagaaatggcagaatgataattcagagataggaaagccccttaatgctgaggtaatcatgaagacactatctacaggctgtacacaattgttgtctcatggcattttactagtttgtcttgtttaacacacataaatttgaatttctggccttatatgctcaaatcgaattccaactttcaagtaaatactatagtgtgtccttcacatctagcttttctaatcaattggaagatatctgttgcgaatgcatatcttaattggtaaagacaaagacatgtttctccaacatttatgtggtttagctgcagatcatttgacaattttttaatatattactctttaaggtgatggagcttgacctactctctctagattcagttgtaaaatttgccgatgcctggaatgctcgtatggcacccctacacgtattgatcaacaacgctggcattttctctataggaggtctgtatgcttcgacgataatctgtttcttttgtttttggtctatcaaatcaatccaacttgcattttactcggtaaagaattcaaattgtaccagacataactaactctttcattttctgtagaaccccagcgtttctcaaaggatgggtatgaagaacacatgcaagtgaaccatcttgcaccggctttattggcagtgttgcttctaccttcccttcttcgtggttctcctagcagaattgtaaacgttaattcagttgtgagtctctactcttacctgtgctgtgactgcctacttaggaattgttggaaagtgaccacggtttccttatcatgtataaaattggttattaatcctaacctcaatattttgaaaaacttgtctgaattcattattttaatgacaattaagaatcatttctgtgtaaaatttacaaatacctccagatacacttctgccatctaacaagcttgtctgcaatttcagatgcacacagtaggttttgtagatgctgaagatatgaacttgacatctggaaaacggaaatttacaagtttgatgggatactcaaatagcaagttagcacaggtatcacagaggtgttagattgctaattagcagttgttccctttgcaacgttaatttccttattgtactttgtattgttttcattctgctttattgcaagggaacaatcagtatctaaactgtccatgcacttttttcatgctatgtaggtctgatttattcttgtttcacttgcagataaaatttagcagcatgcttcacaggaggattccggcagaggctgaaattaatgttatttgtgcctctcctgggattgttcatacaaatgttgtgagttccgtttccccctgtccaatgtttgccctgtgaaacatgctatttcataggaattaaagaaccagaagtttgtggtattagttttgcatatgcctctagccagaccaacccctttcgggtgttaccataaagagaaaagaaacacatgcactattggggaaaaaatggaagccaaagaattttgtagtaacttaatgcaaggacagttgaaaagaaataccacaacctaaggctacatattttccgagaggattagtcatgtctatttttagttcaactcagcaaagaatctctcttgagcatcctaatgaacctctattaatctgtgctctgaataaacctggccaaatggaccgtgccaagccgggccggcccgagcacggcagtactgtagccggcccaggcccggcacggcacgccagcctgtgggccgtgccggcacggcccgttatcccgtgccgtgtttgggccgatgcctcagcccgtgggctggcacggcacggcacgtttactgtagcgtaccggcacggcacggcccaggcatggcacggcccaccggcccatttattttcctacgattttctaatttttcccatatatttctcatattttttatttttttccacattttatcctatttgaccatatattttatgatatatttcctaaattttcctcacatttatcctatatttatcattttttcctttatattatgttttttctgccttttttctttttttcccctcaaatttcaatttttatgggccacatgtactagtgggccggctaccagcccacgtgccactacagtagccgtgccggcccggcacggcccagcaccttcttgggccgtgcttgggccgtggccttggcacgtgggccggcacggcacggcccgctataggagccgtgcctaacgggccgtgccctagtgggccgtgccgtcggcgtgccgtgtcgtgctgggccgggccgcccgtttggcctgctatagctctgaatatattggcaaacttattctcatttccttctgttagtttattatttgtatgttgatctaataatgcccataaatggtgcaggcaagggatctccccaagcttgttgtagctgcatatcatttgattccgtacttcatattcgatgctcaagaaggtgatgtacaggacctttcagacgttgctatctatcaattgacaactctccaccttctgacatgcacaatatcttgttactgatctaatgcaggttcaagaagtacactgttcgcagcttctgatccccaagttccagattactgcgagatgctcaagtctgaagactggcctgtttgtgcttgcatctcatatgactgtaatccaatgaatgcatctgaagaatcacataacctcgagacgtcgcagctagtatgggagaagacattagagatgattggcctcccaccagatgccgtggacaagttcatcgaaggggaatcggttcagtgtcgttatggacaacagaaggcagaataggctatttcgtagacagcaaatatgtgataatttcgaatgttcgatccatttcatcatgcgattagtttgccagtggttttgttccagtactttgtaatagtacatctgtcatacccttttttttgtttcatatggttggtaaatctaactgcgtcaaatagaagtatgacaaaacaaagttcgttacaatttatctttgccccttgttaaatggcaaaacgtttgtagagttttgagttgtaaaagcatagtcccttcattctttggggataatcaagatatttattattgtttgggggaattaaccgaaacattttcagtttgtagcctgttctgctgtgcctcaaaacgctgcacttacataggtgtggcaacgctgtcctgaataccaaaactgacgatacaagaaggatggataaattttcaacatcacaagcaaatactaccatatatcagctctgaatttgaggataatgtaatgaactaatttagaacatactatattgctatgcatgtgctcacatgcgaaactcttgctagaaacagaacaagtactgccaagccaatgctaaaataatagcacagtcacaacttccacacttgaacaaactcatgcgagggacatgagagtttgtggagcattcaccaggcaagagggttacgatccagattaattacaggcatcgcccctcaataggacgagttaaaaacagaactccaataaaagaacagtttaccacgtaatggacagcatcgcggactattttactctccaggaagaccgaacacattttgatctgccaatggatgaatagcagcatagctagtctgcacctaattaagcatttggtggcca

SEQ ID NO: 68816 - DNA, 2473 bp, Oryza sativa
  unsure (1)..(2473): unsure at all n locations
ccacgaccacaccgccgccgctgtcgccaacagacgttgctagccgaccaacactcggccacacccagaccggccgtgagccgctgtggacgctccggataccgcggccgccgtcggcagccaccgccgccgacagcaccacctccaggagctcctgccgacggctgacgccgccaccgccgtgggcctcgcaccgccgtcgccaccgcgacgggcgctcctgccacgagctcgccctgctgccgccgccgccacgtcgtcgcgagctcaacaacgagctccttgaggtagctgtgcttgcggagcatgtcgatgacctcggcctttgaccgggaggcgaagaaacagagctcgacggcagccttcgggtcagacttgacgaggggcggaagttggtgactgtgtcatggccgcggaactgccgtgccgcaacatcgtaggcgtgccccgcctcggcctcgctggtaaacgtgccgagccacacgcagtcgcgccgctcccggccggagtcccctcgatgcccaggacacaaccgcgtncatcaccgcgctggcaccgntgcccacacgctgcatcgcctncgtcgacacagctgtcgcgcctgtgccttcttgcccatggacgcaccgctgttcatgtcatcgaagaagcagctcgaccagaggccatggctacggtcaatgcagtaggaagaaaagaggagaaacgaagaaaggacaagatgggaatgaacagaaaaggatattaaaaaaagttttttattggggcccatttgtcagttggtgtagaatttgtgatgctgccacatcatcgtccgtgtggcatgccatgtaggatcctggaggtgtcatggcagtttgtgatcggattgacacaatttaacaagttttgggatttggatatatgcattttgagagtttggggactcaaatgactcagtcgtacaagtttagggaccggctatgcactttacgcatactataatgagggagtccccaaccttccacaagcactaaaagactttatcaacttatgttgtaagtataaatatgcgaaatataatggattgaataaaaatatggtacgtggatgtgagtgtttgcatgagcaaggaactcttatcattttcctcttgttgcaagctaagttcatgatacgccttttttttttgtttgcattcaaaccagtagccactgggattttttttaatacacaaattcactgcttggcttgcatggaaaataatttattttgctttttcttagtgtgtaatcaatcaatttcacttagggttctgaaaagagtagaagcagatttccatcaaagttaaaaaatgcattttatatggagaagaaaattttctgttaggagactttcaacagtgaaactttctattaggagacttccaatggtaaaactttctactaggagacattcaacggtgaaactttctattaggcgatttccaacaggatgaaaagaaactttcagcaggtagccagttagctttgggtgatgccttaaaagacttccaatatgaattgtattcagcaatcggaacattcatatcaagaacttttacacaattactttctatcagactacatattcataaggtagaaaaaaatgcatgaaaactcatctaaagctgtgctaaagctatgcatggtcatgctagacaacagaatagctgctttctctacgtgtagataagcacgtgtctaacaaagcttaggacccctttgatttggaggaaaaacataggaattttggaggattttaatcctataggaaaatttcctatgaagccctttgaaacaaaggattgaatcatatccaatcctttaaaattcttatggaatggaaatcctatagagattttggagaaaatttagcaagagtttcaacctcctggtaactttcctttgagtctatctctctcatccaattcctgcgtttttcctgtatttcaatcaaacggtcattcctgtgtttttcctgtgttttgcaatcatctgttttacacttacattcctatcaaaatcctgtgtttttcatattcgtctgttttttcattcctacgattcaaaggggctttaatgtggtacatgaccaacgtaggccccctttgattcaaaggaaattcataggaattttaaaggatttcatttctataggaatttttccaatatagtcctttgaatcaaaggaaagaatcctatgtaatcccatgaaattcctatggaatgcttcttcccatgcaagatttggaggaaatttaggccccctttgattcaaaggaaattcataggaattatagaggatttcatttccataggaatttttcttgcaaagccctttgaatcaaaggaatgaaccctatgtaatcctatgaaattcttatagaatgtctcttcccatacaagttttggaggaattttaacaagaggtaaaacttcatggaagaaatcct

SEQ ID NO: 68817 - DNA, 51658 bp, Oryza sativa
  unsure (1)..(51658): unsure at all n locations
ttaagttgaatgaacagatttgctaaatctcaaccatgaaagtaacatttatatatggtcgtcgatcatggaacgtttgatggtttctcgttgacaacaatttttttagagaagggtattttttacccgacctctatatccaaccgaatatatacggctattaaaatagggaacttaaccccgcaaacaacccaatctgaaattcgctccataggagatttgaactcaggaccttggggtactacatataggcatataacgtttttccgagttgaaccaatgtgccctacatccatataccggcacgaggtatatctttccgtaagaaccatagagcaaaaatgaattattgtattagagacattacatccatgcatacagagcaaactcatctatctattatatactaaaagtccatgaaacttcctataaatacttataagccaccatgtatcgctcctataatcactcctaaaccaccaagtgacactacgaaatgatttttctttaaattggtgggtttaatattatcagccattagatctaataaaaaacaaaattcccctctccacatataccgatctcccctctccggttggtacgtatgtacgtatacgtacgtaggtaactcctcccctcatctcttttttcctttcctaatctccaatctctaatttaagccacatatcttattttttattgttattttaattttgacaaaataagtaatttaatatctatgttgttctatgcgccatatgctttatatggcaactagataaaacaaggaaatatttttaactataaaaaagttaacagcatatattattttactttaagtaattctacaaacaggtgtctctaaattatatccactatatccaatctatctataaaagtccatcaaatttccaataaacataactaaataccatgtgacgcacatataaatgctcctataacgccacgtgacgttctaataaattagataaaaaaaacaaattttcactaaaacagctagctctaataaatttctgtttaatcgttctctcattataactaaattaacaatataagattcatatgcctatattttgctatataattatagcatttgggcacagttcacctgtgcactttgcagccatctaaatactttaaagtcttacaacaaatattatatcactatgaatcattctacattctataaacatgcatagctaaattaaatctatagtatcgaaatagaaataaaaaacatattcaatttgacaatagaaaaagaaattgttgtcgaaacgacaaccgcatacgtcgaaagacgtggttactcaacagtggttggaaaaatgaagtgtattaaattttgaatttcacttggggatcccccgcgtttttactaccagggtttaggttgtacaggggaatttacatgattacccttatgaaagggacatttacaggggtacataatgtcatagggctcatgggcccctgatgggccgtctggcgatcgtcggcctgatgggccggaggggcttcctcagccctcgcgggagcgaacttgtcaaggcgaagtcatcctcctttggcagacagtcttcgccttgcacccttcgcctgagacgcctctggcctggcgctactcttcgccttgcgccgttcttgctccatagccttcgccatgggtttcagtaggttgggtcgaagggcctcatgccacccgccaacaagcccctcacgggcaagggtgagattggagcttcggccgagactgtgcaaactatgtggtatggtatgcggcgccccctttcgaccgatgctcctgccgaaacctacattattcctgcaaatgaagtttgttatttgtgcggctggtattatcttgccgcgcttcgcctcgtgggattgatagttatatatattcttttttcctgggccgaacggaacagtattgggccttcctatcttgggctttttactgtgccgctcggtcgatggaatttaccgtttcgcctacccttgcgatacgtgacactttattactggtaggtaggcgaacggtcgcctgggcgggctatatattcccgttgctctttccttttcaccgccacacttgccattttaccgtgtgcgctttctttctccgtctcttcctttcacagcatctttcgacccctcaggcgtttcgccgaatcacttttttcgccaccgcaaacggaccgttcgccatggccctccgtaagccaaacccctcttcggcgaaagggccagatcccggccgagtcgacgacgacagcaccgcctttctggggatttctcttgtgcacgacgtcgagctggagaagctggtcagctccggagcgttggtcgaggggcaggctttcgccccagggaaaaccgtggtgccgaaacttgtcgacaatcggacggtggtgttcgccgtattttttgaggcagggctacggtttccctgcaacgtgttattgccggagatccttcgcctcttccaggtggaacttccgcagctgagcccgtcggcgcttgttcggatcgctatcttcgactgggcgtgccggacttccgggtttgagcccaacgccgagctctttggcgccatatttttcaccaccgtgaactcgaagacggtgatcaccccggctggaacgaaaaaaaccgtgttcgggagcgtgaacttcaacgtttgccccgagcggtctgatctctggccggtgaacgctgctatgtcgaagtgggtccgccattggatggcgaggtggttctaccacaccatccccttcgaggctggttctgaatcagcgaaagctctccagtgccggcgtagggcaattgcgccgaaccggagacccaagatcgctgtggacgacgccatggaggcgcggttcgttctactgcggaaggtttgctcccgccttagctgctgtgacttggtggaggaattttgcatgcttcacatttttcccctctcccagtcatggcaagtcacggttgaacaaggcgaagaagtcgacggtttgccgaacctgatactccctgagggggcgaacaataagactgttcttatgttatataatgttgtgctttgttatttcgccttatttgacttttgacgtagcttcacgctctacttttacagtgttgaccctcgaccaggccgaagccgaagcccgcaggatgatcggcgatgtttcggtcgtcgagtatagtcagctgttaacgcgtcaagcggctgggcgggcgaaccgggtttacaatggcgaactgcctccccgggcgaatccccaaaaggccgacgacgaggcagggccttcgcgaaagcggatgtgtggacaagtgaagcttgcccccaagaagcgaagggttcctgcttcgtctgactctgacgccgacgacgaggatgatgccgaagaacgtgacggcgaggaggaaggagaggaagaggaggaggtggaggctgtggctgataaggccatgggtgaggtggtcgaagaccgcgccgacacccctgggtacactcctaccccaagtcctggtcacaacgaaaccagggtggagtcgaacagctccccccttcgtcggaaggatttggaaggggcgaaggccttagttgcgttctcttcgggagtggcggcgaagggaggccctgtcaaaaaggtggctaaaaagaaagggctcgttgatgtcgctcgcgtttttagcgacgacgagtcctccgacgggactccgacttcgcccgctggtcgcagccaggatctttcggccgcccccattcctccacttggcgccgctggagtggacggtagtaccgccgttggggcttcggcttctgcggaaagaattgcgatggccgcggcgaaagtattcggcagtcctccgcatcagccggtagcctcgccgctgatggaggcgaagggaaagggagcggtcgctgaaacgtccgcttcggaatattcgctctcggtaccccgcttcgcccctggcgacttcgcgacgcgagcggacctccttccttttgtggagggggtaagcaatcttgtactgcccgccagcgccccgagcttgttcaccgaactgaatgagttcgacgaggggtgctctgctataaaaagcctggctgttcgggtacgttttccccctctttttatctttactcttcctcgatcttgtttctacaattgacacttgttctcttcgccgctcgtattctgcgcccagatcctcgcggctcagtgctcaacagagcaaaccgtgcgagctcgacttgatgggttcaaaagccgtcttcgggccaaggatgacgaactaggccgcaagaatttggagatggaggcccttgccaacacccttaaggaggcgaaggccgaaaacaagcggattcaatcggaactagagaaaggaaaggaagctagggccgaagtcgattgcttaaaggccgaactggagaaagagaaggcccacaccgccgtgctcatagatgtggcgaaccattgtatattcggcaaactgccgctaaacctttaagaaggcttttttgcatacttggactgtatgataattttaaccactttttaacgatcaaagtctttggcatattattattttgctcattttgcattatgccataccttccccttctttcgcctattcttaccatgcaagatgtgttttgccttttctgcactgtctaccagggggtctgccgaaaatcatgcattcggcccccttctgggagctggcgaagtcaaaacgagaaatttgtggcattgaaggatttgccgaaggtacgatgtccatttcggcctgtttatcgcgaaatggaaataaacggtcgcagctataaagttttcaaggttgccaactggctgcgggcgcaccccgggcgaaccttagaagattacgatcttgttcattcaagacgtttggaggatatggctcgcttttggcgaaaccatcagaagactaaacgccaggaatcgatctttcagcattgttacagtttagtctgtgtttcaccccctactcctcttaaggttgtgtatgatattagtagtgatgacgaacctagttcgtccgaccattccttagggagggataatgattactggagcgaaaatgtaacttacttgtaaaatgaattgtatcaggttgtaaaccttgtactcttcgattattttttcgaagctaataaagaacgtgttttatttccttttcgctatttttcacatcatcacactttctgcttttgttaggtcggaacatgccggcccctttgcatatagtagcgaaataggtgtagtgacttttcagcttttcgtcgttcgttttcgatctgtagcgttctgtgtcgagagaaacgcttttgcgtttatgctgatcagtcgtaacgtcgttcggctatttattttccgagacaagctgttatggtttcaacgttcggcgagcaatgcttcggccgattcgtttcgccccctagcctttttcgctgatcaggcgtttgccttggggtttttccacaaattatcaatcacacgaaaagaaataaaaagaaataaaaagaaggcggaggagacagagatttttatactggttcgggcctccatggtggataatagccctacatccagtttttttttctcttctcttttttcctttttttttcttgccgaaaggcttacatagtgccgaaaggcttacatgacaatatgtacatttttacaagttggcgatttgggtgccacccattctagacatagaagcgcttgagggaggcggcgttccaggaatggtcgaactccacgccttcgagtgtcgctaggcgaaaagatcctgtcctggacttgtgtttgatgatgtatggtccttcccactttgattcaagcttgccaaccgctactaggttcgcctttttccttaggacgagatgaccaggcatcaactccgtgggtcggactttttgttgtaagttgccgaagtgcttgtggcgtacttgtgcatgtgctcgagcgcttcgacccttacaccttccaagagttcgagtgatacctcgcgcccctcttcgcccccggagaacataacccttggtgagttagcccctagctccgctggggtcattgcctcttcgccataaagaagcataaatgggctaaacttggttggtcttgtgggggtcgtccgaagggcccaaagaaccgataacaattcttctagccatttgcctttcgccgccccctcaagtcttttctttagtgcttctaggatcttgccatttgtacgttcggccgccctatttgactgtgggtgcgcgaccgacgcgaacctgatttctaggttaagcccttcgcacatttctctgaacttatcagagtcaaactgcttgccgttgtcagtaatgaactcttttggcaccccgaaacgacaaacaatgtttttccatgcaaactttggtactgctgccgaagtgattgccccaaggggttcagcttcgatccatcgagagaaatattccacagctacaattgcgaatttatactcgtttcgcgccaccgggaatggcccaataatgtccagtccccatctggcgaagggccatattggtgcaatgggctgcagatcatactggggcgcggcttggcttcggccatggcgctggcaactttcgcacttcttgatttgctcaacacagactttcaacacagtgggccaataaactccttgtctaaatactttggaggccactgttcttgcagcctggtgcgcgccacatagcccctggtgtatttcctttgccatttcttcgccttcggcaaaagagatgcaacgaagtaagggttgaagtaccccggagcggtaaagctgacccgagaccatcttatacttcgtggctctgagttgcaaacgcttcgcttctgcttcgtctaccggaagccagccagtttcaaggtgtttcacaaatggggttcgccagtcatatgggtcttcacccagtttctcttggtcgattgtcatgacttccgagctgtccatgggcacacttggagcatgtaggacttcgaaaaagatgccaggcgaatgcgggccaccacaagcagcggatttcgccaaggcgtctgcttcctcgttttggtctctaggcaagtgttcgaccgttatgccggtgaagcatttttccatggaccgaacagcctccagataccccttcattccctcttcttttgcctcgaaggatttgtcaacatggcctgctaccaacttggagtcagttcgaattagcaggcgccggactcccagtgctttcgcctttcttaggctcaggagaacggcttcgtattctgctgcattgttggttgtgtcgaactgcaatctcgctgcgtaccgaatcggcacaccattcggtgaaaagaggactgtcgcaacgcctgccccattgtgcgaccacgaaccgtcagagcacatcacccagaactggtcgtcgggctcggggtcgggggcaagtaccggtgtccattcagctacgaagtcagctagcacttgagacttgatagcagagcgtgcaacaaaatgcaagtcgaacggggatagctctgccgcccacttgctgagccggccagtgacttccttgcctcagagtatttcgcccaaggggtactgtgatgggactatgactttgtgggcctggaagtagtgcttgtgcttgcgcgaagccattactagagcgtaagcaagcttttccatttcaatgtaccttgtcttcactccttgcagtgtttcggagacgaagtagaccggtttctgtccggactctttcttgaacgagtgcagcactgactgccactggcgaagctgccaagtataatagcagttcgcttcctgggggtgggcttatcagagctggtgggctttgcaagtattactttagctcgtcgaatgctgcttggcactctggtgtccaattaaactttcccgcgccctagagggtcttgaagaagggcaaacctctttcggccgcctttgagaggaatcgactgagtgccgcaattcggcctgcaagcttttgtacttcatgtacgcttgacggaggcttcatttgttggatggcatcgattttctcgggattcgcctcgatgcctctttcggaaacaaggaatcccaacaacttgcctgcgcggacgccgaaaacacacttctccggattcagctttatgcctgccgcgcgcaagctgtcgaacttctcctgcaggtcgatcgcatggtcgaaagccttgcggctttttacgacgatgtcgtcgacgtaagcttccacattctgccccaactgcttgccaaggaccttgtacaccggcctggcgaaagttgctcctgcattccttaagccgaaaggcatcctgaggtgacaaaatgtgccgaatggagtgatgaaggacgttttggggatgtcgagcgggttcatgtggatctggtggtaaccggaatatgcatccaggaaactcatgagctcacatctagctgttgaatccacgagctggtcgattcgcggcaaggggaaatcgtcttttggacacgccttgttcagatctgtgaaatcgacacacatgcgccatttgccatttgacttccgcaccagcactggattcgccaaccactccggatggtcgatctcttggataacccccgcccggagtaatttttgtacttcggccttcgccgcttcttggcgatcggcagacatcttgctcaacttttgttttcttggcttaatattcagcttgactgctaggtgatgcatgataagatccgccgggacgccccccacttcatcagggctccaggcgaagatatcgatattctttttgagcacctctagtatgctctcaacttcttcttcgcccatgtcgcccccagtgatacgagctttgtggggtcggcatcatcaatctgcacttttgttaccttgccgtgaggggtgggcttcggcgtgtgcttcggccgctcatgcggttcggtctcaacattgtgcactgctctgttgattatggctagatcgcgttttgaagcggacgaaggctgaagccccttgactactatcacccctcttgggccaggcatcttgagcttgagataattgtggtaggaaatggcttcgaacttgttcagggttgcacggccgaagatggcgttgtagttgtatgggatgttgacgacgtcgaacagtatttgctcttcgcgcctgttttctcccgagccgaaagctatcagcaaaagtgcttggccaagaacttgcactgcctctccgccgaacccccggagcgacgttggtgccggtgtaagagcttgggttggcaagcccatcttagcatatgcttcggcgaagatcacgtcggccgaactccctccatcgaccaggattcgtcgaacttcaaaaccggctatctcagctgagatcaccagtggatcttgatgcgggaacaggactccttcgacgtcttctggcctgaaagagatcagctggttcatgtactgtggagccccctcacccgctgaagtgatgctgtggaccatgcggatctgcatctttctctgccgtttcgacaactggcttggtgggtcggctcttgtaatcacttggattacccttcgttgtgtatcctggcgttgttcggctgggggtgtttgctcctgaactgcttcacggggtgcttcgaaagttgccccctgctgcggccttgggtcttgcgcgttgccacgttgcctaatgtttcggcattgctccgtggtgtgcgaagagcgtccgtgaaaggcgcagtagaggtcttttcggaccttcttgcgggctggctgctgatagttgcttgcttgctgggcatcgaactccttgcggagggcttgcacttcttcgacagccatcacagccttgcccgctcgatctgttctgaactttctccaagtcatgggggcttggccttgccttggcggctatccctggatcgccggctgagactggcgaacagagaggggaggtggttcggtaatttgagcttgcacttgagcttgagcagtggcgacggaggctttatcgtactcagcttgtatagcttgtcgtcgcctagaatcctcctcgccccttgcgaacccgtcaataatgcgaagtaggtgctcgagcgtctgcggctccttgttagtgatttttcttgttagttcgccctcaagcagaccagccgatgcggcgtttatgaccgacgcctcggttatgtcttgaacttggcaccgggcttgcgagaagcgacgcatgtactcccttatcgactcccccggcctttggcgaatgccgagtaggtgttgttgcgtcttcggctcctcgtaggtgcctcgaaagttaaggacaaaaacatcgcgcaaatgctcccatgagtaaatgctattggctggtaaattgaaataccaagaacgggcgatgccgtctagagcgagatgtattaccttcgccttggtattttcgtcaccatgagccgcttcgatcgctgactcgtagatggagaggaactccttcgggtcagtttcgcctgactagcgcgggatgggtgggaacttgaactggggtggaattggacgagtcttgattcccccactcagcggtagccccttttcgcctcccgccctgtttacccaccttgctgcgggtacggtgtggcgaagggcgaaatcgcagcttgtacgtgaggttgggccatggcgttcggctgcccggctccaactggaggcacttgctgagccgctatggatgggtcaaaaattggctgcgaccacgtcatggcagcttggattggtacttggtttgttccgaagcctggggtcggagcttgctgccgaacggttggcgcctaagcaacgttggcacagtcgaactgcggtccctgattctacggcgaagctcccgagcctgactgaatcggtggcaaccaagtaggcgcaccttaacttgtattccccaccgggtgagccgatggggttgtacttgaaatgtagtagggttggttgagttgctgaaggaaagcttggtgttgcgtctgcagagctgaagccccttccgccactgtttgtggcacttggccaggtgattgatgctgcccggtgaagtacaccggcacctgtgcggcttgtggcggaaagggctgggtcgtcacttgcggatggacttgaggttggacatagcctgccgaatactgaaggattggagccgacgtggccttgacccgccttgccgcctcgtatgcttgttgttgttcttgcatttggcgaagcatgtcttggagccgtgtcatgttgtgccgcatagcctccatgtcggcttcggcttgtgcttcgaggtcaaggctggtttgggcctgtacaacggcgagcgcggttgtggtcgctgccggctgtgatggagcagcttggggcaccaccggttggcttgtcgaaaggatctccgccatggtctggagtgcccttgccgccgcagccgccttcgccacgtcggcctcgttcggctcttgcaccgaagttgcaggggccgaaggcggttgtgatggcgcttgtgctcctccagcttcggctacgggcgccgaaggctctgctccttcctcggcggccatgtctggtccggcatcgctctccgttcgcctggcaaccttctccttcatgaccctcttcggtggcattcgctctaagtggttttgctcggagtccccacggtcggctccaactgttgtcgaaacgacaaccgcatatgtcgaaagacgtggttactcaacagtggttggaaaaatgaagtgtattaaattttgaatttcacttggggatcccccgcttatatggccctaggggactatttatagccccattacaggttcttactaccagggtttaggttgtacaggggaatttacatgattacccttatgaaagggacatttacaggggtacataatgtcataggggctcatgggcccccgatgggccgtctggcgatcgtcggcctgatgggccggaggggcttcctcagccctcgcgggagcgaacttgtcaaggcgaagtcatcctccttcggcagacagtcttcgccttgcacccttcgcctgagacgcctctggcctggcgctactcttcgccttacgccgttcttgctccatagcctacgccatgggtttcggcaggttgggtcgaagggcctcatgccatccgccaacagaaataattcaacaatacaagtcacaccatgatctattttgaaacatgtatagctaaactcacactatataagcaagaataactagctgaaatatagataatctgagccactgcataagcaattgagtgcctttaactaaagaaaatattatgtttttttctaaatgtgctcaaataatccaaacaatctaaatgatcttctataagttttgattaatattctgcctttataagtttctcaaacacagtctacgattcatgcccacgcgaacgcgtgggctacctttcttgtttagtataaatactgcctaattgcaagcgttaatcatcacctctgcatacagtcagatagctagccaagctgagcaggactaagatcactcgtgaattcggagataccatgggaagtgtaccgaaaaaaggagctgcctttgctctgccggtggccattgcgaccatcgtggtggggaccaccaggaagatggccgcggacantacacaagatcctcacattttttacggcatatctgtgatgggctttagcattggtcagtgataagggtcacctttgacgggttctacgggacgcggtcattggtaaggcatctttttccaaccggtccaaggtactaattacctgtgacggttccatagtagaaaccgtcaaaggtgaggtaaatctcacctctgacggcttccacatccggcccgtcttacctgtgcgggttgcatccttataaatcgtcaaaggtgaggttaactcacctcaaacggacccatcactggagcccgtcacaggtggggaggggggctgactagactagtagatggagatatgtactcccttatccactctctctcttatccactgaaacaaaaggacctctctctctctcccttatccaaactcacagaaacaagaggggaggctcttgcggcggcggcggaggacccgacggcccccgggagaggcagcggcgtggcgacgacggcggcgccgcggcggtggttcggcggcgttgggcgacggctcagcggcgcgtggcagcggcggtggtgcggaggcgcagcgtcgaggtggtgcggcggcggcgctgggcggcagcggtggtgcggaggcaaagcggcgaggtggtgcggcggcgctaggcggcgagcggcgtcggcggtacccacatcctcctcccccttctttctcccctcctcctccttctcttatttccgatctggtgcgtggctcagcggtgcgtggcggcggcgaggaggtgagcggcggcgccgcggcctcaatccccgaccgccgacctccaggagctcggggtcactggcgccaagctcgagcgacgacgacgatgaccaccgacgacaaccgctgagtctgcctccaggacgcggatctggcctctaggacacggatctggccgccgacgcctcccccacctcccggccgccagcgcctccaccctttcttccccgccgatgtggtcgatatggatgcgcacctccggccgacgagtaccgcctccaaccgtctggcctcgcctgccgcgagctttgcttccccttcgctccggccggatgcgcctcccaccaaagggtgtcgccgcctccacctcccgaccgtcgatcgccatgactgccatccctcgctcgccgatcgccagatctgtcaccggtgtgcccctctcgccccctatccttttgcattgatatgatattgttgtctctgcattgagaaattcttgccatcccctttgtgtgaatacttctatatgagatctatcggtttgaatttttttgtgtgataatgaatgtgagcaaagcagctgtgagcctgtgacaacgagcaccaccacagcagcgtgcaccattgttttttgtttgtttttcacaccagtgacgggttgcacgctatttcttttttttttgttgggttaaagacatcagtgacgggtcacaaaataacaggtcgtttgagataatagtacctgtgacaggtttgatatgtggttcgtcgcaggtagccttcaccactgacgggccttcacccgtcaaaggtgatgagagtaatcagtgaccactaatctctgaccagagctatatccgtcagaggtgacagtttgggcccgtcactaatagccttacccagcgtagtgcgacctgtcggacgccgagaaggcacagttcgtcaagctccacaacgacgcccgggccgcggtcggcgtcaaggcgcaggtgtcgtggagcgaggcggtggcggcgaaggcccgggagcacgccagcacatgccgcacggaccacatacaggggccatacggtgagaacctgtggtgggggtggagcagcgccgccggctgggtcgggaagccagcggacgcgatggggagctgggtgggcgagaagccgtactacgatcgcagcagcaacagctgcgtcggcgggaaggtgtgcggccactacacgcaggtggtgtggagccgcaccacccagatcggctgcgcgcgcgtcaccggctgcaacatcaacggtcgcagcagcacgctgatcgcctgcaactacaacccgcgtggcaacattaacgggaagcgcccctactagctacgttaagccgatcgagtctcctctgatgaactagctgctctctctaacgtgggctactaatatatgggttcggtatagttatgaacctacatattattagttagagagcgtagtatgttagaggatccgtttccatacgtatgaatgctcgtaagatacatatatattacgtacaaatatatatacatgctgaataagagagtccatagtcattattgtatctatcaatatggtttttaccataaataaaaggaaaaagtacgaattacgagtctgaactatcgcggtcgaccgaattacccccctaaacccgaaaaccagacattttacatcctgaactttgaatactggacgaatttccccccttgacccaatccagagcggttttgtcctacgtggcgtacgcgtggcaatccagtcagtattttctttaaaaaaaattagtgggacccacctgtcatatctcctccccacctcttcccaatatctaccggggacatgcacaagagcagcagctgggtcaacggctccggcacggcgtccgccagcggccgccctatctgcggtggcctcctgtcgtatctctatcgctagagtgtcaacgtcgatgcactggcctgggagatctgcttagctccagtgcaggtctaaagattgatgagatgcggacgtgccagttagtttaatcttgcaactgacaaaatatgtaaacagtagataaaacaaccgattggctgacaagccaatggagtaattctagccaatagctgatattagccgatgccgataacaaccgatgtcgatagggtttttagcaatccgctatatgtccaatgtagataataatataaagacaatcggctgatgataataaaatataacaataatatagtccaatagaaaccaatcagctaaaaataatatgataggataagtactgatccgatagttaaagcatatatcggctagagattcgatgtcattaaaatcctcaagattagataaacagtaaaacctttgttgcaatcggctaaatccaacttgtatgtaatgcttgtaagccgatgcaacgtccagataacttatcggctagcacctcgataaaacactagcatgaacctatcgacttaacaagatttatcaataacaatctagtaggtcggacctaaccgatgcagcacgagattatatatgataatctaatactcgatgagccgatagatttgtctaatgtgatagatataacaaatctatttataacaacattgtgattgtagagatatatcggctaagacagaagatcggacctaaccaagatagttcctactaaaccgatgtatctctaaacataatgcaattagatatagaattgagatatcaggtaggcaaatatatcaaccaaaccagaccgttctaagagatcgaaagcaatgcagtcttgaataacaccaatgtagccgatagattcaccagggccgaaagaaggtaggacttacccatttgccggagatcgaactgaaccaatgtagccccgcgtcaggtgccaaattccggcggttgataagtaaaaacctcagaaaaaagggtggcgatgcgccgagagtagttgtattgatcgaaagatagtttgtaatgaccccgggtgtacatatttatacccatgggtagatgcttatccttgtaggacaagaaagaaactttccaaaagataaaacgaaaacataaagtccttatatgacactaaacatacttttctaaagataaaagaaaactaacaaaatattcctaattaatagataacttgccatgccgcatcctccttgaactcatgtacttctggataagcttcctttaatatattgatttccttaaccgattatagcaggaatccgactattggcgatatgataattatgttagaggcttaccaaatttcactattaacatctagctagatgacaaagcctataacctttaaggcgtttaacttattttattagtaggttaggcaacttgacttgatattgttgatattgttgctcaatgctggtatataggcaacaaatatcgagcatataggcaaggtttttagaacatatttgtgccttcttaaattaatgttgatgagtgggaggccaaggaatacgatgcttatgttttctttgttggctatataggacactaattttgcccttgacgttggaccaaggcttttgttaggagttgatgtttggtgatttaacccaccagcaggaacaggaagacgagtcaaccatttttttaaaacgaaaggatgacgctggtggatgtgaacgtagctagttaagtaatatgtgttaaaacgagaggatgacgcgagtgaagaggaagatgaaccgttgtagttgaacaggaaatagtcgcgagaagcacatccaaaaaccttattgccaccttctaccggtgcaggatgttgaaggtgaaggttctggagatctgctctcccgatcatcggtgcacgccaataagcgggatgaagtagaccacgagtgatgacgtagtaccaaggaagaggcaaaccctagattaatcaggacgcttgcacgatctccactccgtgtaaccgaactggataagtcacgtgtaacttatccggactccacgccatttcacgcacctgattattcggagtgtttccaaaaaataaatctaaatttcccgcagtaaaataaaactgcaaaaagagactgcatctgcgcaagggtgaggaaccaattttggcggaccattcgacgcgtacatcgtgcacgcgcgcgccatgccaggcgaggagagcatgtctcaagttgctaggagagcatcctcccttataaggaggtttccctctgctagaataggcaaggtgtactaaactccccatgcatgctatcccataaggtgagctttctttatttttctaaagaattatctttgaatgggctaacacccatctattaattccaacgtaatgttggtatataggctgtgacggacgccgtacccgattgagatggggttgccgcccgattgagatggtggttaccgttctagtgaatggtttaagaatatctatacatagatttggacataagacagagaattatgtgtgaagtgctcatgattattttattgtattactgatgtgttagtctctttttatggtattaatacaattccatttatgaaaagggacccaactttcaagacaataataatctgtagtggtgataggtgagtttatatctaagcatggactaagtgatttttttttttgaaatttgagatacattcttataatttagtatatcaaagtctatgatctatttcacggcataagtatttttcttccattttagttaccattataagataatttaccatctcttatggtgaatttctaagatgaatatggtgagataatacttcttttagtgttctctttatcattaaaaataaaatgcccgcgtatcagtgcgggcttccttgttacttaaatttttaaattttttgaataagacgaacggtcaaacatatttaaaaaaagtcaacggcgtcaaatatttagaaacggatggagtacataggcaacaaatatcaagcgtacgtatatgcaaggcttttagaacatatatatatatatatatatatatatacatacgtgtatatatatatatacatacgtatatatatatatatatatatatatacatacatacatacatatatatatacatacatatatatatacatacatatatatacatacatatatagtaaatttgtttggtgctccatggtgcccgggcaccattgttgaaattgagtatatacccaattcaaatgagtatgaaactttttcaattacttaggtattaatattaactactttactaactagttcaaaacaaatttgaactgaatttgaacttgtttttgttagattttgattcttggtatatagcatccatacatataattagttaggtatgtaatcatggattgtgaaataaagttaaatttgagttgttttgttgataggtataagtatgaatcaaattattataactaggtatatactcacaatttgaaaattttaaaaattttgagtgattttgtgcatttgataccatggtgcccgggcaccatggtgccccatatgatatatatatatatatatatatatatacatatatatatatatatatatatatatatatatatacatatatatacatacatacatatatatatatatacatacatatatatatatatacatacatatatatacatacatacatatatatatacatatatatatatatatatacatacatatatatatatacatatatatacatatatatatatatatatgcgcattctgaaattaatgtttatgcaagaagtaggatcgattggttatgttttctttgtttgctatataggacactaattttgcgcttgatggtggtctaacgctttttttaggagttatgtttggtaattaaacccaccagcaggaacaggagaagacgagtcaaccattattttaaaacgagaggatgacgcgggtggatgtgaacctagctagttaagtaatactacctctatatttaaaatatgtatgacgccgttgacttttggtccaacgtttgaccattcgtcttattaaaaaaaattatgtaattattatttattttattatgacttgattcatcatcaaatgttctttaagcatgacataaattttttcatatttgcacaaaaattttgattaaaatgaatggtcaaatgctggtcgaaaagtcaacggtgtcatacattaaaatacggaaggagtatgtgttaagttaataaaaaagattgttaagttgaatgaacagatttgctaaatctcaaccatgatcgtacgtcgatcaagaaaataatgtatgtttgatggtttctcgttgacaacatataggcatatagcgttgttccgagttgaaccaatgtgccctacatccataccggcacgaggtactactatatctttccgtaagaaccatagagcaaaaatgaattattatattagagacattgcatccatgcatgcaaagcaaagcgtgcccggaactagaagccggcaaccgactgatgcatatttgtctgattttgtttacgcttcagttcacctaaaaaaatcttaactagtaagtaactagttgaatggagatttctctcttccaatacagtgtacttgttaatggcaaaattgctccaagcaatattgtttgccttcccatcaatatacaactagaagcatttttagcgatctattccaattcaaacattttgctgcaagtatcatatgattcagcacatatccctcacctctgctacaaacacccccagtaaatgaacaaaaacacacagaaaaaagggagagtattagcttactttgattttaatttggatgtgatacgacgagccccatccacaggttggggattcaacgaaccctagaaaatacaaaaatgaagagatgttaaaaacgaaatcagaaaatcgatgaaaaaagaggattgagagaaaggggtatcgtgcgcaccgactccgccgcagcagccgccgccgcaaccgccaccaccatgctcacgccactctccctcaccggcacagctgacctcgtgcgcaccggcgtcgctaaagtggagtcgtgagcaggctccaccgccaccggcttcgtcaccgccgccggcccaccgccgcagccatgactcaaatgcttgggagtcatttgagagctgtaggtgtctgtttgggagctgctcagatgcttcttcagggtgtgtatctgattcgtgagggtctgtctgatccgtgagaaattgtcctgtccaggaccgaccccaaacggtatactggtaagtagcatttatttatgatgttttagtcataaataagttaagtcttcctttttcatggggttaaaaccttttctctttcgtttcatgtttttttctgtcctttgtacacgatatatgatcgggagttctcgaaacaccaagcacaataatatcccattcatgttttatttttgcattccatcagtgtggcgagttctcacaccaagcacatatatgtcccgttgattctcgatggatatcaggcgagaattatatttatattttattaaattataccgatgttaaacaaaacttgtgattgtgggatgggaagcaatatagtactccctccatcccaatcccaatataatcagaaaaaagaacttctggacacaaaagaccaagagaaatttatcatccgatattccgatcagtagctggctcatgcatgaagtttaatccagcgtgatccatttaatctccatctaagaaagctacatccatttaatttaatttatatattatttgtttttcataaaaagaatttttttaaaaaaaaatgagcaaactttcaactaaaaatttgaaactttcaatttaaaattttaaaaacttttaccacaaaatttaaaaaattaattcaaatttaataacttttaactcaagtttgaaactttcaacccacattttaaaattttcaactcggatttgaaattttcaaattaagtttcaaagcttttaactccaatatcataacttttcaactcgattgtttatatgttgttttattgtaaaaacactaaatacgaattagaaacgatattaatgctaagctagagttagcggcgggagttaagggcgcactgcgctcagagaacatgggccgatttgctttcagggataactgcgtgcaatagaaaggcccatcctaaagtttctactccctccgtttcacaatgcaatgcaagtcattctagtatttcacatattatattgatgttaatataaatgtgtgaaatgctaaaatgatttacgttgtaaaacggaggaagtaaaattttacataatatattaagactttcctccaatatgtatatatatttatgaaacgaacaacttttcaaaacacgagggagtagtaatttctaatgggactattaaaaaaagtattcgacattgaaatttcacaaggcgacagatgcaagcttattttggtcaaacaactaaattcggctagtttttaaaacccgacagatgcaacttctattgcgacatttgccatgtgaacgaggtatattttagaaaaatatgacaacaaatataatataatatggtagaagtagctattagaaaaatgcaaactgcgacatatgcaaggatattttggtcaaaaactaaatgcggctagttgtttgaacccgaaagtgtccacgctgctgacccttgcgcagcctttcaatctccgacgtgaaccgctccatggccgccgccggcagcacgaccggcacggccacaccatcttccccggcgccgttcttgacggcgatcaagtagctcactccataccaagcgtgcgagggcccgccgtacaccggctcgccccacccgaagtccacgcggtggaagccggcgagccggacgtcggagaggaggagcaggttcgccgtgtcgatggccggccgcccacgcatcaccagcgtgtcggccacggaccggacgtactcggcgttcaccgtcttcttcgcctcgcgcacctgctcgaccacgtcggcgagcgagccgcgccgccgcagcgcctcggcgggcatcgccaccgtcaccggcacgcacacgttgccgtagtagccgcggggcaggcggagctcgccgttgttcctgaagctgacgatgatcgccagccgcgcgtcctcgccggcgggggtctcgagcgccctggcgcgggcgcgccagacgaacgacgcgagcacgtcgaagctcgtcgcgcggccgcggaggtgcggcgggagagcacccttgagcgcggcgacgtcgccggggctgaaagagaaggtgcgcatgaccatgtcgccgagggcgcccacggacggcgccgccgggggcgcggcggcgaagtcgttgtactcgcggagatggaacgccagcttgggaggcttgcgcgcgtccagaagctcgcgtgaccacgccggcgagacggccggttcacgggcaccgcgggcgagatcggcgacggcgtccatgaactgcacgatacccgaggcgtcgcacatggcgtggttgaggcgtatcccgaggacgaatcctccgcagaggagacgggtcacctgttcgtccacggatcaagtcaacacgtggacatgtgccatgcatgccacaccattgccgatgcgtgaatgagcaaagatgaagcattgaagcttacctggatcagcagtaatggcgtgccgagcaccgcggcggagccgtccacgtcgaagagcagctgatccatgcacgggaacggcgccctgagcccggcggcctcgagctcgacgacgcggacgtcggcgtccgcctcgacgaacatcacgccctcgccggtgcagtcgacgacgagcttccggccttcaacctccctgagccgcccggcgaacgggtagtacggcaccagcgcggcggcgagcgcccggcggatggtgtccacgggatcagcggccgcggctgatgggcggtagacgaagacgacggggacctgccaccgcagcgactccggatcgtctacgtcggagaggcgcttcgtctcgcggggcgtcggcgcggcgggggcgacgagctccgtcgcgcggcggcgcacggcgaaggacagcgccatggcttttggttgtttggctttgcacctagttatatcaaagctattgaacgtaagttcaaatgttggccttcaagctagcctagacaattaatgggcgttttatatgatgaaacatgtacatgcttatattttctaggccctgtttagttctaaagtttttttctaaacttccaactttttgtcacatcaaacctttcatacacacacaatttttctatcacatcgtaccaatttcaaccaaatttccaaactagcgtgaactaaacacagccctattctaattccaaatgacttttcaaagtaattctcgacaacgcactgccggagggggtagctgaggggcaagcacgtggaaggaatggaggagctggtctacaccgtgtggatggatggtggcggtgcgcgacatggaggcccgacagtggtgcagatgacagggtggtgagagaggttgtggacggcagtggcctgacagtcgcttctctctcgccccctcctccttcccgcatttggcgttgacggcgacaacggcggcagcgggcgacgccctcccctccaccagatccggtgggatgagaggcggtgggcggctgcattatcctcccctccaccacatccggtgggatgggaggcggcggcaacatgcagcctcccaagtgacttcttcctctccctctccatcggccatccactggtggcgcgcagatccggtcggggtgggttggtggcggtggccaagggaggcagcggtgggtggccaaggatttttggcggcgacatcactgatgagttcgtgcatggattgttcttgctcgtgcagttcttgcttgtgtagttattgatggatttgttattgttgacatgtgattgatctgcgttgatctgtgattgttattgaccggggaatgggttggctcgtaagcataagctcggctcggcttagagccggcttctccttttttttttttgaatttaggagagcacaaagatgccggttctacgaccggcaccaatgacactaggtcattggtgttggctggaaaactgacacctatgggcatttttgtagtggtgctgttttttcatgggtataggtcttaggcaaatgataaggggaaaatttaattatttgcctcaaagaatgtgctattctttaaatgccacttctatcattgttcatattcttttaccacaatagccctatgaaatgtctattgtgcccctcatctctctcggccaagtaagagtgaaggcaatggcgcagtagtggaactctggcctaatgacaaaccgacgatatagcttgagctccacccttgatcaccaaagtgccagacgagcaggagaacttatgaatcgagatgggagagcgtgggcgcatggggtggagatggtggaggcaggtacctttcgagcacacagaggttgtcaaagtgatgcatagtggccttctcctaggggacgatgagagtggtcttttgactcttttccatgtgctgctaggcatttagtggtgttattctagttgtcgatgaagagtgcctcgaaccgccggtgcgcgcgtgagccggatgtttgggatgagctggctagcccaccccagtcaccctttggttgtgctcctctttctcctactcttctgtcattttatgggatcgatggaggagtccgggaaatgctttcgccttgttgtcaagctaaagcttcaacactactcaagccttgttgccatgttactaggctcgagctccattgcttgcaccattgtatggcttggccagcgagaagcaagaggcgagagtgggggagatgagggggtacaatgaacattttatagtgctatagtggcacatctttagaatagctccattcgaaaatataacaacctagtattgaattagatacaatttagtactatgaatctagatagggttccaaattcattatactagactatgctaatctaatacgatgttgctatattttgagctgaaagatgtactccctccatacttataaaggaagtcgtttagaacaatgtttaagtcaaaccttaggaatataaatcattaataaccctcaagttgttgagtttgaaaatataaaaattatatgaatatatttgtcttgaaaaatactttcataaaagtatacatatatcactttttaataataatatttttatagaaaaaagaagtcaaagttgtgttttggagactgcgtctctgtccaaaacgacttcctttacgagtacggagggagtactttctctatatctataaaaattcaatcctaactatgaatctgaacacacatgtgttcaggttcatagctagaatttgattttttttataggatggaaggagtactttcttcatctcaaaataagctaatttatgttataatgagacattatctaatacaacaaatttagaatgttttttcttatctaggttggctaacttagtttattttagggtggacaagtatctgttaaaattattttaggctgatctttagatgttactaaaacttgtaagtctttatcacattagatgtttgaacactaattataaatattaaatgtagactattaataaaacccatccataatcttggactaattcacgagacaaatctattgagcctaattaatccatgattagtctatgtgatgctacagtaaacattctctaattatggattaattatgcttaaaaaatttgtctcgcaaattagcttttatttatgtaattagttttataagtagtctatatttaatactctaaattaatgtttaaatatagaaactaaaattaagtttctggatcccaacaccaccgacttggttcgattttcagagagctctgggcacagtcaaaactcaaatccccaatcgtaccattccacacgcttccatttattattcacccgaaacgaccctggccccccaccccccctccctacccgccgcgggccccaccccctgccatttcccaacggaatccacccggccgacgccgggtttcccccatcccccccccccccccgccccctcctcgtcggcgccaccgccgccgcaggctcgccgcctagggttccttccactctcggcgcaaggggcgtagggaggttgagagggagcgagcgagcgatggaggggtgggtggcgacggtcgcgtacacgggcacggcgctggcgtgcgccgcggcggcgacggtggtggcgctgcgcctcgtctaccgccacctcctccactacgccgagcccacccaccagcgcttcatcgtccgcatcatcctcatggtcccggtaggcactcgcctccgcccgatcccctcctccccctctcgttcccccatgcgtcggctacgtccccagcttcgcgttcctaggcgggtttagtttgtggtagctccgatttgagagaggtgcgcgtgtcgattccttgagcaattttggtatcggcggtgacgtgagaggcgcggatactgctgctgcgttgtgagttgattttactacaagtcgatagttaatctgggtcgttggatactgggatgcgaggccccaagcctctacctgtttctcacttctgaacgaacaggtttctattggcgaattgttcaggaagtgattgtgaatctataagttggatgggagtgtatttttttttagtaatgttattgcagctagctaagttattccatttggcatgcaagctgcctgtatggatttctgggattgcggacttgcggtattgtttgttcagagtctatgtgctgattccataattcagtcaaggccacatggttccagctgcgatttgagtgcaagtgatacatcatatatgttggtctgttggtcaatttgatctgtgttggtgtcttcttgatggttgtggatttgaaaggaaaatactattttgtgtttattgttcatctcaaagtgaatttaaccaacaatgtgttggctattcaatggaattataacttgttagggaatatattctgcagttataggcttatagcattgatttaatccttagttctttatgagaaatgcaagtctttctgtttcatatatgcattttaatacttgtagtgaagctacaaaagcttcttagaatgccctgtaatatgcattattttttaatggtgctactattgtaattccaatcctgaatgattctgatatttgtcccatagaatcaaagatgtatgcttgtactataaactttgcttgccaatattcacttatgaatgtaaagtttgctggttcagtttagttgtcattttatttactcatgttctcaacattttatttcattaactatggataaatacattattgtgcaggtatatgctgtgatgtcatttctttcccttgtactacctggtagcgccatctacttcaactctattcgcgaaatgtaagtttgactgctaaccaacccttattttatcctgtacattgcgccagtatacttgatataggtattgatacttacttgtttatgccttgacacttcatacactatatttagtttcacgaatctcaatatcttggtattaagaagatggcaaaaataccaataggtgtcagctttgctccctattgcaaaaagatttccctgttacaaggttgtaaaggcactatatgctagttagaggttcattgatcatgacctcgaagttttttctgaagtttcagggcacattatcgtttttcatactgcagtttctgctaagtaaatagttgcttttgattaatgaagtgcggcctggcattttgcaccaactaattctttttgtccgtaatagaagtagtcagtatgtgattccagtttgttgatcgatacttctttgggtgattcaaggtgtagcattgattcggacattcagtaacaacattttctggattaggatgctttgttgcttcagatccttgatagcctctgtgttatgcatgaaatgtaatcagcaaccacttttttcactatgtatattgttttagttaggggtgggcgttccgtttccttggtttaatcggatcggttttttcgggttgcctggaatttggttttcgtaaaatgtaaactgaaggaagttccagaaaaatatcaaccgagcaaaataaaccgaagaagatcggtttggttgttttgggttcagtttttactgagaaagatctatgccgcacactgcggttgactttccgcaagtatgcacggcctgcccagctctgcctgagggcctgtgcttgatttggagagagggaataggatttggtggatctgttagctgtcatgtattttttgggccacagtgaaagttgggcttgatgcacacgttagtgggcctcgagcattttggattggctgaacactcatctgtttcttcggtctcgtcggttcacgtgagatagaaaccgaagcaaaagccgaacaccgaactacaggaaaataaaaacaggacaatcaaccgatgacccaaaaaacggcctcttcagttcggttcggcttggtttggtgcggttttcagtcttcgggattttttttgcccatgcctagttttagtcaactttgttcctatgactgatcaatcctaaatacgtttatctggttattggtttgctttgttttcattgatgattagaggacacgttttgtgttttgtgcatgcatgcgaacagtatttaatttcatcggtatcaaaatcactaaccacttttttcactgtgtattgttagtcaactttgttcctatgactgatcaatcctaaatacgtttatctggttattggtttgctttattttcattgatgattagaggacacgttttgcgttttgtgcatgcatgcgaacagtatttaatttcatgcggatcaaaaccacagatgcattgttaaaaaaaatactaacagaatgctgtaacaaagattaaagcacctcagcatatttcacatgttctctatatatccaggagcatattacgtttgtcttttatgctacgatttcatacagcttgaacaattacttgaaggtacattatttattttgtgcagtacttttgcagaattccattggtcataatccataagaccacaaaggctttgcatattgattagatgtggtttttattgaaaaatcatggaaaaaaaggctggataaagaatttttcgtaagcttcactataatttcttgaactctcatcaaatgtgtgttggtgtacttacaggcaaatctataaatgacagaaacacgaatgcacttacactgtttagtcatgtttactttcatatgaggtgacttatctggtattgtgtttattgtgacagtaaaatggtattaaaatgttattgagcttttcttcttttctgaattgtgttttagctatgacgcatgggtcatctacaatttcttttcactctgcttggcatgggtaggaggtcctggtgccgtggtagtaagtttgactggccgatctctgaaaccgtcatggttcatgatgacttgctgtttttcagctgttcctctagatgggtgagttctgcacttccatgtttgaaattgcctatggtaactagcattatcttatgaattttgatagtgcaagtgctgatgattgatttttcaatgttcgctacaggcgttttatacggagatgcaaacagggttgtctgcagtttgtgatcctcaagccaatattggttgttataaccttcattctttatgccaaaggaaaatatgaagatggaaattttagtgtcaatcaatcctatctatacataactatcatctacacaatttcgtattcgatggcactgtttgctctagcactgttctacgtagcatgcagagatcttcttcagccatataatcctgttccaaaatttatcattatcaaatcagtggtgttcctcacctactggcaggtaaagtgaagttattaggattagttatttcctttctctatatcttatctcggagcctctggtctgatcaaagtgctgtatagagttgcatttattgaaacaaagtgatttctatcacagaaaccctctttttacttgatgaggagaagtttagtactccctctgtttcatattataagtcgttttgacttcttttctagtcaaaattctttagctttgaccaagtttataaaataatatagcaatatttcaaatatgaaacaaacatatcattaaaatacattcaatgaaactaatttggttttgtagatgatgttaaatttttctataaacttagtcaaagtgattaataatatgaaacggagggagtaacaagttgaagcttttctcacagggcgtcctggttttccttgctgcgaaatctagattcataaaaaatgctgaagaagctgcttatctccaaaattttgtgctttgtgttgagatgctcatagcagctattgggcaccaatttgccttctcgtacaaggagtatgctggttccaatgcccgtcctttcggtggattcaggggaagcctttttcatgctctgaaattcaatgacttctatcatgatactgtgcaccaggtaaacaagatatcgcaatatgacatcccccactctgcccttcatcctgatgaagagtccttcatggcacaatgactccatttgcattatgggcttcatctctgtcttaatcatgattgttcatgtttctttgcagtttgcaccaacatatcatgaatatgtgctctacagtaacgaggaagaggatgaaccgacaaaatatagctctgccagtgttgtgtcaacagtacaggacatacagctggtagaagtctctgtcgtggactcgaaagctccgttggcatcagtcatcctaacacatgaggcagataaaacaatgccctcccatggcatggaagaaactgttgccccttcagagccatacgacctctcaaacttggttgatgtagaactgtccaattactctgctgaggtccctgcaattcctgatgtggggaaacaatgatattgtgtgatatatatccgtcagatgtaaatgggtagcgctcacgagttgttcatagattacactgtaaaggtatccttgtaatcctttgtttctgccaatttttccccgttgctagggacgtgctgatatctttggttcaaattgagctaaactgacagattagctgatggtgtcaagtaaatttgtaatgtagggagaagagaatgtaacatgtttctcagttttgttgttgctgataaagcatgtctggtcaaatgcgttatgtccttatgggtatcgatgcactcctgttacataatcagagtgggtggtttgacctggcaaggagcagatcaaattacatttcataatgtattaatccctttgtcataaaatatatagcaacccaggactcaaatatctcgacagatggtatctagtaatccaatctggacatgtggtctcttgttcagatttgtaatactaggcggtgtctaattaagtactaggttggtatattactatattttacacagaaatttctcgacaggtggtatctagtactccaatctgggcaggagtctcttatctagatttgtaatactaggtgttgtctacttgagtactaggttggtatatttaacgacgaagggagtaagtagtttctttttttttcaagttcatatgcggatatgccccacggcaggattaacacagtagaacgctatgattaaacaggcagcatgcgagtaagcaactcctgcttatctggaatgcaaatgttactgtcgtctgtcgcaaggccaaacggaggtctatatgcacatgcactcatacagtgacaatcatggattcaggatcaaaatggttaccaagcggcactcagggacctgcggttgtggattcttcaggggacatgaggctgcttcatgacagcttccaggttcatcagttcatcactgcagaagaaattgtctcaaacaggcagataattcatttttggagacggaccatttcatctttggagatgatccttactttttcctaaacaagtttggaagcgctatattgtagctatccagcacaatctataaaagagtacatatttggagacattgttaggcgaaaaagaacacctccagatgctacattatattctcacactaacactccaagctgactaagtgaagtagaagggcacttctggataccattactggctgttaacatcttctaaaaagatctgggcacaactctaagtctctaaattacttcctttctacacagatcatacagtacaaaaacaaggaaatcattcttcagtatctcatctgaagcaggccagcttaacctcattcatcgtcagtttcgaaggattcattccagcagctttcatctgatacaccaccctggtggcctctctgtacattccaccgcgagcatatgccatggccatggcgttccagcacactgcgtcgggtttgccatcaatagcctcaaatgccctggctgcatctgcaagctgcccttccttcgcgtacatatgaagcaaccctgacccgacgaactggttcatgtccaggccacgcttgatggcatcagcatgcacctgctggccatagcatcctttgttcttcgcctctgcacagaccgcaaggatgcttgacagagagaagctgctcctggcaatgcccgaggaagccatgcccctgaagacatcaatggcatcgtcaagaatgccgtcacgatggtatgcggtgatcaagctggtccaggccgcctcaggaactggttcttggcatgagaacctcatcatctcaagcacatgccgtgcgctgctgagctgcccactgtcgcagtacagctgtaatagcgagctaccaacatcgccacagactccatttttcttgacaacaaaagcatgtacctgctcaccgaactgaagctcgttcacccgagcacacgaacgcagcaccgccacaatggcatgggtgtagtgatcaccggtgatcccccgcacttggtgacacatctgcacgaatagctgtaacgcgtcatgatggaagcaaccatcggagtaggccgagaccatggtcgcccaggtgatgccattcttgactggcatttcatcgaacacctggcgcgcagccccgatgtccccgcacgccgcgtatgcaagcaccagccggttggcgaggggcaaagggaggccagagacggcgaattttccggcgatgtgcgcgtggacggaggcgacctcggcggcgtcggcgcagtctctgaggagggagacgtagacgtcctcgtcgggcgggaggcggagcgcgtccagcaggcggagcacgtcgccggcgccggacgagcacagagaagccgtcgcgcccgtcgccggcttcctccttatgtccccatcgtcgtcgctggaggtggtgggtacggggagactgggacgcgggtgcaggggcggcggcggtggtggtttggtgggtttccgcagggccggcagcggcagcgctcccctggcggtggtggcgttagcggcgagaagacggcggcggcggcggcggggagagaggcgcggagcagccgcggtggcggtggcggcgaacggcttggcgacggagaaacgcgccatggatggtgtcgcgaacgggggcaggaatggtgatgggcgcacgcccgctgcaaaacaaacgggctgtttttctcacagcgccagtggctgtttttgcttatcccctgcgcgtgcgctgccagcgcctgctgtagtgctgtctgttgagctgtacgagtggatgagattaagattttcgtgttaagctttttaaactactgaacggtatgtttcgtgcgaaaactttctatacgaaagttgttctaaaatatcatattaatttattttttaagtttgtaataattaaactcaatcaatcatatgttaatatcacctcgttttgcgtaaaaaacttaattttcatctccatctttatttttaggagaaaagaacaccacctatgatagagagtatattattatctcggttccagaatgttccagaatgcaagaatatttagggttggacacggttattaaaaatgttggtagaattaaatggaagaatgttgtgattggataataagtgaaagtaggtgggaaaattgaatggtggagggttgtgatttgttgggaagagaatgttgatgaagaagttgatatattttgggacaaatccctagaggctaaatattgttatattttgggacggaaagactagataagctattgataaaccatgaggtccacttgatacgctcacaactttggtcggcacgatctttcggtgagttgatcatagctacaatttggcgacctcctcccccacccgccggccggcttgtccaatgaggagaaaagtgagagagagagagagagagagagaggtggaagggagaggaggggaaagagatcagatgatgacatggcatcctgacaggtggggcccacgtgggtcccacgctgattcagccgtcacgtcggataaaaccgaggttaaaaccgccgaaggacctaaagtgaacggttttgtaagttgagggatgtcatatctggttttgcggttgggggacgattttataactcgatgacaagttgacggaccttcgatgtactttttcctataggtaacataacaccttgtttctgtgactgtggccaacatggatggaatttggggatgaggatggatccattggaaagaggatcccaagagtttccatcaaatacttacgagtcaaaaacggagctcgtatgcttggcagccgtttgaagtcaatgttgttgcaggtggccgaattagattcagaacttctacaacttgatctttgatatcttctagttgcctatgatgtgaaaaatggttgaatctatcgtagccatgattacatcagctataaggttatctctgtttttcttctcatctctctatctcttacctatacatttaatttattcatctaggaatatgtaaatagctagcttttgtatgagagacaatcctcttcaattttcaaatcctctctcctccacataagtcagttgacttatagcctactattaaactttctctaataacggcctataaaccaattactataaatttatgtgcaggagagaaaaaaaataaaaggtgttggttcttatataagagctagttctacatatgttttaaggtaaatacattaaatgcataagtaagaggaagagaggggagaaaaaaaaagtaaagcttaccttataagggcaatctcaatccaaacactgcaaaacagtttccatacttgccatgtcataaatacactaggtatagttactgtatgccgaatgggtggtgtcatcaaactaaattctcatccaatcacctctcttctctaatttaatccacctattctttattttcgttcttgattcttgtgtagagctggattcttgtatgagaaattgtttcttcatctttttccctcttctcattaactctcttgctatttcaactttttgcttatgtgatagtatatttaatgcttcgacaccagctgaggtggagggttgtgactgctctaagagcatcaccaacagtctacctatatgattccaaaaattgattttgagggattttagtaaaagaacagctccaacagatgccctactctcctacccgagttttgcagttcccttctcccgattcctcgctgcatttatatacgggcgcgaaactcgctcccaatcttgcactccccgcctttctcctcccgttcccgcgcgtgggagatagcgatctttctgcgtatgaaagaaacaaaaacggaattttctgttagtagtttaacataagggcacacttttaattttcgaggattgaatttaggctatctgttggagggaggagttttttcactttctattttcagtttaggaaaaccaaaaaaataattttggggaaagattataggtaatttgttggtgatgttctaactaatctatatatattggctctaacataggttaatagttaggagttagctcgatctgctattaagcttgctctaatacatttattcctccactttatcaaatctcaatgctaattgtttcccactttatctactcccaatacatttattctctacttttataaattgcaatgcaatgattacgggatagagggagtactccctccgtactcgtaaaggaagtcgttttggacagcgacacagtcttcaaaacacaactttgacttcttttttctataaaaatatttattggaaagtgatatatgtatacctttatgaaagtactttttaagacaaatctattcatataatttttacattttcaaactcaataacttgagagttattcatgatttatattcccaaggtttaacttaaatattgtcctaaacgacttcctttataagtatagagggagtacatattaagtaaccgtctgttgagtgatacgagatatttttagagaggtacaatagcaggctataaattagctgtaaacatattttaaggagataaataaggagagagaatggcatcgggctacagatttgtagccagctgcagcacggactccaagacgcagggtgtgtatgacaggtgagaccaggtattaatagtgtactatgtaactattgtatgaatgagctattagattggctatagataaattagagctagtagttggctatactattaaacttgctcttaggtatttacatgttaagtgatttagaatatatttgaaatttttactattgtaaaaatgttattggctggtaacctggtcggtgtatgcaatacattgagggtaggcacattaaaagggaatcgttaaaaaaccgacgcaacctttttaaaaaacttctagatataactatattatatggtagtgtaaatttattgtaatttttatataagagtgaaatacatggccggtccttaaacttgtggtgtggtgtcacttaggtccgtgaacttaaaaattgcacgttttggtctatgaacttggtttaatgtaccacccccggtccaatcgtcctttgactatgtttgaccgccaacgtgatatgccacgtaggcaacacttttgtgctcagccccctccatatatatgttcgcacataacttgccctgaccagtgcattcaacccaaatcccccaaaatatccctaaatcggctagggtttcgatggtgaggttagcggaagaaggccgagaggtagcggttgtggcggcctcgacggtgagattagcggcaaaaggcagcacggtgcaacggggttagcagtgacacagtgcagccggattagcggcgggaagcagcgcagtgcgtcttgcacgctaggcatctacatggattctccaagctcgtccctgtcttgaagtcaccgaaagaaggtgttgttgatcaagtgtccgttgtgcaaggataaagtcattttggagcgcagagcaatgtcaattgctaatcgggacatcattttctatacatgtaaggagaagaatgagagggaagaacaatttgaggatttttttgggattctggtgtcactatataaccacgaggagatatatgtgacgtgttgtaatatggagggggctaagagcaaaagtgttgcctacgtggcatgtcacgttggcggtcaaacacagtcgaaggacgtttggaccggggtggtacattaaaccaagttcatggacctaaacgtgcaattttcaagttcacggacctaagtgacaccaccacataagtttagggaccggccatgtattttactctttatataatttatgtgcaagttatatgcaatgtttttaatactcatatacatattatataaaaagttccattataactcattatattgccgtataattacatatttaaatgttttcaaccaaagattttttagacagtcctgcgtgaaagatggcatgcagaaagtcttttttaagtggcggtcgccttgggccatatcctctggaaatgcacacatttctatatttctatagaagcggtcgcctttggaccaccgcctctaaaaatacacacattttcatctgcttacgatgaccacatgtggaaatgatgatatttatacaggcgggtggtttttggaaaattgtttcctcttggacctcgaaagtaaagaacatatgatgctccctccatccaaaaaactctagaacaaaaattgttaaagtttagatgggaatagtattttcttgagtacctatatatttatgatgttacatttctcatcaaatcaatatttttattttaaagtacatatattttgcactataaattttaaaacttactacttacgctataattttactactgctatatatgagaatttagacaaaaaatggaatgcctcttttaaaaagaacaacatccatcccagtcatgaaatgcatcataggcaagatggtgaggagactacacgctgagtgaatgtgagagttccaggcatggtttacatagttatcgcggttatcacctgcgataaccttatcagtttttaaaatcatggtatgtctcacggtaaccgcacggttttcgtgataaccgtgcggtaaccaccaaaccgtgggatggcagtaaccacccaaaaaacggtttggggaaccctggttccaagttcaactcctatatactagacgcgcatatattcatgcgtaaaaaaaaatcagaagctggaaattcattttcacaagcggctattaagaaccgcacatgaaattgtttcttcatgggcgaatgactttgtaccatgtaaatatgcgattttcacaagcctttgtagatgacttatggggacaacttgtttttttaagtagtgatagattatcagtgttatacataaggcatacccaatagtttttggttgggcttggcagggtccaccatattacaagtcttatacataatcatgacacatatacaaaaggtgttccagagataaggaaagagagacaaaattcggtcggacccggagttcggccaaacttctgggccacctcccgggcctcccctttggtggggagacttcttaatgggccctcaacatcatatactatggttgggctcaatcctaaatggtttttactgacttatgggacctccaatccgtataaacgcatcttgattgttcggaggtgtattttatcacatgacgggtgtgttttcttcataaaatacctacatacacatatttacgaacactagtggaaatgattagtaatagtccctaccactaagttggataccatattttatatcattatatgcaggcattgacggtcggatattataatttaaggaccgtcaacagagatcgaagttgattatcatggaaaagttttccaagtgtatagtacatttaattttcttgtgtcgccaatcatggtgatgcaaccagtattaacctgaaaatggatacaataaaatgcaactctcaatcggagcatttagctgaaatcccattttcgtcatttctcccaactcaaaatgtgtttgccactttttagaggcatcatgaccaaagtgccccatattgggattgattcagtccaaacgggaatttttttttggcagaaacgatcgattcagcacacattaggatcaattcaaaattgtctaaacaagatatcaaagtcatcaaattggatgctttgtgagcaacaattctggatgcaattcagtgatgcaattgattgtgtgagaggcacacactgagctccccccagcgtagtgttgggccttggtagccaagaaagcaaccacaattcatggatgctgaaccagcccaataggatctgaaggtagcagccacaatccaacacaatgctttgtttccgcacttcaaatcttcagatgcaactttccttgaacattctttcaccaactgatgaaaactaagggcaacggagattcgatggttggagcaactgaggaggaaggagcccatgaggtatagcacagtgagcccatgcctcctggtgcctgaccacatccctttccctcttggcgtggcctggttccggtaaaaactgaagaagagaaagagagagacactgatggaatatgatgcagcatgctcgacctgacctgactgaagcagtacaatcagggacattttagatggcaaatattggaaaaaaaatgggaaagccattttaattttggaaaatggcagaaatggagtttcagcatacactcgatgatgagagtggctttttatcgaaacccattagcgggatgtcattccagtgatacccacttttgatgacatcgtatatccaaaattctctgactgaggaggtgtaggggatgagtatctaataggttcctgatcaatgtgcacaaaacttataggactcatttatatgcaatctctaggtgtgcctcccagactagttggagaaagccataaaaaaccatcaaaatgtgaccaagcggaacctaaactaaaattgctagaagatgatgatggaaaacaagagcagatgatgccagacaactctacatgttcaaagggtacatccacgtataacactcgctggtcatcgagatttggccaccaccaccactacattgtttgtgcaacgtcattgagtacaacactggactattaagtttaagtccaacaaacgtcgtacaaggcctgagctgctcaaacccactaggaattaggatgtacctcaaaattgttgtaccgctctgtagctagggacgatgaacctgaacttgccaccagttctggatactaggtgtggacacatgggaaagctatgtaacaacatggacactttagtacgtgctttcattaatattacaaataatctttatcatgtgccaagattaaaatgcctaatctctgactgataaactatgacaccccggagtaactgaagaaaaaaaagaaagagataaagagaagtgctagtgggctgctttggtggtttttgggccaagctagctagagtgcagtgtgtgcagaagttgaaatgcgcagtaccacatgtagtgttggactttagtcccacatcgctacttagttgagatggacatgtttataagttggatagcacccaatgacaagtaacacatgtttgaacctttttgcgtgaagtgaggactgaggacgaaagcacagagtgtaggtatggtccaaaagtgagttaggcttaatcattttttggagttaggtttgaatcatttttgggcctgggcaatacataaatatgttaatttagttcatacgttatattatcttgtaggttagttaatgttcaccatttttgtactactttttccttgattcttctaaagataaagaattccatatatataagccatggcaatgacattaaccctcttcttcttaatgataagaatgaactcttgaatccagttgatgcgatgacaacactatttatgatttctatcgtgatcaacaactaatgatgaatagtaacagcttgttcaggatcgattgaactaccactgataagccgttgaaaaataaatgaagcaaccaaaaataatttatgtgtacaacttttatatatgtattgttcgcggcttagaagccaaggttggaaaatagacataactgaaaaaaaaacaaaaaaccaactcaaaattgttctagctaataagccaacaagcagacaatgagatgcacacactgagctacacgcaacattctaaatcatagctggtatgggatgaacacatgtaagtgttttgcacggttgtagatacaaacatatacccacgacaaattgagcattttaggcttgcatttctagccattatagcataaccttatcactttgatcaatgtttatcctattggcagctcataactactagaccatttagtgtgatagctaacctttttgagatgttgatgcactcggcatacatggaacgccatactctagctttctttgtggccgttggattgacctagatatgaacggccgatgtatccctgcgtcccctatattatgagggaagtcaagtccccatcttcgcactgaccaatccccttgttgatttgctccatattgaggttgatttgccttccctaatatcctcccccatcgacaattctggcccttgcttccttccttgggaggtgaattatagtggctacgattgactccttcctcaaccaggagttggtgatggcaaccgacaggatgccggatagtcactttatggcctctagcaatggtggggcctgctaccaaaacactcatggtactccaatcactatgggggtccccaacttaggttgtcttgttgctagcataggcattgctccgtcaagctctcttatgccggagaggggtctggcaaccgctaattacaacttggttgctaactttccagaagatgctgccgtggtgcctcaacaacagcagttgcaagctgcatctagtaacagcaactcagggttgatcaaaggagggtggacaagagaagaggatgagtaagtgacggatcatccggcttcgactcagatttttactcttgtttctcggcatctcttccttctcatgaagagatcgtgtactatcattgtgttttcttgattgtagagttcttagacagatggtgcgacaccatggagatcgcaagtgggcagagattgcaaagagcctccccggtcggatagggaagcagtgccgcgagagatggaccaaccatctgcacccggacattaaggtatggatcttgtgacattcctttggttacatgtgtagatctaagggatctagttttttttctcaatgcaatttttgaggtggaattccttttcggatttacgtaaaaatcctagaaatttcatccctccattccaaggtgaccggttattaactgctgagtacggtagtcatattgcataacttttgttctagataataaatatgggaatttcttcattatggccattaatgtgtcccatacttagtcctagggaactcgtctggacagtactccaccaagtttatttatgttcttagtcgttgttgtctatgctaattaagcataatgttttggacacttatagttaaaaatgtcttagacacttattagtccaatgcctatgtttttatatgctgctttatcactataagcaagcaatatgacattctactaggtttaatatattctttatttgtcgccagagtaatcaataacattatttggcagtaccctgcattatcatgtatatgtatatatgctttttatctctcaataaatgtgctcaaattaagaaaatcattaaataagaatccgtaaagttccggatacattaacctttaattgccttatgctgttaatcatatagatgcatccaatattaataagtagcaaatataaattacactgcagaaaggcatctggacagaggaagaggacaggaagctgatcaaagctcatcaaacttatgggaaccgttggtcagcgattgccaggtcgctccccggccggtcggagaacaccgtcaagaaccgctggaacgcgaccaagcgaagcctaaactcaaagcgccgactgaggaagaaaaacaatgagcaagcagtgccaaggcagccttccctcctcgaagagtacatccgtagctgccagcacccactgcccaatgagacagcaccacccgcatcattcgatatcggtgggtacggtaccggtgggacgatcggtgcaagtccaaccccacccacagtgcatgcgttgggtggatctactccactagggttggtgatgttccttgacctacttaaccaggctacaccgcacccaccacagccagacttgaacttgttgaacataacaccggtggtgccacatctcaacactagtgaatactgcctacagctcgatgcgaggggcaactgtagtatggccagctgccggtgcaaccccacgggatcagcgcccaggtaggcccaagcaacgtcggcaccagtggcagaaccggcggcatggacaacaatggcgtcatccagatggcgtctaaccagttcgtgatgccatctgagggtggtggcattcctgacatggccaggtggatcaactgaggcttgcttgcagtattgccggatcatcactcgtttaataattattattattattattatcatctctgagttttttttctttttggaatttctccaattaagttgaactctcacctacaattgcagtttgtatggctatatgcctatactttgatttgtttggaacatctgagtcttgagtcgtccctgtggtgtgggagcctttattaatttcttgttctttttaagatattgtttaatgtatgaacctttattgtgttgtgcttattatatttaaggtgtcaatcaatgtatgagttacattgttctagaatttttacttttctttctcaagaaaagtagcatatttaagttttatattgttgagtgggagagtggtagtatctggtacccgtcccataatacaaatgattttatgggaacacgcgtggggagggggatgtttttttaatgttagaaaagctcaaatatgtaaactagacattagagataactagataatacgagagtcctccatttggctgtagggttaaataataaggtagctctgctcgttaacttaaatgagttaaaagtgtagcttggcaagctgagtataaactgctattttaagctcgctgacactgtctaatttatttattgcacctaaaaaattttagcatttgaatttaatatatattaacaagataatataactaaatggtgaagtagtgattaagtagtgatgtactaatcttggaagtaacttaaatcattaagtactaaataagaatcactaagtataaaatgataaagtttactttttgcctactatgctcaaagtccccttttttaccctgaagtccaaaactggttgtgtttttaaccctacttcaacgggaaactgtcttaacctatcaatcccacattggtcaaaaaccattcaaatagttatgaatcttttttttttaaattacaaattcatatgacacacacacacgcccacacacacacacacacacacacgcacgcacacatatatatatacactactttacaaaaaaaaatttagttcctaactcaactcacaaattgagatataaaaaaagataaatttagcagcatatgaataatagtggtactatttatacatgaatttatcttattttcaatgtgtaggtcatatttgaacttgatttttactggagtgtttaggtatcactatactctacattatcattcttttcttaaaaaaattttataactctttacattgaatttggaagaaaagtctaccttggccagctaagtgtaaactggcttgtcaagctcgctcacatggtctaacttatttatttcaccttaaaaatgagcattttaatttagtatatattaacaagacaacataactaaatactaaagcagtgattaagtagtaatatactaatattggaagtaatttaaagcattaagcacttaataagaagcacaaagtacaaaatgacaaaattaattatttttagccagctctcatgtggtgtagtattttttttgtcactattggtatttcttaacgacattgttgacggtcgttatagaccaatttcaaccgtcaatataactaaaataaaggagaactaactatgcttgcaatggatatttattttagaataacatagttacacctgtacttggagtattatttgtttgcagagattaatacataaatggagaagaaatgagaaaacttcacttctaagcaagcttaaggataagatgggctcacttgtcaggtgcaaccgtcccggaaaccgccataattgccacaaccgtcatagggacccacctgtcagtgaccctgggaagtgtggaggcctgctgggccggcccaggttcgaccgaaccctggtgacgccagctccagttggccttacatgtggacgtccaggattgcttgctgatggtggttgtggggcatttcatacaattcgcatcaattacaaccgtcatacttgcctatttcaggaggagctcattttactttcaacacgcactcaagcaagacttgatctcgatctctctctctaaagtttagtttagtgctctagtgctaagtgtagtagtgttccatctgatgcccaaatgttcccagcaacttttactgtaagggcaagagaaaaagagatgaatcaatgtttccctggggcctccacagataccacaatttaaaacaacatcatccggtgcacaatgtctcttatcaagcatgtcccttgtgtttaatctatcccacaacagatcaagccacatgaaaatcttgatcattttcacacatttggttttccagatccactagaaaggtcttggaacagagattctcatgaaattaggcctatagaacttatgagcgtaaaaggttagggaattccaaaaaaaaaaaaaaaccaagagtcacctctctatgtgctaggtcctaaaccatctaactctgattctagctacaaatattgtatataaacatgtggttcaagtggaaggttgaaacaatcttcaagatgcacattattataaaaacacaccaactcccatctgacagttgtatgatagaaaagacctggaaacttatactttctgatttttcccattccaaagatcatcccagaacaaaacagtagtcctagactagattgtgcattgtgatatggctctgtatatgtcagataggtggaaaattaaatagggaacttttgtcatgtaatatgaatcccaaataagtcttacccagcgcaaatcaacagtagtgtacaatttgtgaagatgttttaggagcagagccacattctgaatgtatagatttataacacctaaacctcttttgtctttcggtctataaactttgtcccaggcatatttttcaatcaaatgggcttgcttgtcattgacttaattttgtagctaagcttgcctcaagtgtgatcaacgttttactaaccatagtacgtacttgtggcaagccatcctatcttattataaaaatctacgcttaaaactaagcattgtgcttaacgctaagtcatttcagcttaacgctaagttgggatgggggcacgcgaccttgcgcggttgcgccccggagcactcctgcagtattagggtttccatgcatttgtacactggaagtgtgcctttatattgcccctccatttctacgtttgctccttcaagagacaggagctatactcgatcgagtagccggtatagctcctagcttgaaatcgactgccatggcgccagaggcggctgctcctcccgccggcgagaagatggccatccgcgtcgtgagccgccgcctcgtcaaggcctccgacgcctccatccagccacacgtagccgccgtctccaacctcgacctgtaccctaactgctagtctgctatcaagcctccatcgtctgcctctacccaaccaagcttcccaacgccggtgatggcgactttgacgccgtcgtcgccaccttcgaggccgttctcccgtcattgctcaaccacttctaccctctcgccggccggatcgtcgtggaccctgccaccggcctccccgagctgcactgccacaaccagggcgcggagctcgtcgtcggtgaggtcgacgtcgcgctgggcagcctgaactatgccgtgaccaactagtcggtgaagagggtaatggttccgtaccccaaggacgtgccgcgcgctgtcggtgcagctgctgcggttcgcctgcggcagcttctccgtcgtgtgggggaactacaacctcctccacgacggtcaggtcagcaccatgatcgtcaggatgtggtcggagctggcgcggacggggaggatctccgacggcttgccgattaaccacgaccggtcggtgttccggccgcggagcccgccgtcgtacggcgccgcgatcgacgccatgttcacggcgtacgacgacgggggccggctcgtcaacgccctgaccgcgcacgacagcttcgtcgagcggctgtactacatcgaggccggggacatcgcccggctgcgcgacgcggcgagcgccggcgccgagcagcagcgcgcgtcgcgggtgcaggcggtgtcggcgtacctgtggaaggcgctcgccggcgtggtggccgcgtcgtgcgtgcccgaggagcggtgctgcatggggtggtgggtggacgcgcggcggcgggtggcgtcgccggcgctggtcccggcgatgtgcggctactgcggcaacgtgacgtcgtacgctctcggcgacgcggccgtgggggaggtcctggagaggccgctggcggaggtgccggccatggtgcgggagagcatcgcgtcgatcgactacgacgagtacctgcaggagctggtggactgggtggtggggcacaagacggagaaggtgatggagaagggtgggctcgggctgggctcgccgacggtcaccgtcggacggtgaaccagacggtgttcgcgtcgttcccgctcgacaccgacttcgggttcggccaggcggcgctcgccatgcccatctgggaccacggcaagatgggctgcgggacgctggccgtcggagtgcgcccgggaggcgacgggtcgtggctcgtgagcgcctacatatggccgcggatggcggcggcgctcgagtccgacggcgtcttcaagcctctcacggcggcgtatcttggactcgtctagctttgctatatatgcgcgcgcggggcttttttttgccttaattattatatcgtgcctaagataacggccggccttgtgcgcttgcatttgggacttctgtgtatttcacttcaatttaccttttttaaataaaggggctgtctatacgacagccggttaaattcaatttggtttgatcattagaatttctgcctaattaaacgtacgatgttatcggccatcccgtatgccgagaattagttatttttagagtaactaggtattcaatttgtttgaagagtaactagtactctatttttaaagttatttttaactaatacttaattagttatacattaataaaccaccacgttttcgtgcggggaggtggagttccaaactttacctaatataacatataggaaaaagttcgaattaccccccaaactatcgcggcgaccgaattactgccccccccccacctaaaaactaaacattcctcacccctgaactatcaatactggactaattaccccctcaacccaatccagagcggttttattctatgtggcgtacgcgtggcagtccagtcaacattttcttgtaaaaaaaatagtgggacccacacatcattcctccacttcatctcttcataatctctctctctctctcgagcgggcacaagtgtgcacagcgatgcagaggggcaggcggcggaaagtggcgcgcgggggtggcagacgacggtggcgcgcggtgggcggcggcgcgtgggccggcactcaagcggacgtaggcgtaacagcagcagcaggagtgagggcggcgcgaggatccaccacgcctgatcctcgggagcgacgccggcgcgtggatgtggaggccttcatcctctagagcggccagcgggagtggacgtgggaggcgtccttctcctctaccccctcgccgtccccctttgccatcgccgccgcggcctccgccccctcgcctcacggccgccacccatccctccacgtgcacagtggcacgcacggtgcagcgtgtggacgggaggtgggcgccggcgcgcgggaatgcacggtgggcaacgagcagcaactcgacggtggcttggctgtgcccgagcaggcggcggcatgagacggttagcgccatcgcttgcctgagagcgtcgtcgtctttgagcttctaccgtgcggcgccgtcaccgcatggtccgagggccccgtgccaccgcgtgcagaggccatcgcctcctgctcctcctcaagccaccgcgctgccgtgtgccatccccttgttgtgctcgagcccctgcatagccacgggccactacaccgccaccatggcctcctcctcctcgtcgtacccgccgcaattgacaccgcctccacccgttcgctcccgcccatcccggcacgccgccgcccacctcccattcccgcgccgctgtgcctgctttgcgcccgagagagagatagaggaagagggaaagagggggtatgacatgtgggtcccactatttttaaaaaataaaatgttgactggatttccacgcgtacaccacgtaggacaaaactgctctggattgggtaagggggtaattcgttcggtattaaaagttcagggtgaggaatgtctggttttcgggtttaggggtaattcggtcaactgcaatagtttagaggggtaatttgtactttttcataacatgtatacaactataaaatatatgcaactttgtaacttatataggttacagtgtagttacgctattgttgtagtgtaattacattggtatactacgactatactatataatactatacatagttacaacttacaacagttttagcaaatcataagcaagcttataacaaattgcaagcatatgaaccaactaaagcgaggactcggtgctaccaataaagtttcacgatgtttcttaaaaaaatagtcaaagaacattcaattgaaaaatgagaacatcttgcttttaatctaaactttgttccacctgttttctatacaaagtaatacgcatgtccgcgtgaatgtactaactacagctaccttatcttaaagaataaatttcaaaaaactgcaactttagtgacaaaactatcagtttgctgcaacattagcgacatgtttcagattgctgcaacaatagcgtgggaaattatcacaaagctgcaacttttacgttatat

SEQ ID NO: 68818 - DNA, 669 bp, Oryza sativa
attcctgcagcccccaaaattaaaagtggatcttttgttaaactaccaatagaaatttctgtttttttcattccacacccagcatgctcccaacataaattttcagcgctcgcacacgtaccagagattgagagtcgctctctcaccctcaaaatccatggggaaggagagagaaacacaccaactagagatggggagttgctctcttacctttaaatccacatagcaagatatatggggatagaaaatccaaaactactgcagtgctttttggatctgttggatcggattttttcactgaaatctctcgaaatcaattttgggaataaaataggatgattgttggtgatattaatcccttgaatttgttcgcttctacaccctcgtatttcaaaataaatacatctatcgaaaaggttattctagttaaactcttctagtacttcttgtatgaaagttagacccaacaatggatcggagggtatgtataatagatactaccaaaattttatatttttgttaagacttatcaaattttgatttggtattaagagcgaaacgtccttgaatttttaaacactttaatagcggaagttgagtgttttaactatatctagtctattatcttaaaaaaaggtaaaattgaaaacttcaaggaccaaaacgtgc

SEQ ID NO: 68819 - DNA, 3323 bp, Oryza sativa
agaccttaaaaacaatgaaatctaagttcattccctcaaagatattacctaataacctgcaaaaacttgctctgctaggtaaccaaattattaaggcacattccactggtgaccactataagcctttaaggatcccagtacaatttagcatccctgctttatcaccttcctttcatatatatgcacaacagtgcttaccctttacagcccgggcgagagagagttatcagagtcttcccatggatggcatgttcgttcccttactcccactgttcatatgggcttctagtttttgccgcactcaacatgcagaccatatcagattgcttggtctgacattttatgcaaacagaaatggatattttttagataatgaacagaaatggatatagggcataaactttacaaaacattgcaggatgctaatttttcttcttcttcttttttttttttgcaggagactaatacttcctttttacctctatatcaacgggaagaagatgtattcagcatagaagagattccaaatgaaccggtagtactgtgaaatagcatcctgcaagacaagaaaaaatggtaattatctatgcgagaagcaaggtgacataagtataattgaaacacaaccatatttatcccctaaattatgtcctatcagatatttacggtagttttgcaagtgagcttacaagaagaaatgggttaaccaaatttaaaatcgaagcccaatgattgagattaggatcaattgtgccatctcatccaaaaacaaggacagtcaatttgcatatgtgacatggcaagtggcaacttgagatttattttaattgtgttgctcttttgattagtaaggaggcgcaaaatgacatatcttcccaagaaataaaaagaccttacaacagtgagatcatgttaaagagaatagaatggaaaatatttgtttgagtaaaacagccacaagcaagctcacatatagaatgtttctattagcattttatactaatgaagtatcttatttttctaacaaaagaagttctttttaaaaggtttcagaactgaagtcaaaagtttcaccttagtatattttgcttgctccagaacccatgtctgaaaaaatggaacagaaaacaaacaagttacagttaaaatgtgtgtaacagcttcacagaagcaaaacaagatactagctgtgaatgaaactgcttcttatcaagtcattattctgtagccattttagtttctgttaaaatttatgtgcagcctcacttagcagttgttttgacaatgacacgttaaacctgcaagccttccatgtgtgtaattctatataattcaataaaaaaactaatgggcagccgatcatcacaacccatgaagtaagctaacaatgtcaataaactaatcatgaaacattgtgccaaatagttagagcatagatacacgagggtttttcgtctctagaagcctaacacatatacctggaaaattataccaacggcaagggcagcatgcacaggcaccattacagtgcgcctgaaagcctgcatattggaacataatcagttattaaaaaggaaccacgtaatgcatcttagtattgcagtatgcaataaaaagcctaaacaccttgatctggaaagtccaatgaccagaaaaatatcctcaggagttaggataaaagaatttacatgctgacgcggttcagaaatcacaaatataaaaggttgagtttggcaattctttatattgaacaatatttgtagaatattgtagtggaaaatcattgaaaatactattgcttgaatcataaaaaaaatacaaacaaagaacatacaagtcaagctaggaaatattgaaacatatgacaagccctaacgtttgtatggaagtggactccctagcaagttggaaatccaacatgccaaacattggcaagtcagaaataaactagtgatctaagtaggatgtcaatcttacaaaaatttggtagcaaatccaatgcatgccaattgtgttcactgctaccaaaatttggcaacaatcggcatagaaccatacagccccaaatgttaccatcacctattctaggtggaactactaagaggataaacaccaacaatagcaccgtatagttatgtttctaccatataataccaatttgattgtcctccaattcatggttttaccatctaaacatcatccgcagttgaaacaggagaaatcaacaaaatacagtataccaatatccagttaaatgcacaacatgccatacaacatgtgctgcatgtttataggtgaacaggctggaatattaaaagtagtaaagcaacctgaggcatgagaaaagctacagcaatagcagcaacataatttgctatcaataaaccagagccaagaaatgcaatgtttctgacaccgagctttgtcgccaaagttgatatttgatacctgaatgaggaaaaaagatataattagagtgttagtagtccactcattgacatttattaaacaatggtatagtgtatcagaactgcttccaattgctcctattcaatcttaagcaaagctaaataaaaatctgttaagcttaaacatagaattctgcacctttttcacatttgtgttatgttttaatgtactacttcctccgtcccaaaatataacaacttctagagttcacactttgtcccaaatataacaacctagtacttgtaaaatgtgacattgaccactaaactacctataccacccctaatatcccttggctttattatagccctaactagttggcctataggcaacaaagtctttttacccctctccttaatacccatgctgaaggctaaaacctgctggagggagtatatttgattgcttgtttcggataagatctcctaaggactagaaattatgtaacacaggcataacttatttggctaacaatttggctagcataatttggagaagtacataacagtctcttgatgagggttctgtctaccattttggttatgtcgggccaatgcctctgatcttgccagaatcagcattctctgttcgcctagtaagctggtaaccccagaagtactctgataatttcttgctgtctacaaaagctggcgttctgtcctttagtttatagaaactaggtgctgcaaccaattactgccattttttttgggacctttaatctaaatattgcattatccaaacgacaaggaatggctgctcaaagagaattatttactcatttgtgctttcatcaccataaggcagtgaaatagtagtttatttgtgctgctcaaatacctgtatgcaatatt

SEQ ID NO: 68820 - DNA, 13116 bp, Oryza sativa
gcggtgcacaacgtgcgcgcgctggggcgcggcgcggtggcgtccatgacggccgcgtccgcgccgtgacgtacgtccggtgggcggcgacggcgcggcgggtggtgacgtcggcggcggacggcacccaccgtctgtgggcgctgccggcgccggcggcggcggagacggcggcgagggaggtgcggtcgtacagcggccacgtcagcgggcgaagcttcgtggggatgggggtgtggcgtggcgcggggctgatcgccagcggctccgagtccggccacgtcttcgtctacgacctccgctggtccaagcccatctgggtccacccattctcccacgccgacgccttcgtcagcgcggtcgcatggcgccagctcgccggcgacgacagcgacggccagctcgtcgccggcggctccgacggcgtgctcaagctcttcaccacccaccgccgtctcacccccgacgtcgccggcgtcgggggcgacgacgacgacgacgtggctgcatgacagtgagcaacgcattgcaaacacatcatcatcatcctccattaattaatcatcgccaccgtgctcgaccgtgacgccgccattcttaattaatctcttctttgtgtttgtgtttctgtttaatcaccacatttttccttccattttcttcttttcctttctatactaaaaaaagggagaaagatatggatgtaatgctcaagttgtcagagaggaggagaagaggatgactgatggattaagattcttttcctttcctttttttttgtttgattcgatcggtgaatgtgatcgatgtgttcctgacagtgtacacgctgatttattctttaaacaagaataataatgcttcaataaatttccatttaccattgatccaacagcatgcattataccattgagtatacttacatgttttttttcactttatgagcgccatttgtgtatgtttcttcagttcgattttgcgcgataccacgcttttttgccctcattttctttcgtaaaagttttagatgctgtgggcctaatcaatgttacagtgtcggcccatactgcaacggagtcattcggcctagtgttagcccaaaggagttgggcctaacaggtaaggcccatttttggtatcggcccacataaactgggcttcatttggcccagtcaaggtgcgattactgaataactattccttttaaataagaaactgcacaattttgtaagtagatttataaagttcagtttgcattttttatttgaaagtaagtttaatttgcattaaagctgtctttaactagatagatatatctattatattgatcttgctatcacttatgtctgaaaagtttgtccaatgaactggtttcgcctatcttctttcctgcacacatagactccaaagctgtccaacgaactagatttatagaaaataaattttcattctcacttagactcaaaaggctgtcaaatgaaataaatttgtatatcttctttcaaactttagactcaaaaggctgtcaaatgaaataaatctgtatatctttcattgcctgaagtactcagcctactcaattcctcatggatcccctctttgcctccactttggtcactagcttctcctaatctccttgcatgaacattatcatcaatccatgataatgtacttaaaataatcggataagcttttctttgctaccaagtatgcataaacatggtactttcagaagcaaatcgttgctgctgcatgctgattaacaagcaagttaaacagcatccatccacttaatcaccatcttcagcattcctctcaaaatcctcaaggatgcctaataattattcgtgtacgtgcttatcaagatgacataatttttgcagccatccattatacttaattctggcaagatatactgacaatttgcagtgctagtcttcattattcagtgagtacccggatgagctgtacttgtgtatacaattgggccatcttgcctgtctctgtggattaattctgaagagagcattgacttgcatcccatcattgcaagtacaaagaagccctcttgcatgttcctgcttcatttttttaattttagaagcatattttgcaaatcaccatcattttcccaataattctttaatcattaactaaatcagtagtactacacatttacattacattctagatgtgacaagaagcaacaagcctcgcaagtcaggatgcagttcttaactaggactaggattttatgtgtgtgtggaactgacaaaagattcctttatccttcttctcttcagaacagtgctattagtttaaccactgggacataatgtatagggcaagatgcctgaatttgttcggggattaggtgtttgtccacatgcacttatgcacaagtcaatttgcagacaaatataatttggcacagggccgtatacttaattttgttaataaaatcatagtgttgtatacttgtattagtttatcattgtcggctaatgttgagagaagagagctctgatttttttctcatcagcaaatctcattttttgatgctgaggaagagaagaggagattaagacgcctctgaagctcacatggaaccgtccctttttgtaggacattatattgttgtgtattaaaagaggacagagatatcactagtcatgataggactcttagagctaattattattaaattttagttctttgttctttcttcgggtaaataacatctatgcgttggatcatgctttgtttgttttcggttctcgtgtctcgcgagcatgttgtatactgatttcagaggatgtaaaatcgttaaaattttataatgtagcttaagctcagcatacttgtggagttctacaagtattagtatacttagtaggctgtagattttgatgcttttcagctttctgcaaactgaagcactgaacccattcacatagagctactaccctgaagaacaacgagtcaacatctagctgaacttaacacttcatctttttctgaaattaaatcatgtcagcaccagcagtaaaagacaaacacatggcatccaaaatgcagagattttgatgtaattttagatcatcatgacgcaaacttggctttcgtttatttgacactttcggagaagtctttgtttttcctacgcgaggaactcgagaagaagtaaagagaactggtgtacctatactgggattctaagaacaactagttcgaggaaaggacaaaaatcttgatgaacagatgatgttagctgtcaaactgcacaaactagtaccgtacttctcttgcaatctatcatcatcatttcactatgaaaactaagacagacaactagccaagtgtcgctgaattaggacaatgccactatgtatcaccaagaggaaaaacaacaccgatttctgtattgtatatgatgagcacatgaagccgtgtaaaatgattgtgattctttcactctgaatttcttctgccagctatgttgttcttaaaatttcataagaaaggagcattgtggtttggcattcaagctcaacatcattgttaatttgtgcttctggggtccttgtttatgtatggcccttgtccatggtgcagttcatcttgttgatccttgcagatgcaaatccttctggatggatgctaactagcctgtcttttcttgtgtccttgggcaattcttcatcctccttggtgttttgtctaggcagatgctttcaatgattggcaattggcattaagagagggtgattaaatcatgtcttgtcattgctaatccaagagcctgtttgtttcatcgcaataacagctcatgtcaatgctctactcatcattggtggagacagtctgacctttatcacgctgattactggataatcatgttttatagtaaacaaattggatggccattatcactctactactaatgcatggccctaatagttttacagggtcatctgaaaatactgcctctgaaacgaattactttgtcagtaaaactctgataactaacaattttggtactaaaccgatggtctaagtaagtaggtaattaacatatatactatcagctgccaattacaataacaatatagtcaccgacttaaaaacaaaaataaaatgtggtcattagtgccagcaagcatccacatcattagaacaaggccaaaactgaaagaataactatcagaatctttttttgtgtaatgaagagaaagaggtgacaatgtgatatcctctgaccaacgcctccctcttgatgatcctcatgcatgtgcatgtattacctactcattcccaccaattaaactaattaacaccaaaatgtgagaaccccctttaaatgacaaggggtcacatggtgctgaaaggactggcacaactctgctactgcaacagctcatattgagacaagaccaacatacaggttgcaggaggaagaacaggaggagatattcagagaaggaaagaagagagcaatggggtgccggtcctgcgacaagccgaagatgaactacaggaaggggctgtggtctcctgaggaggaccagaggctgagggactacattgtcaagcatggccttggctgctggagtgctgtccctgcaaaggctggtgagctttttgcttctctctgtctctactgtgaatgcacattgctgcattcaccaatgcatccctcttcacaattgtgaattctagcctagtctagtcccctctctaattggtaattagcagttacagagagtacttagctttgggttagttcaagcttagcttgatcacaattcttaggccagttgaaattccagccaaggaagaattctcacccttttttttccaaaataataacaaaagcattacagtacatagagtctagctctctaaagttcatcagttgttcacttgttcttaaataaaaatgaaatctttgtctcattcactgctattatttctgacccttttttctctcctttttatttccaaaaggtttgcagagaaatggcaagagctgccggctgcgttggatcaactaccttcggccaggattgaagcgtggaatgttctctcaggaggaggaggacattgtcatcaatcttcaggccaagctgggcaacaagtaatcctcacacctgacaatctctatgaacaggatgatacaaaaccaagctagttctaacttgtagctgaactttaccttgaaattcagacaaaacaacgtcttttaagttaaaaaaaacaaagctcaagctgtcacagaataacaaaattgagcattttcaattgttccatttcatctacatgatgctgattgttttgagaaatttatgatcaggtggtcacagattgcgatgcatctgcctgggaggacggacaacgaggtgaagaactactggaattcctacctcaagaagagggtgatgcaggcacagggctccatccctaacaatctagcagcagcagcagctgaggtcacctccatgagcaccaccgagccaccatcattgcatcaccatcatcatcaccctcaccatcatcagatcaagaacagcagcggcagcacgaccacctcccatgaccaagacgccaacctgagcagcggcggcagccatggcggcatctctgctcctgcacctgtcgctgagccatttgatcagcagcccaagagcttcgtcttcaccggcgactggatgccgatgtctgcggcggcggcggggcaggagagctactccatctcggcgcagcactggccggcgtccacggcgagctccggcaacgtgacgccgtcgcacggcggcgcgttcggggaccagatgagcggcagctacggcgcattgcagcagcagcatcagagctcagctgctgctgctccaatggcaggaggcggcggctactttgacctgctaaacatgggagacatctatggcggatttgctgccactagtgacgatctgctcttctgatgacgattgtgtgtgatatgatcgatcgagttcgtgtgttttgtgtgcattgagcgtaaaagcatcgaaagaaattgcggtatactgcttcattaatttgattcttctcttttgtaagaaaaaatgtgatgtagtagaagttaagcacaccctaggctggacatattctttggttgtttctgcaataaaaaaagtgtaaccatttgtctgtgtaaatgtgagcctgtaattctcaagtagtagtagcacaatacccaactgaaagaaaaagttttattgttggatcgagtaagtttgatgaattctccagttgctcatttgaataattttgaggaatagagtgattacttgtcactaataattgatgttcgaaaaaacgttaaacctctggatgtattcgcaattcatgcactcaaaatactccagctgtaattgatatgaaaatggtactatggaactgagccttacatagatgttctgcaaaattgtatagcttacatgcttcatcagagttcagtctacaggatgacttttttctccacaatcaccatcaaggtgatacactctacttctctcgtcaaacaatgcagtacaaaaccatgatagtaaaagagcaacaaatggggaacagaaattcaatgcttcttgcgagaaaagtggttgtcattcggattccgtttcccactgaacattgcaagggccttcctcactggaggtttcagtggtactttcttttcaccgctgtgcgaaaatatgtcctcgacacccaagaaatcatcgtcctatagagaatattattaatggttaaataaatagttgcttaactattgcgatacaaaaacaggaaaaaaaagcatatgcacccacagaatggagaatatctgtttagcagagcacatagttggtgtaaaagaacgttttggagatgttgaatttaagtgccgaaaagcaggcatccttataaaaggaggcttttcagtaaatctaacaatagcaagggctagttacctgcttgtttgacttcttcgatttagggtgcagaaccttctggggaagctggtcttcacgcaaaatgggattcttagttatggcatctcttccaccttggggcattgggagggaaaactgaaagaaaataggcatacaattaaaaagaaaatcttttgtcatcacagtaggaatcaacttggaaaggccaggtgggcacatggaaaaatatccaaccaaaagcattcagactaagaaatgaatacgaaaactgatgtagaaggccatagtatggcaggatatgtattgcgattcaccaaagagagtctagaaggacttgattagtaaggaatgcatacgggactggccaaagctcatggattttctacaccactacactgaagactatgttcgacacttttgaacctctgaccatcatacatattacaagcatggaaataaactatctggacatttggcatgagtctaaaatgtgcttttctatttctcagataacagtaaagcaaggcagcaaacaaaccaatattgccacaataatcaggcaagtgacaaaacataaaagtatctaggccacatggaagaaaaacagcattaagtttgaaactacactcacttttgtgcctcgaagtgtcacacgcggacgtcgtgaggccatagtgatcccattttcaccaactgttaccgaaaccttccgtaaggtgccaccgttgccacattttgggcaaaatattttcccaatctcttgggtcaccttatagcaagcatgacacctcagaacccacctgccaaattagcatcccaaagcattagcgttacaaagaaactactataaatagaacaagaactagtgcgtgaaagagctctgaagatgctaaaagctcatacctgtgcaactgacgtatttgcatgccacctggtgccaagagacggagaccaatctgcaggatgacattttgcatggcatagtcactggttatgcatgctacagtagattcagataaggacctcaacgcccaactctgctcactgctcccatcatctgcaagagatgaatcgacaccttcctcagagtcgcttttgatatccaaattatccaactcttcaatgcatgcgtccgtaccgccggtctcctcaacatcaccaacattgcctaccccattgtccttattatcagattgcgaatgatctgcaacaatttcaggttcattcacttcttggtgctccataacatcagtatcagcggaagggccatccactggattcaaaccattttcagataaaattttatcgtcatcaattgatggggcagcagaacttgtctcaatactttgttcagattccttgagggcatcacgtctcgccttccttcgtagatatcttctgtgtgtactgcgactaacagcaggcaaccaaccttcattattctcatcatcttcccaagcaatacctacatctttctttgcaggctgatgctcttcatcaccttgcttgtcagaaatactgttggtctcactattcggtatttcgtggttctcaagatccttcagtggaagtatgcgtgacttgagatccccacctgcttcagacatctggtccaattcttcccattctgctaggttctgcacattagagccccaacctggcagtggagcctctttcaggtttctcacattcaccacacgcagaggaggtggctgctcccgcaaatggttagtcccatggatctcagcttccagcatgtaagctagagcaataatcttgatatcaacatctgaaagcgtctggaggtctcctgtttcccgggcaaatttgacaactgccagaaacaaagattgagaaattagcctttctcatcattacgtcattcaaagatgaggaaaatttccatagtagaagactagaaggctaattctattctatagaaaaccatactgttgtgacatctaattgcttttgcacatgcaagccttgccatttccctcatgcttacattaagttttaagacaacaacattaaacaaactaccagctcatgttacacaaaggcaatgttttaaccacaaaacttattaaaccatggtcttggctacacctacaccgttatccagttcttagtacactcgtaccataaaatctattttaaggaaaatgtgaaattcactgatctgtagatagttttattgctaatactcaacaaggttcagtcagaattgctgaaggtagtacctacctttcttgacgaattcaggggcagggtcgagggtctcgacaggggccatgaggagcgcgaggcggcggcgcgcggacgcgtcgcgcacctcctccagcacctcgggcaccgtgacgaggcgggcggcggacgaggagagcgcggctccgcccgatatgacggcgttggcgtccaccacggccaccgccacgccgctcgtgttggcgcagctcgccaccagccggctcaccgcatgcgccgacgactcctcggccacctccttccgctgcgccaccgccgccgcgccccatgctcctccacctcctcctcctccgggaggagccgcagcttccggggcgggggcgagaggcggccacgcttcttccatggcggcggcggcggcgctagggtttttgggttcactttgaggctgtttggttggttggcccgcaccagtccatgcaaatttgtttgcgaccaagggacgaaaatcagactgacctacaaatagagggacccaaaatgaacttattctttggttgcctgctcgggccgggcctcccagcctgtccacgaggatgcaaaaaatagcccctcagccaggcccaaggcccgacggaaacggacttcgctgctcggcctggctcgactcgagtgatgcacccgctcacggaggatatatggggtcaccgctacttctccctctcgcgaaaaaactagggtttaccctagcggctctggcggcggcgaggcccctcccctctcctccgactccggctctcctcggtcgtcctccctctcttttgccggtcgtgccccctgctccaccgtcactctccgtcgagctgagcacaatggatagttgtccgtcgcccattgcaaggttgggcatcctcttccctgtcccagttttttctcctctatttggttgatttgctgtgatttgagtggatgagattctcacatggggccttcataaatctgctacattttcctagttgattttggtagatttaaatgttgaaaccatctactgttgctatccttctccttttccctcttatagttgcggaaaaaacggcgcgtattttagaaaaaatagaggggtcttattgcataatggccatcatatcatctcgccgcgataaaatggcggcgtcaccatccgcatttccccttctccgcatctcgcctttttcctcctccgggctgcggcaatggccgaaaccctagtcccgccgccgccgccaccctctgatccccaccagatctaggatttgtttgttgtttcacggtgctccatgcccttctccttcctttccaccacaactccgcccaccgctctcaaatccaccgcgtccacccccgcccgcctctgctcctcgtcagatccgacgcttaagcacctttccgaggtgtgatttttccccccgatggtattgtatcgttctcattctcttatcatcttgttgttaaggttgctcttgtgtggtagtgtatgttcaggtggtaggatttgtttgagttgatatcgctgagctagctgagctagatgattagattaaattggaatgaggcgtgcaagttaatctgcctgctgaactgattgtatctcaaattaaattgctgtgatgacatctaataggacggtatctgagcgacggatctatcctcgcgtgattatacctaaactgagactaaaaatgtctgagcaaaactctgcatttcttttttaccatctggaagttggaatatttgcttctcgctgttcagaactaagcagcaaccagcatatgctattcgtgttctgtgtcgtctttgttactgccttgaaatgagaatgatgatttgcactggatttagaatgattgttttgcactggatttagaatgattgtttgccttgatgattcctacaaggacggtatctgagtaaggttcttgaaagagtactccttatgtgattacatccaaaactgatcagagattctgagcaaacatgtgtctgaacagaagaaattgtctatcctgttgtacatttgactgtttctcaacctgagaaacatgttaaggtactacgtattataaggtagtacattttgattgagttgatgtcgctgagttacatggttagattggaatgaggtggtttttaagtttgtgggcctgctcaacttaatgactgtatctcataattgctgtgatgacatctacaaggacggtatctgagcgatggatctatcctcacgtgattatacctaaactgagactaaaaatgtctgagcaaaactctgcatatttttcactctgtgaaagaaggaaatattttgctgttcctgttctatgtaggcttggttacagtcatgctacaccccctattttttttttatgatgattgtttgctgtgatgacatctacaaggacggtatctgagtaaggtggctcttgaaagagtactccttgcgtgattacatccaaaactgatcagagattctgagcaaacatgtgaatctgaatagaaccagagtatcaatcctgtcgtacatttgactgttatgcaaacctgtcaatgatacgcgcttaatgtatctgcttggtttctgctctttttacacttaaacataatttccctttgaagttaacagttaggcccattaacatttcttttcttgattgtttgccatgatgattcctacaaggacggtatctgagtgaggaacctcttgaaagagagctcctcacatgattatatccaaaactgatcagagattctgagcaaacatgcaattctgaattaaataataaataatgaagtcgctgtgcctgttgagcaaaatccttcctgtgattgaactgctttcccagctgaaaagaataacatgccttcattggcttcactgtgtaagctcattatgtagagtgtcacgcaggcatgacctctttggtaaggacgatctgagtaaggaaccacttaaaagtgttcctcacatgattatatccaatactgatcagagactcagagaaaacatgtgtaaatttgaactgttctcccaactggatggaaaaatatatgcttgatgctttcactaggttcaatattctgccctttatatagtgtcgccccttttaaagcatcactacttttgatataatagatcagcccattgagatgttcattttttcccttttcttgcttgtttgctgtgatgactgagttttcttgcttgtttgctgtgatgattcctacatggacggtatctgagtgaggaactacttgaaagagtgttcctcacatgattacatccaaaactgatcaaagattctgagcaaacgtgtgtagatctgaattgaatagcatgtaacatccttgttgtgctcctggtgcaaacagcaagatactgtcattttttttactgtttttcctaactcaaaagactgtttctgttccttatatggtgtcaccctatttaaacacgcctactcctaaagttaacagataaaagttttcagaaatttagtttttccatcatgtttttgttgctcatatagtttcaccctttttaaccatgacacatattgtggctaatataaaaaaaagggataataataaaccaattgagatttttgctttgccttttcttttcttgcttgtttgctgtgatgattcctacatggacggtatcttagtaaggaaccacttgaaaaggtggtcctcacgtgattacatccaaaactgatcagagattctgagcaaacatgtgaatagaatagcaagtagcatgctagtcatgctcctggtgcaaaatcatgtcaatgtttggactgtttttcccaacttgaaaaaataatatatgcttcgttgcattccctgtgttcctgttccttgtatagtttcaccctttatgaggggctgcaggaat

SEQ ID NO: 68821 - DNA, 1026 bp, Oryza sativa
atattgtggctaatgaagtagcttgatttggccatgctttctgctcctgctagcaagatcaaactgcgatgattaatgttattagccgggagttgtctagctaggacagtgcgttgccttcggggttaattaggaggtgacaatgacatgtggggccctggacgggaggaaggccaattccagtacagtagcccggtactccatgtcactatttatcagggtcgttgtgagtggtttcgagcctcgaatatgtgatatagtacgcaggaaagagacggatcactggattgacgctttatgtggctctgccgcttcgcgccaccaattggttgttttcagaggcaagtggccagtttggtttggtgcttatccttttgcaactaaacaattacggagaccttaattccatggcctatctatacgactatactgtatctgctttacatattcaggggtttgtttaacgcatagagcgcctagctagtcacacgccacaatggccgtgcacaaaagcatcggttaatttccggcaatcgcatgcaaaggcaaaggaggttagggggaggaaagcgagcattaagccattaattcccctgtgattgttgtgccctgtttcgtgatcaagttgcaatgagacgggaatatgccgtgcactcgtgcaaccctcggcttttgcacctactcgagaacaattaagaaaaggcaagtgtctgtctggaggcactagtagatagcgtactcgttgcgtgcgcaggtgtaaagcgcaacggagaccaatctgggtgtgcgagcgagcggcagcgactgcgaggcagcatcaggatcgcagagttacaagttgcaagttgcaaggcctttccgagctccggcggcttctctcggttcgcctgcgagtgcgaggcagctcatgcacgcgttgtgttccccctgtctcgagagggtgttgtactgggcctctagtgggcttctttaggctacaattcatttcgtcggcgaatttcctataggaataagtccactttgact

SEQ ID NO: 68822 - DNA, 29316 bp, Oryza sativa
gcctcgccggtgccgttgacaccattcggccagccggcgaggccgggcggtggcgcgctggggcggcggcggcggcggtggcggaggcgctgaggagcggtggcgcgtgaggaattgggaaagagaggagagaggatttttagggttggttgcctgcacgaatcttaaagcaatcggatggtccaaaatttgcaatatttgtgagggggttttctgtcaaatgatctatagacagtccctttttatttgacggggcctttagtaaagaagaggaaaaagtacaccgaaagggtccctcaatttgtcatcgagttaggccctgtttagttcccaaatttttttcccaaaaacatcacatcgaatctttggagacatacatggagcattaaatataaataaaaacaaaaactaattgcacagttatgggagaaatcgcgagacaaatcttttgagcctaattagtccatgattagctataagtgctacagtaatccacatgtgctaatgacggcttaattaggctcaaaagattcgtctcgcggtttccaggcgagttatgaaattagtttttttattcgtgtccgaaaactccttccgacatccggtcaaacgtccgatgtgacacctaaaaattttcatttcgcgaactaaacgcggccttacaaaatcgttccccaaccgcaaaaccagatatattacatctctcaacttataaaattgttcacttcatgtacttcggtggttttcaccctagttttgtccgacgtagccgctgactcagcgtgggacccacgtggatcccacatgtcaggatgccacgtcagtacctctctcttcccctcctctctccctcggggacatgacggggaacagcggcaagagaaaaggcggcccggcgctccccggtgacgggtgcacgcgatggccacaaccttctcctccgggaggccgatgccggtgatcggttgaaggggttggccacgagcggcatgacggggctgagcgccaatgacgggaagtcgagcatgctcggtgacagcaccacctggtgctggtgctgcgctgccttcttcagggacgccgccccacggccgcggccaccgccatcactagcagagtgggcgggagtgggcgcgccaccggtttgagctcaccgagtgggcgcgcctcgtcaccgccaagggcgtggaggatatcgtcttcgtcaacaagctcagggaaggtgaaagggtagttgggacgacaacggcgacgggcggtgggagggcgacaacgacgacgtgagcggtacatggacgacgtcgaccattgcccgccagtgcctcggcgaggcggctcacgcccggccttgcgtccgcctccgcacccaccgtgtctcccgttcagctcgtcgccgtcggcttcctctgggccctcttgtcacgcccagaaattcacgaaccagaatttctaagctgaatgtgcattaaacccctgtccaggaccagccatggtacacaaacgacaattgttgacatacagatccacgtcttataaaaatataaaagattacaaatgcagcggaaaagataaaagagagctaagtctgaagacttgactcctgcagtgggtgactccattccacaggcatccttgacggcagcgacgaaaccaacttcttcgagacagctccaactgagaagaacatcaactctggtgtggggaagagagagcatgactgagtactacctactgtactcagcaagtcataccagaagggcaaaggaggctaaaggttcatttgcataaagcagacatttaaaagcagtagttgaaagcagtaaaacaattgttgtaattaatcaatattaaccaatcactgtccaacgctacaccacgttgcaacaggcccaaccaaccacctgaactacaccagttcattatctaactaggggtgagactaatcacggttaatctggttgaccacccataaccgcgggcacggctattcgaatagttttactctgatcagaggtgtacaactatacccacaagacacagccccatgacacgttttcgtgcgccgacatgccaccacgacataccggaaagaggccgtgataggacccttcgcataaccccctctaaccgatcgtaccacacctcagggttcgcccccgttcccagtaggcaacgggcagcccccctctcgtgccacggtgaatccgaaagccgatcaaccgaacaccccggccgacccaactccatcaagcccaccctaacctgggtacgtcggctagaggaaagctacactacaagcccagccgttgcccacgctggcttgtggtaagtacgatgaattcttccagggtttcccgcgaaccggtccttaatctccatgggcacgactagtaaaaccatgcacccacagcccaccatgtagtgtattttaattagctaacaccattgcggtgtcactattccaaagctatgccaataattaaagtctatgcattaatgtgattccccctttatgtaatagttgaactaaacatggctaagcattccctaaaccaacatctaatcattttaatacccaagttatcaatggcataaggtaaacaatatatggctgagtagtaggacccatcccacatgatattgtaaaacaatgcaacatttaatagaaatgcgggacatttgtaaattggttacaatatgatcaattgtaatgcatgacttgccttgctcttgtaccaatgagaccacagcaatgtcttcggggaaccgcggatcaacgaaacggccgaaatctatgcgacaaacaaagcacacaagcaaaacaggctataagactactgaaacagagaacaaaaccatttttaatggattctatcatttttatgaatttacttagacttgaatgtacttaatcggaactcggatgaattagttataattttagaagattaaatgtgtttttactataaaaagaaaagccttaatgagatttattgcgcaataaagcatcccggataacgttagcaaaggggggggtttgcttaaataggagcgggggcggagagtcgtggccgggaaaccccccgatttggccagcgacgtgggggagtggggaggaagagagagggagggattcgaaacgaatcccgcccattttagggcgtgtgcgagggcggggaagcggggaggaggcggcgacgtgggcgcgggtgcggagtggggcgcgagaggagcagcgtgggggcggcggtttcggtggcagtggtggcggttgccggaggttagggacgaccccgacaggtggggtccacctgtcggcgtcccagagagaggagggagggagtttagactgggccatggccacggggctggcccagggaggaggggaagatgtgcgcgagaggcgggtggactgggccgacggcccaacaagaagaaaaagggagaaaagaaaagaaaggaaaagggaaatcgatttccatggaattaaataatgcacatgctcatttttaattggttaaaattattttttgggctctgaaaattccactaaaaatcctgttagaatattttgacatgtagaatccaagaaaagttccacatgccgattctaattatgatttgcatttttttgatttagggtttctctcttgcttttaatcaaataatttcttgcaacaatttattaattgaattttggctagggtgaagaacttcagggcgtgacacctcttcccctcatgcctccctctcgccctccccgacggtagcgaggtgtggtggagctcgagggcagcgagggtggcgcggcgtcgtgggcgggcgctaggtagcagagctcgagaacagcgagggcggtgcggagatggggcagggctcgtggactgcgaccccggcgcggcggcctgctcccgcgtcgcaaccgccgccgttgcctcgtcgcccgccgccacgtcaccgaccaccggatcacctttcccacctcgccccggcgtcctcctccccagccgtcggccggcgttgcacagagaagagaagagaagagtgagaaagagaagaggaagggataggagggggaagaaagagggtgataacatggcatcctgacatgtgggtcccacgctgtctcagccgccacgtaggacaaaatcggggtcaaaaccaccgagggacctggtttacactggttttgtaagttgggggacaccggatatctggttttgtagttgggagatgattttgtaactcaacgacaagttgagggaccttcggtgtactttttcctaaagaagatagccaacagagtcacaatttccatggaaaccgattgaattccgtgaaaaaccgaggttttgacgtggctaggaagtagtagccgtctggaaattcgatggatttcatccaaattcaaaattgaactgatagaaaccaaaaaattcaaataaaatcctacaaaatagtatgatatttgcataacatgttgggttattttttcttcttcaaaaactcggtgagttccgtgcctttctcgaactgtacggtaggaaagaaaaaaataataatggtttagacaaaagaaaaccctttccttgaactgtacaggatgaatttcatgtattccatgtcatagaagctaccgtacaattacagtatagcatgtagtgtttattggactctaaactgtgtataccgtatacgtagagatggaaaaaacaatcaggcgatcggaatcgatcagagatgtaaaccattaaacacgcctctctagactctacatctaaaatttatatggtcacttaacctgaagactgttcataatcagaatgaacaattagatggacctcgaggcctcgactaattaatcagcctgactgttcattaattgtgtttggatgccccttttcccaacctctctctcgttttccgcgcgcacgttttttaaataaacggtgtgttttttaaaaaaaattgtataccaaaattattttaaaaaataaattaatccattttaaaaaaaatagcaaatatttaattaatcacgtgctaatgagctgctctattttacgtgcgtatgctcccatccggctgtagcgaacacacccaaaccatttgacaaggtaaggcaaggattatgccttcaggggacaaggattcttcagtattgttcaaaaaaaaaagttgtaaaaggaaaagcaaggattctgaccagcaactgtttacgaccatcttaacaaactggtgtgacacattacgattgaatcttgatttttcaaaaatactttaaatccaggatgagacgtttgcagactagcaaatctctctcctttatgggtcgcgtcaagcaagcacacgggttcttttcgcggaataagtttacttcatgaccctcaaagtcatcgaaatctaatccattaccctaaaccacaaaaccgaatatctcgacccccaaactcttaaaaccggtgcaatttgactccctgggtggttttggagggcggtttcgctgacgtgacgcctacgtggcagtattaactcggtcttttttccacgtggcgttgatgtggcgcttaggtggcattagaaataaaaaatatgtgtgggacccatctatcattcatacacaaaataaaaaattgtggggcccactgacatgtgggccctacatcatcctctatctcactacccttcttcttcctcctctctccgttgtttctctctctctcccttgacatgagccgtcggcaggaggggctcgagtgccggagtggtggtgggcgggtgccggagtggtggtggcggtgggcggtggatggtgtacctcggacgacgggcgcggaagcagctccttctaccgtaccgggcattgagcgacggacctcgggtgacggtgggcggtggacggtggggagcatgggcggcgggagctgaagcggcggcggcgacggcggtgggctggaccgtctggctgctgcccgccccctccatctcctcctcctcgtagtcgtcgccgctgacctccccgaccatgccaagtaccagatcgagaccagccgcccgccgccgccaccgctctcgtctccgacctttcagctgcggccacagccaccacccacgggacgcgtcgccgccgctccaggtcagcatgcggcagcaccgtcatgagcgcgagtgcgggaggaggcattggcagtggcgacaacacgagctcggcggctccgcctttcccctctcctttccagccctcacgcaccgccaccgcctcacatgtcacccatcacctccgttccccccttacctgctctcctctcctctcctctctccacttggctaggccgatggcgaggctgccgccaccaccgccgctctggcccccgcttgccgccgctccagctccagcctcccgtgcttcccttggccggccaaaggggagaggagaaagagaaagaaagagagaagagaggaagaagaaagggaagagagaatgacatgtgaggcccacatgtcagtgggcctcacaattttttgtgtgtgtgaatgacagatgggtcccacgcatattttttatttctaatgccacctaagcgctacatcaatgccacgcggaaataagaccgagtcaatactgtcacgtagacgccacgtcagcgaaaccgccctccaaaaccgcccagggagtcaaattgcaccggttttaagagtttggtggtcgagatatctggttttgtggtttagggtcatggattagatttcgatcacttttgagggtcatgaagtgaacttattcctctattcgctcgtgtgcaatgttcgttccgaacaacagcccaagcttacgtatatgggccgtactacggagcccaagcaaagattctcgtgggcttaattgggcttctcggccgaccacaagaaccaaatctttgcagaaaaagttggagcagctgccaactttctctggacgaacatgccattgccatccatgggaagactgataaatctctctacccccggctgtaaagggtaagcactatatatactatatgacaggaaggtgataaagcagggatgctaaattgctactaggatcctcaaagtcttatagtggtcgtcatatcattggtggaatgtgccttgaataatttggttacctagcagagcaagtttttgaggtcctatctttgagtagattcccttgttttgggatcaggtcacacaacaggtagtgctggaggagcgaaatatgaccttcttttacactacaagggaggttgactcagctcataaacttagatctaatattaaacattaaacaatgaaaagacatctaacattaaaagtacttcatctgcgttaatccaagctggcatgcttgtcgcagaaaggcccttcgacgaggagttttgacgtttccaacgtcaattgttgttatctttggggtaggtggcctctattctatattctcttctctgtacttactccccgtgcattcttttctactatcctctaggacttctgcacttacgaaggtgaagcttgccctgtgtaatatcatttgacgtaatatattcaagtggaaaactctcccaatacaaaacaaacagttctctaaaaaaatacaaaacaaacatattatccaaatatatttaattttatatttaataaaattaattgggagttataaatgttactattttttctataaatttaatcaaacctaaagaaatttgattaataaaaaagttgaacaacttatagtatcaaatagatatagtaccttggatggagattttgggatggagagggagtaacagaaatcgtcgcatgcaaggtggtttttctacggcatgcagcacctaggccgcatgccgttggatggatcccacgattggtgctgtatgtaaagtgctttgggcgtatatattttgtatattgtggtggacggtatataccagacattatacatgaggtaaagagaagactactttacaagccgtggtcccgcctcccccgctttttttttatttttcccctccaaattattgccgaccacacatctcgccgttgtgttccagaacacaccatccgcggattcccccttcctcccccgagcgccgccaccaccatccccccaccctcctccctcctccgcctcgtcgacgcggcggcgatggcgtccacgcggcagcagaacctgggcccggatgttctaccccatgccactgccgatggatgcgcggcggcggttgatgttagggtgtccagcgacattgccagtcaataagaaccgggcacaatcaagaagaacccggcggatgatgttagggtgtccagcgacggatctcatcctgagttgcgacgaacacgaatgccacaagcacgagagagagagagagagagagagagagaggtggaggcggcggaggggaggctgctgctgctgctgcggcggcggcgcatttgaattggggtgggaggaggcggaggggaggcggcggcggcggcggtggagggggatggtgaagctgagcacggtggcggtggtggcgtgggtgctggcgtcggcggcgctctgggcggggctgcactggcgcttccgccgcccggcgctgcacaaggccgaggaggccctcgtctgcatttgcgaggagcgcgcccgcatgctgcaggaccagttcgccgtctccgtcaaccacgtccacgccctcgccatcctcgtcgtgaccttccactacgacaagcaccctcccgcgctcgaccaggtcggtccgacgagcttccgccgcgatgatgatgatgttgcatctgttgtttttttttttgccccccgcagttaattgcgataatgcctcgatttttactcgacatcttggccgtgtactttgctctgctgctttcggcttcatttaattctacagtgaccttccatgtcagccatggccatggattactgctccggtcccttgttattaaatggagcgcactttttgttgggactgggaggaagtgaattgattgtgcttgcttgcttctgttggtagtactagtgatttcttcggctgtgtggctgaatcttcttcgttgtgttgtgcgtgtgtgcaggacacgttcgccgtgtacgtcgcgaggacgtccttcgagcggccgctgctgagcggcgtggcgtacgcgcagcgggtggtgcacgccgacagagagagcttcgagcggcagcaagggtggatcatcaagaccatgaagcacgagccgtccccagcgcaggacgagtacgccccggtgatctactcccagcctcccaggagaccatctcctacatcgaggaagaggagaggagagtcctaagtccatgtcaacatttcatatctcaggaagagtttgaagcaaatgaggaaacagggaggctgatctgtggccacagctatcatgtgcaatgcataaagcagtggctttctaggaagaacacctgccctgtctgcaaaactgttgtctcaaagacatgaaatccaatcagtccctaagcacacttgaactgaaaagtgtgaaaaggacttgctctttcacagtgttgtttgtgattgtacagctctgtttgtacatgatgctttgtgtaagcacaagcctgaagcaaaccatctcatttgcatatagcagtttacatgttttcagttttcccagtgtctactgagtgttaagcatttgcttgtagaaacttacatgttttcagttttcccagtgtctactgaatattaattcaggtgaaagaaaaaaaataagaagagaacagtttttttcactaatctcagtcggttttcatgtctgttggattcgttcgcatgcaaaggcaaccgtatccacccgatcttccggttggttttatatactgaattgctatatcttaatcgacagttttcttgcaacgaatatgtcacttttcatattttataaaaatttacacggtagttacacaccacttagatatgtaattagtatgtaattttaggacttacatatgtaattttgagacttacattgtaaatacactaaaattacatatgtaatttaaggacttacaatgtacttacaatgtaaaaacataccgactattttttggtgaaaaatatggcgccataaatatagctactcccattttttttgtttgaaattatattgcctttttctgaatctcaattctgacccctgcatttcccagcgagaagcttcagacagttcagtgtcaggactctcctcttcctcttgacgttggacgacggcgccctcggcttcgacgaggatgacatcctccgtgacttttccattctcgtcgtcgccgccgagccgctccctctcgcctccaccggcctcctcggcgtgttcgtcacctctgcatcggcggcgctcgcttctccgagctccctctcgatcgcctcggcccgcattgcgatctcctcgctggttcgccgcgcttccgtccacgcctccgccgccgccgccttcatctcggccaccgcgtggaccacctcggcgcgccccgtcaggtactcgtactcgaacctggggatcgtgaattcgtgacgttcctggacgacgagctccgcgacgtcgcggccgcggcggtggccagcgtcgcgctctcgacgatggccttcagcctcgccgtcgccgcggcctccgacgccctcgccgccccgagctccctcaccgactctctgatcctctgctccgccgcggcgatctcggcgtcgatgttctccgcgtcggacatggcgcgccggttctccgtctccgtcagcgtcttctccttctccgccgcctcggcgtcatcctccagctgccgaaggatcgccgccagcttggagatggtctcgtcggccctctcgtcggccgccgtgacggcttccaggcgagacctcgccttgagcagcttggcgttcagctacttcacctgcgcgctcgccgccttctcctgctccgtgaggcgggggatctcgtcggtgacccgcgccgtctccctgcgcgttcgctcgatggacgtcgtgaatcggaggccctcttccttgatggactccagcacgatcctcgccgagctcagctccgcctccgccgcctgcagcgatgactcttcgtgttcctgctcgtgtctcctcgacgccattgcagtggcagtgtggcacccgttgctcccaccactgccaggacgccgtgctcctcgcttgctccgtccgcatctcgctccacgccgccgccgccgtcgccgcgcgggccggagctcaccggaacattcttcggccggagactcgtcaagcctggacggagcgctggaccgctggttcggtcgacgggggatgcagtcggcgggcggcgggctgctttaaggaagatgcaggacgcgtgtgccggggaggggggcgcgcaggcgcggtggcggcgccggcgggcgactggcaatcggcggcggtggccggagattaggtcacggaggtcggaagctatcgagacgatggagagggatggaagatatggaatgtatcgaacatatatgtgtggtcgagaaaaaaagtgagtagtcgtactccgtagtccgtacaaaaagcatcttacggtggggtcaggtgtattttggatgcacgcgcaaaataaaaatacgacgctacctgtacatgatatgtaaaggtgtgcacgaatcttagagcaagttcaatagtatagccaactactagctctaatttatctatagccaatctaatagctcattcatacaatagttacatactacactattaatatatggtcccacctgtcatacacacactgtaggagtccgtgctacagctggctaccaatctgtagcctgctgcacttctctctgctcgtttatctttttaaaatatatttacagctagcttatagcccgctattatagctatcgtgcggatgctagccaggtgccgcagcacctaggtgctaaaaggacgttccgccatgatgtttagattccctgtgaccaatcgcgtaggtaagcatgaccaaactagttggccctccaacaagccaacaactactcctgcgcacgtttttttgtctgatgctgcagttttatagtactatgaatacagtctgatgagtgatgacattgacacccacctgctgcagttttatattgaattcggacagcagtcaccactccctcagtccctcgtcgcgtttcgtcggagacaatggcgacgccagcacctgatgtctcggccatcggcgcggccctccgatccccggcggcgacggtaagcgaggccgacgtcgagaagctccggctcatcgaagaactgacctccgacgtggacgccgtgcaggagcgcgtcctctcggagatcctcggccgcaacgccggcgcggagtacctcaccaggtgcggccacgacgccggcgacaccggccgcgccaccttccgggccaaggtgccggtggtgtcgtacgacgacctgaagccgtacatccagcgcgtcgccgacggggactgctcgcccgtcctatcgacgcaccccatcaccgagttcctcaccagctccggcacgtcggccggcgagtgcaagctgatactcgtcgccatggacgactccggccgccgccaggcactgcacggtctcattggacctgtcttgaaactgtaagtcaacctcttctacatggcacttcgccagtccgaagaaaagtgatatcgaacatttcgcaatgtatatatagatatgtccctgggcttgaaaagggtaaggggctctacttcatgttcgtcaagtcagagacgaagacacgaggcggcctcacggcgtggtttgccctgacgagcgtctacaaaagcgagcaattcaagagcatggcaattgcctacacgagccccacggcggccatcctctgcgaggacgcgttccagagcatgtacgcgcagatggtgtgcggcctgtgccagcgccacgacgtggtgcgcttcggagctgtgttcgcggccgcacttgttcgggcgatccgcttcctccagctcaactggggccagctcgccgcggacatcgaggccggcgagctcggcccacacgttgccgatccgtcggtgcgcgaggccgtctccgggatcctccggtcggacgccgagctcgcggagttcgtccgcatcgagtgctccaagggtgactgggccggcatcatcacgcgtatttggccgaacaccaagtacgtggatgccatcgtcaccggcgccatggcacaatacatccggaccctgcagtactacagtggcggcctgccgatcgtgagcacctcgtatgcgtcctccgagtgtttcttcggcatcaacctccgccccgtgtgcgacccgtccgaggtgtcctacaccatcatgcccaacacggcctacttcgagttcctcccggtcggcgaggtcgtcgacgcgaccaacctcgtcgacctcgcccgcgtggaggtcgggcgggagtacgaggtggtgatcaccacctacgccggtctgagccggtaccgcgtcggcgacgtcctccgcgtgacggggttccacaacgcggcaccgcagttccggttcgtgcgccgccaaagcgtgctgctatccgtcgagttagacaagaccgacgaggccgagctgcaccgcgcggtggagcgcgcctcctcggcgctcctccgcccgcgcggcgtgtccgtcgcggagtacaccagccgcgcgtgcaccgaacgcatcccgggacattatgtggtctactgggagctactgaccgagtcacccgtcggcgccggcgacggtgacacggtggacggggagacgctcggcaggtgctgcctcgagatggaggaggcactcagcgcggtgtacaggcagggcagggttgcggacggctcgatcgggccactcgagatccggatcgtccgtcccggcacgttcgaggaggtcatggacttggccgtctcccgcggcacgtccattgggcagtacaaggtgccccagtgcgtgactgtcccatccgtggtggagctgctggactcgcgcgtcgtgtctagccaattcagccctgccctgccgcattggatcccgactccacgatccgactagcaatgcatcctgtttggcatctttattttaggaaaggaaaacgtacaccgaaggtccctcaacttgtcatccaatcacaaaattatccttgaatcgcaaaccagatacaacacgtcccccaacttataaaaccaatgcaaactaagtccttggcggttttgactctggttttgtccgacgtggcagctgactcagcgtgggacccatatgggtcccacatgtcagcctcttcttcccctcctctctcttctcttcctctctcatccctttccacggcgacggtgatggagagcagcgatctgggagtagacgacgttcggtgggggaggagctgggcccgaccggcgaccggcggggaaagagcggggcacggccggtgagggcggagatgggcgcggccggcagccgacggggaggagctggaggcggcggtggggacgccgcggcgacggcagcggtggaggcgggggcggcggcggaggcaggggcgggggcgccgcggcggcggcgcgggagcgcaaggccgggagctaggttccgcagggcggggaggacgacaaggtggtttggcggcgaggcgggggagagcaaggagaggacgtcgatggtggtggccccggccgcgacggccgtggcatcgacgccgctctccctcatccacgcgaacgcccctgcagcgctctggaacgagccgcacgcggtcttgatcccgacgtcggtggcccggtccacggcgagcgcgatctgggcataggcaaggagcacgtcccacctctgctcgagggaggggtccgggagcgacggctgcttgacggagctcgacacggtggggcacgcgcggcatcccaacgtatgcgcgctcctcggctgttgcgtcgaccgcgacctctacctcgtcttcatcttctctggccgcggctccgtctccgccaacctccacgatcagtacaccaccaccaccacccaatgacacaaacgtaacaccaaacagtaacagcacgaacacgccgccattaatggcgtttgacgttttcttgatcgattttgccccgatgtgtatgttgcattgcagacgagaaggcgccggcgatgtggtgggcggtggggtggattgcttcggcgcgtcggggcgggggatgtcgtgttgagatccgccgtcgcctcgtcgcccgtcgccggccgccgaactctcgcctcccccaccggcttgctgtcctgcccactgccgaactgaggagagggagagaaaagaggagagagagaggaagagaggggatgggaagaaggggctgacatgtgggacccacaactgagtcagctgccacatccgataaaaccggagtcaaaaccgccgggggaccgccgggggatctagtttgcactggttttgtaagttgggggacgtgttgtatccggttttgcggtttaaggacgattttgtaattcgatgacaagttgagggaccttcggtttacttttcctttaggaaaaggcacggcccaagataagtcgagccggcacagtccgatcgccacggtgtgtcgtatctgtccacgggctgcacctacagcccagggatgacctaataggactcgggccgtgctgtaccagtccgaaggcacggcttacccaccgcgctcattctcgaaataaatctattttgcctcccctatctatttgggtcgtgtcttatatggttaaaataagtttattttgcctccctcagctcttcgggcttgctgtcgacgggctacttcctgagggagtgggggatgttgggtcacagttgtgctgatcgttgggttgtgccatgctaggttggcacgccgtgccaaggaagagacctaggcacggtccaactgttgggtcgggctggcagggctcgacaacagtcggggcgtgccgtgtctgagtcagaccaaaccttagtgttgtgggccagatcatcgggctacaggccttctggcctttactgctgcagttttatggagtctaaataaagtctgatgggtgtcaatgtcatcactcatcagattttattggataagtttacctttggtccctcaatttgtcgtcgagtctgaaattcatccttgaaccgaaataccatatataacttatccttcaactcgcaatactgtatcaactttagtcccttggcagtattgtggccggtattggctgatgtggcgagtgaaactcacgtggccccacatgtcagcggctcaactcttctacctctccctcttcccccctctctctccatctctcgcatcgaacgacggcgagtccgggccagggatggcgcgctaccgtgtggatggcgacggcggcacggtagtgagagcggtgtcggcacccgctcatgccgcaccacctcgaccagcttcgccaggacatcacctttctcatgacgagcagatttgagttattgatctttttttcttccttctggttctcctttgctgtttgccattgagagcaaagctgagttcttgatgtccctacttctagttctcttcacgatctgtgttcttatgccttaatgcctttatgtcgggggaatgtacggtggtgaaaaactgaaaaaaaaacacagcaccatctatagattttagggggcctgtgatgatatatgcctggaacaaaaatactcactttctggactgatttggctttgcttcaccaaaactaggagctttgcttcttctctgaaagcgtgtatgttgtggactcgtcctgccgtcgcaccgccactgccttttggaggatgagctcgtggtgacattcattttgttttgttggatttgctgtgcgttcatgcaggcgaccactcgacaagtcgacatcgactgcatacacggcaccaccaccagcaagagggccgcggggaaggacaaggccgccatgcaggagtgtcatgcgtcgccacctccagcaaattacttcaagaataaggccgactacaatgctgctgcagcatccgcatccgcgggcgccatcaactacaagtgacgatctacaagcccgggagcggcggcgctgagacgggctccgactccgacctcaccgaagatgacaacgcctgttgggaatctctcctctctgaatgtttaagtactaatcactagcactaacataaacacttgtatttactcggtggacacaaacacacaagaactgaacaacgcacagctttggtcaaggcaaccacacaccggctcacttcgttttctttttcttttatagactcacacagtacatgcagataacagccagccaattctcatgaccgggactcacgctatgcacacaaacgtgcagatgccatgcaactaactaactaactaatcctacttattctcctgcgaagaagtcacttcgcggctgcttatccgggatgctgatcctcatgcatagctagctcctaactaatctcatacgtgcatgtatgcatgcatatgctaggaccgattcactcggctaatactgaccttgcgttgcttgcaatccggctacttctctcagcactccacatgcagttgagcctggtcttcatgaatgttgtttgctccactctcgcgccaccgcatcgcacggcacgtcggcatctcgcccatgagatggaaacaaactaactatgcagcgtccatgtacctcacgtacatagcttctagcatgtgacctatacaaaccacttactacatgcatatgaccaaacaaaaaacatacttttacactaatgacaagattattgctaacaacgccatgctcaccccgggcccccggccatggtggacctccccgacgacgtcctctctccctgaggcgacggcaccgatggagtgagctggaaaggtggtggaggcgatgtgtgcgtcggcggagcgacgcgtgaagcgaggagcgcgtgcattgcggcggaggtttgctgttcatgagagatggggaagaaaggaaaaatggagagaagatttggtcgctgacatgtggatccacatgggttctactcgctacgtctaccgaaaccggccatcatatgatcgagggatgaaagttgacatagtattgtaatttggggatggaccatattggtggacctaaattgaacttattccgactttattcatactccataaaactgcagctgtagttggccagaaagcccgtagcccaatggtctagcccacagcacagagatttgatccgatcagacatggcacaactcgactgtgctagcccgacccgactgttggaccgtgcctgggcggctgggcctcttccttggcacagcgtgccgatccggcacggcatgacccaacaatcagcacaaccgtgacccgacatcccccgcttcctcaggcggtagtccgttgacagcgggcccgaagagatgagggaggcataatagacttatttcagccatacaaggcacggcccaaagagataagggaggcaaaatagatttatttcgaggatgaacacggtgggctggtcgtgccttcagatcggcacagcacaacccgagtcttattatgtcgtgcctaggcgtaggtgcagcccgtggacggacacggcatgacacaacacggtgtgtcggtcagactgtgccgggccgacggatgttgcactagtggagaacccatttttactactggttggtaactctctttagtcctggttttccaactgggagtagaaatccgggactaaagatgaacttttttagttctggttggtgttaccaaccgggagtaaagagagaatagcagcagtatcagatggtccctttttcttttcttttttcctttttattttctcccgaatcaagtgacatgcaaatccccaaatccccaaatcaaagtaacatcccaaattcacatcacaaaatccacatcacaaatcttaaagttacttatacacacaaatcaaatacatcacaaatcctaaataattatacacaaatcaaatatatcacaaatccataaaataaatcacaaatttatacatctcagtgtatcacaaattaaaaaaaaacaaagccgctaccgcccctcgtcacggccgccgcctgcggccccgccggccgccggcccaccggatgggaaggggaggaggaagaggagaggaggaaggggaggaggtggaggagaggggatgaggaagagaggatagatctgatctgtaggagaggagagggggagagatttgatctgtgtgagttgcgattgtggaggagaggataagtgatagggattatatactacgcgttcaattttagtgccggttagtaataggactaaagatccagatgatctttagcgggactaaagatcctcggccccctgacatacatctgacaggggatgaacctggactaaagatgatctttagtaccggttggtaataacaaccggaactaaagatgatagaatcccggtagggtttttaaccgggactaaagatcatttttagttccggttctttttggaaccgggactattgtggttttgggtcgactcagcaaagatcatttctccactagtgttgggccgtgctttttcccaaaggggataatattaaactactaggcggcgcctggtagtatttctgctaaaaaaaacaccagtagtgacaacccggacaagccaaattaaatcaacacatataccctattaaaaaacggttttgctatttcacttgcgatagatttttgggcttctacctttcgatttttgaccgtaggatcttgtgtcaagattcatgttcctttaaattcaacttgcagttacacttagttacataacatttacacttacttacatagcacattcaattacagtgcatcaaaatttaatttttacaacaactttttttcgttagatttatgatttctgacatgcttgttcttgttttgttaattcactaaaaagagttattacaaattccgcaagatttgaagttacagatctatcgaaagataaataggtagttcctttttttccaaaattaagatgctaaacaggatgcattgctagtcggatcgaggacatcttcgggtcatggagccagggtccagtgtggcagggcggggctgaagtgtcccgggacgcgttcggtgcacgcgcggctggtgtactccacgatggacgcgccgcgcgggcggaggagcgccgaggaggcgcgctccaccgcgcgctgcagctcggcctcgtcggtcttgtctgcctcgatggatagcagcacgctttggcggcgcacgaaccggaactgcggcgccgcgttgtggaaccccgtcacgcagaggacgtcaccgacgcggtatcggttcagcccagcgtaggtggtgaccaccacctcgtactccctcccgtcctccacgcgggcgagttccacgaggttgctcgcgtcgacggcctcgccgacggggaggaactcgaagtaggccgtgttgggcatgatggtgtaggacacctcggacgggccgcacaagggacggaggttgaggccgaagaagcactcggaggaagcatacatgccgctcacaatcggcaggccgccgctgtaatactgcagggtcgggatgtactgtgccatcacgccggtgacgacgacattcagacacttggtttttggccaaaggcgcgtgacaatgccggtccagtcgcccctggagcactctcggtcctgatgaactcggcaagctcagcgtccggccggaggataacggcgacagcctcgcgcacagacgggtcggtgacgcgggggttgagctctccggtctcgatgtccgccgcgagctgagcccagttgagctggaggaagcggatagcccggacgagcgcagcggcgaacacggcgcctacgcgcagcacgtcgtggcgctggcacaggccgcacaacatctgcgcgtacatgctctgtgacgcgtcctcgcagaggatggccgccattgggctcgtgtaggcgtaggccctcttgaagtgttcgcttttgtatacgctcgtcaaggcgggctgcgccgtgaggccgcctggtgttttcgtctccgatctggcgaacagaaagtagagccccttccccgtgtgaagcccaggcacgtacctatgaaatgagtgcaccattaactaccaaaagtacttctaggagggacatggaaacggtgaaagatctacaagaattgataatagagagtacaacaatatctaccactataccacaaattaaattcaaaaatcgatctacacattaataaatagaaaagaaaattttggatatgctcgggacgcaactcagcatcggacgcctgatgggagggggaaaaatcgggtgccgacgtcagcatgacgcatgcgtgcaaaaccactttaaactattttttctcttaaattatttattcaaatcatgatccgattgcactattaaattcgttgcatttaaatctttaaaacaagaccacacatggatatattctaacaattgttttttgcttattattgaactatttttaaatattgcacgctgttccaccaattatatcagaattgtttcctaagtagatcaaaaatgtttcaatcgtttaaatcgggcgttgtttcaccttatataaaaataatatttcagcaaatagcgaaagaatgtttcagtgcactgcaacatttgatccatacatagtgaaacattataagtacactaggtaaaatatttttggtagaacaaaaaatgaaacgaattcccttaatagagggtttccataatatgtgggtgatttgttgcaaaaaaaatttttaattcactgcaacattagatctatacatacatagtgaaacatttttggtggaacaaaaaatgaaacgaattcccttaatagagagtttctaaaatatgtggctaattttgttgcaatgacatgcgtgatgggacacgtggcgggagctgcggggggacacgtggagagaaggcgtgtgcggaggaggcgcccgtggggggggggggcgattttctccccccgatccggggcattgtccatatgcttgatatgtcttttttatttctcaaacgtaagggttgaaagttgattttttaggaagagtatatacatattgtatgaacattatcaaattattttacagggttttataattaactatatagatggtatcagaacatatgaggggataatgggacattatcccgaaagattaaaagagttttcccttctccgagtgtgtgctataatttttttaaactattgtttttggaactacctatatatttctcgataaattttctcttaaaaaattaacagatataactataatataattattgtgtaattatatcgtaacatgtatataacttgtacgcacctttcaaacattctatgataactagttgggcggcctgcacaattacgtggctagcatcaatttaatattatctattttttacacatgattttatttaaaattatcattcccgtgattctaataattttatagtttttaaaagccacgacagtcgctaccccttactcctttggcacctatttatttacttacttgatctaccactacttctattcgtcctctttagaactttaaaaattaggccctatagtttttaaagttcattgtcttgttgggtttcgttttcatagtttttagaagtatcatcaaacatagccaatttactactctgtggccagtccactgccacctctctttattgtcattgtgattttaaaaatcaaaaataattattgtctatttccttttttactttctataagtctcgccaaatcgttagtggcttcgccgctatactcctctacagcccacccgctgcctctcctccttattgttattgagattttaaaaatagaaaatgattatcattggggtttatttttactctccataagtcccgcaatcgtcgtggccatgcatgctgcttaacggcatgcccattttcactcctcttaattgtcattgggattctatttgagatcattttgtatagtttttagatatcccatcaaccactagcactctactcctttacatgcctattacttctcccctctttattgtcacttgtcatcgttgtgttctataaggaccttttttttaaagaaattggatatttttcatccttgaacacttataattatttttctatttttcaaatttattttatttgttatttcgaactttaattaattttgtcatgtgctctagattgtctcttatttcaatacttattattttttattacaaattttagttatttataaattgtattctagttgagctcttattttctttttctattttctgaatttattttatttttattttgaatgttaattaatctcgtattgtgttatatatagattattcttttaatatttttttattatttccaattttaattgtttcaaaattgtatattcctacttgaactcacttttttattttttttttatgattttggattttatttgattttttttattaatctcgtattaatatcttatacggactcttctttcaatattgcttatttttaatttcgaatttttgttatttttaaattgtatttctacgttaacttttcttttattttttttataatttcatattttattttatttttattctgaattttaattaatctcgtatttgattcttatatggactcttattttaatattctttatttttaattctgaatttcagttatttttaaattgtatttctacttggactcttttttttctagtttcagattttattttatttttattctgaattttgattaatcttgtattgggttcttatatgaactcttctttcaatattgcctatttttaattccagattttagctatttttaaattgtatttctacatggactcttcttttctttttctcctattaatgtgggaatttctaaccctcacagcgaacgtggtgcctactttcaaatatgttttaataatatagtagatagatagatatgatattttcgtgaaacggaggttgtgggatcgaatcccctcacgtatatatcagcacacgaattgtgaagcaaatctaacgattctaaattacatacatgttacatagtaattatatataaattacactacgactatattgtatttacctttaacaatttttttttaaaaataatttatcatcaaatatatagcaaccgataataaaaaaatgtttttatgtaataattcaaactttcaattgacggcggttaacttacacgttcaagacagatgtagcgagactgctcagcacctcgcggcgggccatctcatccgtgacgatgggcatcagcttgcgctcgccggccgaagtgccggagcttgtgaagaactcgatgatggggtgcgttgacaagatgggcgaacggtccccgttggcaatgcgcttgacgtacggcttcaggtcgtcgtacgacgccaccggcaccttggcccggaaggtggcgcggtcggtgtcgctggcgtcgaggccgcacttgtcgaggtactccgcatcggcgttgcggccgaggatctccgccaggacacgctcctgcacggcgtccacgttggaggtcagctcctcgatgagccggagattctcgacgtcgggctccttcgccgccgccatgagcgacgacgacaggctccgcgaggccgcgccgatggtcgagatgcctttcgctgccattggcagactggctccaccgaaacaattactacgagggagtggttgctagatcgagctcgtagcgtgcaagggacaggaaatgatgtgtgtttatgttgggtggcgtatttatgcttacgtactactagtaattcacaatgtaagttattctattatttttcacatttatattgattttaatgaatctaaataaatatatatgtctagatttattaacatcaatataaatgtggaaaatgttagaatgactcacattgtgaaacggagggagtacaaaattgcagctcacgcctcaagggcttccataagacggtacgatgtaacattttatatgacaacatgtgcaaagggtagtcatgatactcatagaagctacaaaacgttgacaaaatgacgttaattaatataagtagttgatatgctagtacttcttccgccctaaaatataagaatctagaaatagataagacatttcctactattatgaatttgaacagattcataatactattaaaaatatctcatctgttactaggtttttatattttactttatttcatgttatgagacgttttgacttctgttttaagtttgaccaagtttataggaaaaagtagttacatttttaactcaagacaaatttattatgaaaatatatttaattattaatttgatgaaactaatttagtattataaatattattgcatctgtctataaacttagttaaacttaaaacagtttgactttaatcagagtcttacaacctgaaacggagtaacggagttagtaggatggatggagtactaaacaagctcaagtgcccatagatcagatgtttttttttctaggggcagtgatctaagggtgtgttcagttcacactaaaattataagtttggttgcaattggaacgatgtgatggaagagttagaaatttgtgtgtaggaaagttttgatgtgataaaaaagttgaaagttttaagaaagtttgaaactaaacacggcgtaacatggctgatctgcgaataagagacgcgttgcgaagtggaataattacgtggaattgtgttttttttttaaacggcaagggcccagactagggccttgaaagatctggatggatgttgcaaaagtgatacagtaggagttttacagcagggtcctcagagaaatataaattacaaacaaaccctcaaaaagagaaaaaaccttagagcctattcagattgatgacattttcaatcatatcattatttagtaaaattgataattatgtggttacgtttagtttgttaccaaatattggcaatatgtatagaattttgacaacattattaagccaatcctaccaaaattttggcaatgttgctaatttgttaaaattttggcattgccaaattttgttaaggtttattttagcacccatcagaacagacccttttagggcccctttgatttgtaagaaaagtgtaggaaatttgaaggatttcaatcctataaaaaaatttcctatgaaaccttttgaaacaaatgattgaatcctatactatcctttaaaattcctatgaaatggataatcctatagagattttggaggaaagttagcaagaggtccaacctcatagaaaaattcctttgagtctatctctctcatccgattcctatgtttttcatgtggtccaatcaaacggtcattcatgtgtttttcctatattttctaatcctatgttttacacctgcattcctgtcagaatcctgcgtttttttctattcctccgtttttctattcctgcgattcaaaggggccttaaagatatgataaaaagcaattgggtccttgtaccaccatcggccgagctattttcggtgacgctggcgagccttcatggatgaagtggaaaagcaccttgagctcgtcagtcttgcacagctcaaattgcagggcctccaatcggtggaggtttgcttttgattttgccggaggtatgaagaacggccggctcaaccttacagatgatgtcgccggaagtagaagaaatggccgacgctgacctcctagaacttgcgttagaaatttgaggatggagtgatgaaactcaatttcgacataatctttttccagattctattcttgccatgggttcacgaacaagagctggcttacccaacacaaaggccaccacaggcagtttattccaagggcacaaagcataccatggccgctgacgtcggagtaaatcgaagccaccagcccaccaccaccaagggcaggatggacgccggagcttggaccaaagtagctttactaaaacacgccataacgacgactacgagactaacccaactatgctaatacttaatacgggcggagctagacacccccccccccctcccccacccccggccggagacggaagggagggggccagaacggtggaggagtttttactctcagtcgctggagctttcgcgagcgaggcgttgtttggttctaaactttttcttcaaacttctaatttttttatcacatcaaaacttttctatacacataaacttttaacttttccatcgcatcgttccaatttcaacgaaacttctaattttgacgtgaactaaagacaccccaagcccgcatggaagtagctgttcccggaacgatagctcgtgaggttttattcgtgcagattgatagtactattaaataattttataaatttacttgtatatttggatgagttaatattgctaattatctgctctaaaagatttcgcatgtcaagtgatattatacaatattaaaatcggctctttaccagtttaccagaagtacatagtgtttgtttggtgggattatattactctagtaattataattagcatgaatgatttggttggctagaaaggctgcacaagttgattggcaattaatggatactaaaattgaacagccatcgataagataccaaaaatctaggtactttagttgatggacccatattctattttatctcatagacattattttttctttagtttataaaaaaatagattttgtgatgtacaaaaatctgtagaatattagtcatgtatttttttaatttaatatatcttaagcgatatatattgtaatatcttttttatatcacttagcaaaataacatttttgaaatggcattttagaacatatcatatttgggtggtgagtcgatattcatcttgatatattttctatacatagactataacaaaaaaatattttagaatgtaacatatattttctatatagactatgaaaaagcgatatatcattttgtatcatttttggaatgtcattttcacaaatatcatattttggcggtgagtggacattgatcttgatatattttctatatagactataaaaaatatatattttagaatgtaacatatatatgtgtaaaatatcagacatgtgatttttttttaattttaatacaatgccaagtgatataacccatttatatagccgatagacacgatgactaactgataaaaactgaaagtactttagcgattaattgaagtattaattattacaaatttaaaaaataaatttattttatttataaaaaacttctatatagaaaatttttatagttcgggaacgtgcgcacattaaactagagatttttttcaaccaaaactcaagctgtgtttagatctaaagtttggatccaaacttcagtcctttttcatcacatcaacctctcatacacacacaacttttcagttacatcatcttcaatttcaaccaaaatccaaactttatgctgaactaaacacagcctcagtcttaccgacatattactaacatttggcttatccaaaagtcgatagatcacaagcatgcccatgtgtgacgttggcttggctaaaagaattgattacagagatgctcctgtagagagactttcgtgtcaggatgtgacacttggactctgggagggcatagcacaacacaactttctgggagggcagagcacaacacaacttgtagtaccaagcaaacaacttggtgataatgaaacggagtaggtgcatctcggttgcattaggaacaatagcttggtggttgcggattgagggatacaaatcaaatccgacatatatttgagagagttaacgtgaacttattccttacctaaatcaagtatacaattggtcacagggaatctaaacatcatgcatccatgcatcgattttttgttactccttcccgtctcaaaatatatatactttggtggtgttcttttatcctaaagatgaagattaagttttttacgcaaaacgagatggtattaatgtatgattgattgagttttaattattacaaacttaaaaaatatattaatattatattttagagcaactttcatatagaaagtttttacacgaaaagcaccgtttagtagtttaaaaaacatgccacgaaaatcttaatcttaa

SEQ ID NO: 68823 - DNA, 22426 bp, Oryza sativa
gcatgaacctccagaagatccaacacctcgtccaggcggatcaacaactcttccagacgaacgaacacccccaaagaacggacaagagaaatgcaactgcagaaatttcatctcatttcttgatcacaaggagccaccaaagaagaagcggtccttgagtttgacgccgacaacgccattgagcaactttactgcccttgaaatagaaggacctgtgaggacagtcaggaatggtagtgtcgttgacatatagaactagtgtgtgtaaaaagctgagatgttatatattttggatctgagatatgccatctttcggtcaatctcctcaattttagttgagagaaaatataatcagaggctgcataagatgctatctgtagatttcaagcaaatccggtgatgggaaaaattcatttgaggccagtttggcaactgaaaaactgtatagaaagttattcttgtccttgatggtattttgaatggaggaaatatatacgtctgtttgattaattttttcatgaactttctcttgtcatgcttgatgtgtaccttgtccctgaatctatgtgagcagtcaagtcttcaacttttctgtctaaaccatatgaaatcgcaggtgtctcgattttgaaatgctaaaggaatctgttgtgcacttgtgattgcttgaggtgtactgcacataagagaactataaagcactggatgcagaagtcctttgctgctgggaaaagctcccatttttttgaactgaatttgcaggctatatgtttcaaaaaagaaaaaaaaaggaatttgcaggctcataatacataatccattctagttaaatgtatcagaataaaacaggtcactaacaagttttgtagttgcaacttagcacttattattagtttgagtaattagctgcaatacattatgacatataagaaaatcaagttaacaacgaaataataacaattggaaaaatataaaaaaaaggggggagatggcttttttatttttttttttgaatggaaatggaatattctgaatttctgaattattctcggtagacaggtagcatctttatggatatgatatgcgcgccatttcggctcttctcctccgtccccttcctccgctggattcctccatggcttcctcttccctcccttctagaaccttctaccgccactcgcttccctcctccgcacctccacctccttcgagaggggcctgcgccgccgcatgctgctgcctccgcgcggccgtctcccggcggcgggcagccgcgcagctgctctccgccgccggattcttgatcgccgtctcgccgccttcgctagccgcgcggaggggccgcatggtcgtgtcgctggaggactacgtcacttcacgtacgctcttggtttttttttggtttctgattttgccatcagatttgggataaagcgtgtatttcttgtcaagaacaaaagaaaaggaagaaaaaggcagtaaccacatctaacttgtgctgcaaaagaatcttggatatccaagaaatttcagcttttctagataatctggtggcatgattttatactgtaaatgcagcgtgcttttagatcaatagcattcctgaattctcactgtaaacatcaataacatctgaatttagtttttttccccgagtggtttggttgatttcaaaatgtttgggcacagctgatggcctgaagtactatgatcttgttgaagggaagggtccaactgctgaaaagggctcaactgtgcaggtaatttctcccacctgcacacaattccccattctttcattcctaactgaagtgaaactaatggctatattctcttctcaaggtccattttgattgcatataccgtggcatcaccgctgtgtcaagccgcgaagccaaactactggcagggaaccggagtattgcgcaggttatgaggcaaatcactcctgaagtttgaatgctagtacttttgctctaggacaataagaactaacatgtctgcatctcttcttctagtagccttatgagttcagtgtcggatcgctgcccgggaaagagcgaaagcgggaatttgtagacagtgccaatgggttatactcagcacaggcgtcaccgaaacctcctgccgcaatgtacacaataactgaagggatgaaagtggggggaaaggtatgtacaaggcaaatagccaaagggttgtactcagtggcaggctaagaatgtagcctttgtatctttactttattattgacttggtcatctgttgttctgtattctggtaatgcagaggagagtaattgtccctccagagctcggatatgggaaaaaggggatgaatgagataccggtaacatttcagaatattgaaacagtttctcatgtagtttgatttagtatttaagcacatccaggtactgaagtggtgtagtttgaatccatgcttgtttgcagcctgatgctccttttgaactcgatatagagcttttggaagttgtccctcctgcagagaaatgaccatttttgtttgcaatggatggggaactttcatgaggtattaataggaagtttcacaggttttagtgacaaacgttaatggaattataacattttgttttcttgctgattgttgaacagatatgtaaccaaatatgttcatatgatattttgccgggacatgacttgtttgcccactcacaaggagaaaatagaacaagaagcaaagtcaagtaggtaaaagacatgtactaattttgttattccttatgccgaagcaatattggatcaaaaatattctccacaatgtcgtggagcttgattgattatatggaatggtgatatgatctctctttgtgaactctgcatcctttcgctcaaaggtcctcggggccattgatatcctgaaatgagagaatacattttgtttgagatatatgtttatatttcaaataaaatagtgtttcagtggatgaatagaatgctaaaatttagctcctcatgtaagattgtattgctgtgaattatctacaaattatcctgactgataaatagttatatgtttttctatggccatcccagataaacagtcatatgtgccaaagttagatcatacgatatctgtttttaaactgcaaatttctacatcaatgatattgtgcttcttgggagaaaaagtaccttgttctcgatcactgctccatctgggatttccagtttgacaccaggttgggctgtgatggtcaccttgccctttaaaagataaagagaaaaatatgatttcattgtttaaacactgatcaatgagaagtgaagctgtactctgaattaagattgtgtaaacacagcatataaaaggttgcatacagatatgcagtatttcaaaaatacatgaaaaatagtccaaatattttctgtaagaactataactacaagaaagactataattttaagcaactttggcaaaagtaccttcaatgtgatgctagagccaaaccaaacatcaccggaaaccttcaaggtgtcaagctcaacaatgctggggattgacttgaagcgaccaaggaaacacccgacctgccattacgcgaagaaggatcagttaatttcatttgaactcatgaactaaattaaagcttttgcatgaggaaataatgttggaaggaactataccttcttgaactctggacccagttcaattgagggattcgatgggtttgttctggccgggttgcgtgtaacaaagccatcaaccaaggtatatagatcagactgcaagggtgaaacagttaagttagaatgagtgttaccctaaaaagtttactcagagtgtcatacagacctgtactagctgcaaatctgatgttgccttcactggtaggaaccgggaccttggaacattgataccaattgcgtgatcaaagaactggtacacaaaaatatgacttatcatctttgtatgttaggaaaaagaatgatgatggttatgtagtaatttgttagtaccctgattgctgcaccagctgctgtttccactttaagaactttaactccatccacttcctgaaattatatgttgcacatgtcagttgtttgtttaattcttctcaaatcattggacagtaatagtgcattgttaccttagggtttggaatgatctccatctttagtgcatcagcctcaacaaggcgcttgatagccttcaagttcacccatctaccaaaaccggcagcaacattagataacattgggacaatctcatctaaaatggaataaagactatatatgaatccacttacagattgttcgtgttgaagatcttgaatttctcgatggatttgaattcatgcacctatgtttcagaaaagtgtgaaagcaacctcagataagttctataatatatttagtctaatttgatgtcacaacttaattacattacttacatgtgcatcaggaacttgtgcaatctccaggagctggaaagcaaaaatattatcgtcaccaaaacagcagttacataatggttgaaaattatcctccaaagaaactcaagtctagcacagcaacttgtttatatgttcagtactccaagtaattaaattgcatcattgcggttggtaaaacaaggaagaaccaaagtttacctgaaccttgtcttcatatgagatcagtgtgccacctttaacatcagccagagttttcggggtaacctaaaaatggattttaaaactttactaaccaactatatgtgtagtatcttactcattcgataccacgcaatcacatacctccatgcaatattcattctgtttgtggatcaaatggttcagtatctctgttcaatagttaagtacattcccaaaaagctctcctttcttaaccagaaagtctgtaaagctaatatggtgaattaatggaataactaagaactatatatataaggatactcatgtccactatagcacccaagttatctgagtttgcaatgaacacatactcctttccctgcaaaggataaaaagggtgatattacatgcatgcatgaaaactttgtatgaaatgtgggagctgatagtattcctagatgacaatcacaaacctgtgaaagtaacaaatcaagcttgccactgttcatcagggatgggaagatatcaccatggccaggagggtacctgaaaaaatgtgtaatgcaaaggttgtaaaaaattcaaattattcgcctagttcatcttgctgatgtagcgatctatgaagaatggcttaccagccatccttgcaggtcttccccttggaaggccatggcaagaactcatcggctaccacacgaggatactggctctgcattggatcaaatttgttttggtgtcagtagcattttgtaaaacttggcgaaaacaaggaaattcagcagacatgcctgattgaaagtatggacttcaatgttcgaattggtgtatttctcaacaatctgcaggaaaagcgtgccggttagtactctgaaatttgttcagtcagaaaaggttttgtcaggtaagaagagattgccttcaaggtgtcttcatgggtgttgaatgagttcatcagaagcagtgggacattgctgccatacttcttgttgagggactgcaaaagaaagccatgtcaccgaatgccataatgcagtttgcagcaagatgaatcaacaatggatgaatcttgcgtgaagtttttaggaacccacctcgatctggatcacaatcaagtcgaggaatgtgaatccgttgcgcacttcgatgaccgatctgcgaggccatgagcaacattaattctatgttacattgacatgatgatgatgatgaacaatgtcttcctaataatgtccaaattgagaagagattgatgagaagaaaacacatactttggtccggtgcatcccatggtggtgccgaggccgccgttgagcttgagcacggcgagcttgttgagcagcttcttggtctcctccaagtcctccggcggcgccgccagggtgtcgtacggcaccaccacctcgtccgtcggcgtgtggatctttgcccattccacatgctcctcctcgccactttttttttcattaattttggatcatatcgattcagtaatcagttcatcgtcagatgcatacagttaagtagcagcttgatcagaaatggtcatccatggaggataggatgtgtttacctgaggtagcgggcgacgaggctgatgaacccggacttctcgttgtcactgcacgcatgcaatgatttgattcaaaacccaaaatcgatcagcagatcaaacttgagcgatcagatgaggaattaattcagaattaagagactaatataattacctgatctgcgagaggccggcgacggcttcacgcagcttggcgagcttctcgtccgccatttttgtgttcttgccgctgcttcacgctgatctgatgagacagatgaatcggatcggatcggagaaagctcgatcttgttggtttttataaataaacgagaggaaacgagaggagagctcgcatcgcatgaagaggaaacgaaagcaatggcggacaatgcgcgcgacgcggcgaaaacgcgggagcacccaacgtttttacactttcctcttttgtttgttaccttccatttccctcctttttttttttggacacaggtttcccgggcttttcttagagttatttatttattattactgctatttttaacgaggtatatgcttttgtggtgaagcagcacttctcttctgttcaagcatatcaacatttttcagaattttcttcatttcaaaacattgagcattcattcattcattcattcatcatctaattccaatccaatatcttacaccaattgatcagcacgtcaaaacgtattaagatttcagcatctgtacaaagaattaatattaatgtctaggagtcatccaagatgagaaccaagaccagatttttcctggaatgcgctctccctattgtgtttctaacatttcatctaccatccttaggctctcgttttcttgtaccgacatacacacaaatatggaggtaacattcagggttcttcaggttgttggcaacccaaaggaaaggtatgtccatgtcgacctcaatgccttgcacccttactagcttcactattttacccttgttggccacattcgcctcttgcgggctcgacgaagcagacgactctaacttctcacaacttcttggggtgacatcagaatcatcattaggggctgaatctggtgcctgaggagcagtttcggaatcgtcgggtatacgtgatgccttcgagctgaagaactcaggtagcaaagttttcaacgcatgttccagggtgatgtagcttctacctgcaccaaagaaatgtatcaggaaagcactgctgatactgcaccgtaaaacattctgaatcatagcaccacaatatcaagcataatggtgtaagcattattttttgggggataaccacaaccctttagtgaaaccaaatatttcatagcatctggatctctatccctacaccacacgtttcacaggaatgaggggaaatgaaatgtacaacaatagggcactactactgtctcgaaattataaaagagcgccactacttccaggttggtgaacgaaccctttgaagcatgcaaaaacggtatgcaaaccactcatgaaggacaagtaaacgcttgaccaaatttgttctactgtcatccaaaagatataaatgttaattacaatgctacataccttcctccctccgtacttcgaatggtcggttaatataggatatgctttcccaatcaccaacaggtagtgcatcttctaaatcataaaggtcttcttgaacactgcgcacatataatcgaacaggaaccctgcctaaccagagaataactgataagagccaggatggtagctgattcattgtaacatgttgaaatcacttattatgtgactacaagcacacagaaaatttaaaatgtgaaaactatgcaccaactagctactgtataaaaaacttgtgcatatggagtgtatgtgaatgctcaattaatagtaaaggtagacatattcaatgcagaaaagcatacatggtttgccagatccaggagattcaggctcatcagaaccttgttgaccctctactgaggaagttcgtactaagcaatcctcttcgaatggtccaagcttaagcctggtggagatattcatatacccatctaagttacctaatatcaaaataacacaattctggttaaatgatgaagatacagtattcagagaatgcaccacactcaaatagtaggcaatattagtcagagtgcttgatatgtactaatttacaaacaaccatttcataatgaacttattaagcatggctagtattcaagtgttctttctgaagagcacacctttcattactgattgccacaaagcaccttgatcagcctgagacatattcatcacattcttactgttgccagtgatgatgaaggcagcctgcacaagaaaaaagattactctcgtgatcacactccacttccttgctgcaggaacaaaggattgggtaatggcagatctcataaacaaacctctttcagggaattcatgtagctccactttacactatcttcgccatcacagagagttaaaatttcagaaggatatcccctaaaatgaacctacaattttatgatagaaaagcatcatacaagtcaagcaaggaaataaacaaataaataaatgggaaaatttaaacaactctagacttactgttagattccatggtctttctggatctgcacatagaaggtcgtaaagaactccaatgggtatatacctatagtgcaaaggtaaatcggggagttgggaatttgagagggtagttttgaagataatgttagagccaataaattcatattcataaatattcgacacacttcaacaatatgccactgactttgtcgatatccataatatgccgttgccttttccttaacctctacaatttaccatcgccgtctatagtctgttagtttgcattggagaaaaaacaagtgtgcccttagtgaagattggcagcactgagaccatgtcgtgcaaggtaccgagagttataataactgtttatttatgcaacatgattataaataattacgagcacatattttaagtattttaattatgagcaaatatctccaaggctacaggacaggagggggcagatctttgattgggtgccgatgactgttgaggagcggttgaggattgcactgacgacagaaccagcactccagcagggccagggccaccatgtccccttgcaagcgatggcggcgctgacgacggcggcggcaccagcaacagctctccggcaggggcgttgtgtccccttgtttgcgacggcagcgctaatgacgatggcagcaccaccagcagccctccaacagggacgccatctcccgttagatgtgacgacggctttgacgacaatggtcggaccgccgctgtggatggcggttgggccagcgctacggatggtgacgctggtgacggaggtcgtgccggcgctagggatggcggtgctggcgaggacatgtgagcggcggtaggcggagatgcggcgtggcgccgacgcgccgtggcggcactgggaagggtggcaatgcggcgttgggagatgcgatgctaggaagaaagggccctaggccatgcggattagatgattcaaaggatattttggtcattactaaaaaaattaacagtgcaaacagcgtgtagcttgacggcgatggtaaattgtagaggttaaggaaaaggcgatggcatattatggatatcgacaaagtcagtggcatattgttgaagtgtgtccaactcagtggtactgagtagattctctccataaatattggtaggagataacgtatgttaccattttaagggcagccctttgtattcaaaccaaacagtgtcaataccaggcgggagtgtgctgctaaaatgagcctttataattggtaccaacagtggaagatacccgattcttggccccaaagtctgttattgatgaaacagaactccataagtaaagccgataaggtaatgaagtatcataacataacgtaaattaattattaaaaaagatcactcacataaagggaaagatgagcaatgaacccaccttaacatatatggtgtgtacaaactcaaaagtataacttgcatttgttgcacttggtaaaaacaagggagaacaatgactatatatcatgcagcaactcttttctttacacataatatgtgaacaaaacaagcaagtcatcaattcaccaatcaagtccactgagtcaaaaaaggcaccccctaatattgtacatagacctacaaattcaggaatcctaattaaaactgcaatcaacaacctaagtgctagaacgattgtaatccaaacaggcagcctagtaatccagagaatctgagtactcgggatccaacaactcgtggcaaagatccaagatttggatgggagacctccaattgaagagcatagccacaggccgagaaggagaagacgatgatgggaaaagcatgaggctttaccaggaagggcggaggtggggggagggtggtgacgtcggcgtcgtggaggtggacctggagcggcacggcgccgccccagacccgccgcgccgcctccgccgaccacccggcctcgtcgtcgcgctgcgccgccattgccgccggaggagagatctgccgccgccgccgcctaatctttgatggtttttgcttgtcgcaggcagcaaacgactcggatttgatttccccttcttcctctcttcggcaccggtgctgtggctgcatccaccgtccgattctaccttgagattcgtgccaaatccgtgtgtagaaaatctgatttctgattgaactctgtatatatatatatatatatatatatatatatatataaagtgttgtaatttgtgtatggaaaggattacagaacacacacaagaaaaaatccatttaaagcatcagctcaatcaggattaaaacccaacaacgtttctttcatagctctaaactccaaagagaggagaggactggaaagtgtgaagcttcactctactgagcaattgcagtttcatcaacgtcaagtgtgcaagtacaaaatttcttcagtaagtatttaagtgtacttaacagttaactccaccatctcctatcttggttttccataagaagaaaagaattacaggcaacaagagtagctacctagctttttaatgctcctgttctaaatacagcatgccattcatcgtgtttgttcccacacaacatttacagtgcagttgccacaatggtccaagcttcagcatgtcatcaaccatttgcctgcttgaagtgatgcaagatccgtgcagccaagatgtcgacccaagtgtccggcacgccaggaaggcaccaatgcatgcagtcctgcccccatacagccaccgcgtccttctttccgagccagattgccggatgcgcatcggcacggaactcgctcatgtaggtcaggttgagcagctggatgtctgtgccaatcagggcctcctgaatcgccgaattcactagccttgcttctttgttcactcctccaaacctgggatcgaaccacaagtcgagctgcacaagattttgttacagccgcgtcatgattcagaactttaaaatgcatttctgaagcaaaaacagtctgaactcagagcgttacctcgtgttcttgtagaagccgatcagacacgcagctgccattgtgatcccattcacctccatagaagtgcctgggtgactgtgagcgccacagtttcagtgttttacttgggacctccctttcaatgtaagaggccatacttttgaggactactttcaatccatcgtagatgccaagtggcggctcaattggtttccctcctcggtagaaaacaaggggggtctcttttgggaatttatccaggccccacctgataagggacaagcatcaagcattataacaggaatggtgcacgcatggctcctaaccaacctaggaacaaattagaatttacaaagaattttatggagacgcacaagaattttatccaaagaaatttacaaagcaagatgcacaagcatgatctactatgcttagaattttatggagaagcacgcatccaggagatggcatccttggaggaaatttacaatataaaaccaaaagaacattttaaggctgtgcaagaaaggtatgacgagcccacctcccaagtgatgtccagaataaaaagtatgcaatgcttagagtcagagtatcataaggaactatgaacaatttccaaccctactttaagaaaaaggtagcgatgaaacttccactctactttgctagtagtaaacaagacgaatacaacagcaaagcatgcaataagaacttaatgctaaggaaacaattaactcaccaatgtccagtgttgaaaatgagcacatcatagaacctggtgacatttacccattcatcagcaggaatgtcaacatccactctgtaagttccctttattccatccttgtgaagctctttggaattctctacaggctgccaccttcgtatcattagttaccaccatgtgagctttatggttttatcatatgaagcaaagaaagcacaacctcatgcagtataaatgtcaaaatgccatagtcttaagttcaacaattgtagattttaagttcttgaaggaaacagccaaaacacaagaagaacggcatcagaaactgtcaatacatatctaccatatggttatatagttaacagcacaaagtaggataacatataacatatgtttgaacattatcagaacaaattttacacaacaaatagatcataatgcttgggtatttaaatacggtaaatcgtaatttcttcatcacattctatggatctccctgcttactcacccacagtcttatctctaaatcactattagtgcaatgtggataatctcatatttttcagtctggcctcctcacctcaaacctattaatctatgaaagaaagataaccaacgacataagtattgacagcattcagcagacaacatcagatacaatcacagtatgacagtaaccacaccactgcagagtgcagagcacagatactagccatgtcaatgataccaaaatcaagcacaggacatccaaacaaacaagatggaactgatccatattacaacaaaggaatatatgtgacatccatttttctcctgagaatacatccacttcctagttagcatagtggtgtgaaatcactgaattaccaagatcttcctgcaattgcctttttggtatggtataaaaaaaatcatctctatctcatgcatccaattcataagcatacaaagaaaacttaaatctctatagagtatagaccgcatcacattcaatggagaaaattgcatatctaccaatctaccatcacttacagtcttatctctaaaacatcagtactgatgcaatgtgggtaaatctcacctcacctagctacaattcatcccgataaacacatacaaagattgctcatatacacatcctgtagtctaatctaaagatgtaatggcagtctctaacaaacccggaaattaaagcagcacgatttcagcagatagcactcacgtgtacttggcgaggagaactgcgcggtggtacgcgacgatgacgtcatccctggggaagtagccgccgcgccacgcgccccgccgcttccacttgctcgcgccgccgtccgccgaccggagcgcgcacagcagcgccacgaccaggttctccgacagcgagtcccccacgagcccgatccgccgcccccgggccacggccaggaactccgcggcgtcgatcctcgggacggcgccgccgccgcagcgggcgggcgcccaggagagcgcggcgacgggtgggcggctgttgcgggggcagttccaggcgttgcggtggaaggggcaggaggaggtgtagagcggcggcggcaagggctcccgggtggggacccagcggccggcggtggcgtcggagggggcggcgccgcaggggagcggctgaggctgaggctgatgcggcggcggccgcgggggagggggagaggggaagaggaggaagagggtgagggtaatggggaggaggaggagtagagggaggcggcggcgcggcatttgggggagagaccctctccccggcgatcgatcgccggcggcgaggcaggagagcgagacggatactgagtgtgtttccacgcgaggccactgccctgcctgcctttagctttcagagtttttttttttttggcttttttcagattcagacttcttactgtactgtgcaaagtttagatcatggattcatggtatagatgttttcaacataagaaatttccaaaaatttgaagagaacaactcatggatctgaaaaacttgtagctctaccacatgaggacagtttcatgaatcaaaggactctgaatagagatttgttcgggtccaacaaaaagtatctcgaggtactggtacctcacggtaccaaatcattttcgatcgttggatctagctgggctggatatgcattgttagatccaacgatcggaaacgatttggtatcgtgaggtaccgatacctcgagatactttttgttggaccggagcaaatctcctctaaatatgtttgggaaaattcagacattcattcaggaattcagctactctgtacagaaactacagatacaatcacgaccatgaaccaaaaaatatgcatacccctcggtctaaaaaaaactcaattctaactacaaacttcgtagctagatttttttttggacagtgtaatagaggataacaagccaacaacaaaacaaatatattcataatgtaatgttctgttactacaggttaaaggcaattacgcagagcctaattttacagttcaatttctgtgcaatgtccatgctagtcagatgccaacagcaagatcagtttctttctttcagagctgagaatgctcaacccccatctcagacaagcgcgaaagcagcctcctctccagcttcacgccggccaactccgcctccctgatcagcctccggcacctgcccatcctcccctccgccgcgtagcctccgatcaggccgccgtacatgtcgccggtcgggacgaacccggcgtccttcatcctcgccaagtaccggacgcccctctcgtggtcgcgcaacgccacgcacagcttcaccagcacccggtacgccggcaggtcgaggaggccgccggcgtgccgctccatctcccacgccagggacagcgcctcccggtgccgcccgtcgcggcaccggctgtggatcaccgccgtgtacatcaccaccgtgggcctcccgccggtgtccctgaaccagccgaacaggctctccacggcggcgtaccgccggagcttcacgcacaccttcatcacggccgtgcagtcctgctgccgaacgtgcagctccggcctctcgccgagctcgtccagcagcgccgcggcgagcccgtagccctcaggcgtacggacggcctccagcatcagcttcacgtggacgctcgggctcagtgtcctcttgttgatcgtggcgaactcgaggagttttcgggcaaggcctactttacctgccctgatgaacccactgaccatggcttcaagaacagcacggctcgctgaagggacgcactgctctagcgcatcctccatcttcagctggtcgaagcgtgccaagacctcaattgtcgaagcgagaatccggtcgtcggggaagagtggcacgacagtctgcctctgagcccagcaaagtgtctgcaatgccctctctgggagccccatgtgcccaagctcccgaatggtcattgacaaggatcctttccggaggaaccgaacccaccgatcgagcacaatggacacgtcagactccggtggcagcgctgcaatctcccgggcaatcccaatgaggacctccgggttcttgcacacctggtcactgaatgaagagcgtgaagaaagtgcagcccttgctgccagcctgatatgctgctttggtgcaggagcattgggcagtcgtgtcttgtgaggcagtggcagcgggagaggtcgctgcctcaccgggtttggcggctttggtggcttctggcgcatcggccggtcaaagagtgccgagatggcatcaagctcatctttgctccactctacagcctcttcctcatcatcgtcctcatcctcagaagcagaagaattctcatggtatgtctgctcattgcggtccattacctccaactccatgacagaacccccattcgatggctctgtgcaagaaattcgacttgttgatgggagattgccatctctgcagagccaccaagctctggtcttcgccgaggccgtgcaaattccatacagtgcagggagcggccggttaaccagtgacatgcttcctgttttaagattaggcaaaatgttgttacttagaacaatattgattccagatagtagcatgataaagcaaaaggttgcaagtcagcatgtataataagcataaatatactactagtatgaattagaagttcataagagcctctcttatgttcccatcacagccacctgcacaaatatagaagtttgcctcaaaaactaacagacaacataaactactggatttagcacgaggggtgtttctaatatgcaaaccaacagttaggtcacaaagtagcgggaggattttgttgtccttactatttgtatttataattacaaaaaaacactaattggtaaattcccaagaacaacttccaactcaggttttcggcttaaaagtttcctgaaatcaggaattttctaaacatgtactggactttctttttgagcaatttccaaataaaatttcagtgcaaaaacaaattcagatttcagcttagcaaatcagtgattcctactcaggatcagaattgtttgacttcgaaacagagattttatactaaaaaaaattatagggctttcaaatcaagccagctttccaatgtgaaattttttacttttgccttgcaggtttcggaagctttgaaattgccatcatccccaccggattgcaaacatgtttataagagaggctctttgctttcgtttgaacagcgtgaagggaattgttcagaacgaatttgagatgactcgtttcaactgcagttgaaccccaaattccaaaatgaaacgcagagaacaaaacatgcaatcaagtttcatgaaatttcgccaaaaaatacgaatttttctatccgcacgttcccatatcaactcatgcagtgtgtaacttgacaggtcaagaattcctatgcatacaaattagaagcactttgggcattctattcgctcagcaatacgcttgagaacaaacagcacaaatgatgaattagaacagcactaatgatgggaaatacacacacaattagggaaccatggggggaattagagattgcttggcagagactggatttcacctgtgctttgtcgccagatggttctcttcccccgccccggcgaacggcgcgagcaagctcactggctggtataggttgctgacagctgcgctctccctggctggtctctactctgccacacgcagcggctgcagactccagcgcggcctttcttcgcgccgctctgagcagccgagtcgccggcgaggccgccacgcgtgtgcggcggcgccgacctgggctcctggatgagatgccgtcaaaaaatgcagaaatacagttcaaatcagggagcaaaatgcaaaaaatatccatattgggccctcgtggcaaaatgtcgtatcacggcccaaaaaatattgtcctagacttgggccatttgttcggcacacggcccacttaggcccaacaagtcaccctcgtcgtcttctccgatatttaattgtgcagctaattcagctgggagtagtagcctagtaggagtattaactgatcggcgatgacctgacgaaggctgtgtttagtttagcgcaaagtttgaattttggttgaaattggagatgatgtgactgaaaaatgaaaaattatgtgtgtatgataagttgatgtgataaaaaagactgaagtttggatccaaactttaaatctaaacacagccgaagaagaagacgacggaagctaagctagaatgtcacatcacgatgcgtgcttgctactcactgggcttgcctgccgtgcgccgccgtgtcaccagctgccgggcgatggtggaggaggagggccttggccttggaccaggacgcgaggaagcgaagcggagctcgacggcggcctctgggccggactcggcgaccaggaggaaggaagttggtgacgacgtggagtctgctcgccgctcactgcctgagtccgcctcggcgccatgctcggccgcgttgccctcagagccagctgccagccgtcgccgccttgaagcggatggagggatatgtattaggttagggtttttgttgttgttgatgtgtgtgtctatatatatatatatatatatatatatatatatatatatatatatatatatatatatatatatatatgtatatatacatatgtatatatatgtatatgtatgtatatatatatatgtatgtatgtatgtatgtagggatggcaattttacccatgtgtccggggtattcatgtggacacgtccgtccgaaaccgaaagcgcagtgggcaaaaattgggaatcaatttttaccaacgggtaacccatgcctggcccaatagttttgacacaagcaaacttcttgtcaccgacgataattactaggtcggttttttcttggacattaattaagataaggctcgcatagcccgttatcaacgtcgcaacatgtgcaatatatatactctaggtattttttttcttggaaattaattgagattaagctcacatagccagtcatcaacgtcgcgacatgtgcaatatatatactctagatattatatcattacacatatggttctaccgagcctaaccttactagaaattacgttgagtatttcggcttagtagcaatggtacattttttttatagagctcttactaaattctatatgcaggcaatactagttaatgttttcgattttgggtccaactaaaatatgatgaagataataagctcctacattttgcatttaaagacaacggttttataaatttttatcaacctatagatgaagatttagcagtaaaattattagttgccgaatatgtttttttccggcgtctatcttttcatcatacttttttttatcatttgcatttagtttatcaaagaattttgtaataagcggctataacttctattggggttgtttgacaagcggttttactgttgctgcagtcgattgctgccctgtcctggcacggcccaagatataatcctacagactggacccacttctcgccaaatcggcccacttaggcccactcatttctttcctcttcttcctcctcagtaccgacattattattgagcgtcactcgtacgctccctttgcttgtcgtccttctcgtcttcgtcttcttctccaatcgatttaattaattaattatcaagccattaactgatcgaggatgacctgacgatgaagaagaagacggaagctaattaaggctttgtttagatctaaacttcagtcttttttatcatattaaactgtcatgtacatataacttttcaatcacatcatctccaatttcaaaagtagccagccctcagcaagaaggtcacatcacgatgcatacctggtcaaagtcaaaccaaagatggataacacagtaccgctccctccatttcattttatatcggaagtcgtttgatttttttcttattaatcaagctttattaaatttgatcatgtttattgaaaaatttagcaacatctaaaatattaaattagttatattttgataatatatttgttttgtgttaaaaaatattactatattttctataaatttagtcaaacttaaataaatttggctgagagaaaagtcaaacgacttgtaatataaaatagatggaatagtaactaaaactaattaattccaaaaggttaattagcacggttaatcaccggattaatgaagaaggaagatacagaggcagtgacagttaatagcaattaatctccacttcaatgcgtatacataatgcacagacatgttgacgatttccatggttttgacctctggtataaatcctaactccttgtcgctgacgaggtaattgttcttggatattagttgataattaagattaagatcgcatagccagtcatcgacacagcatgtgcaacatctacaaaatactagtaattcagtacacacacaatcatgacaccaaaaacctaaccttacgagtattatacaattaagaactcattttctttctttaattaatcttgatcactttagctcgatcgatcccagcatcatcaatctgcatgcgtaagcagcgttgctgacgacatatataaattagcttagattagctaagttgaaacgcaaatgtacctaccagtccaccactcatccatcaggctgcacccaatgtctgaatcaaacagtactttttttttttcatttccaagttgctggttggttgattgactttgactgacacgtaagtgatcgcaatgggtttaagaaattcaagccactgatcacacggcaggacacgttttcaccacacaaattcactctctcaatctctgaattaatgagctgtataatcagatgtaacagtttttcttctaacagctggagctagtagtaattaactgctctgccgtttgtcttgagctagctggccttctcgtcagattctgattagttagttccaagtatggggtgtaaagtttcagtttgtcacatcaaatattaattatattatatagggtgtcgcataaggtgtttaggcactaaaaaaactaattacagacttcgttagtaaactgagagacaaatttattaagcctaattaatatgttattagcaaatatttactgtagcaccatattatcaaatcatggagcaattaggctcaaaagattcgtcacgcaaattagacgcaatctgtataattagttatttttagcctatatttcatactttatgcaggtgttcaaacgttcgatatgataggtgtaaaatttttgcgtgggatgtaaaagggcctaaatcgattcttgcagctaatttacaactaataaactgttacttcttgattgtttctgcaggagaaggaacaggagacacgtagctgcgcatgcagatacgacgactagttcttcttggatagtaatccaaagggggagtatgtaaaattagttttgttcctggaatcttggcgcatttcaaattgaatacagtttgaatattttaaaacacaaagtgattcggattgtgattgattccatgcgccaactgatgaacactagcagttcttaagcttgacggttttgtttaaatttgtgtacccctagccccaatagaattagacttcaagctgtattaattcaaactggaatgcgccaagatatataacatgaactctgtttggctgttgtgcttgcgctagtgtgcttttaacttttaattgtgttgatcaattgtctcaccaactatattgttgtacctttattattgcctccgttccttttcaattgatacagttgactggtatgaaatcctttaaattgtagtgttttaataaacatctttctaagtgtttgtaatttttctagaagtcaagcggtcaaaggtcatacataaatagtacttcactcatctcatatatatatatatatatacaaggcaccatcatttatttttcgatatttcataatataagacatatatgcatgtatgcaaggaagcacctaccacccatctttaattcactttttaaaaccctacattatcaaaatattttttttgtgggatacattatcaaaatatttaattccattagatgcatgcattttattcgttagtcatccaaacgaagaggtgataatagttatattttttgtctttatgtaagtgatgcatattatatttttttctaatataattattttttcttaattaataatttttttcggccggcaatgttcagccggcgctgcgaaaataatttaaaaatgggttacttcagtactcctacatgttgtccgtaggagcaggattcaagagccacgtagctgcacatgaatcataactcagatgtgcatgtgtgtgattataaatttttttaacaggagtacagctttattcctgatatg

SEQ ID NO: 68824 - DNA, 19349 bp, Oryza sativa
taatccattcaaaaagtttcagttttactgcataagaaacatctcagtaaaaggaccagttgcttctggtaataacatatcccaaatttctgtcaaattccacggttgcagtatgagcagactgtactgaactctgaagatctcaagaaatctcaaaccgatcatacgcttgattagcagaacgatatcttcttcatggacaaaaatgagtgagcagtcagaagtctttctttcagacgatagcagcctcctactgatactgttcatgcatcctgcttgtgcgtttggatctccttcctgcaatttcatcttcagtgacagagacgccacggctgcgaaggatcgatggtgacatattcttagctaaggtgatggactgatggtccattggaggaccgaaccaccagctatcaccttatctgcaatttggatctctttgtttgtaatatataccattattcatactctccttttctttgaaattctattcattacaactggcgtggtagagtcgcctgactgtatttcgtactatcaatagagacaccgtaaaagcgaaagggtatgtaatggttgcagtgaccgaaataccacgaaattctgagttcaaatctttatatgtatgtaaaaattgtcgcattataccgacagcctcatcttttagcttatgcttatgcttataagccaaaatttaaattttcaacattaaatttggagttgattttgggatttttttcaatcgtagtttatttttcagcatttgcttttagatcgttaagaacacgtatataaaaattttatttataaattatttttcgtttgcaaatataccgtttcgcttataccgtcgataagcgaaataatggagtcccgatcgagttagttgcacaagtggtttagtgtagtacttataatctgcggggaccttacatagaagttaaaacctttgcagagcaacttagcaacaagacaatcgtcatgcaatcgtgataaggttgtagattaatttccatgtttatgtatgcagtgtaaccatctggaatattttcctgcaagcatccggacaacgctgtcaaaattatctagattacccgactttctccatggacacacaaatcatgagatattgtacatgtagaaaaaaaacgaagttgaaaaatatgatgttttaagatggaagctttattaaactcaaatagttacattacggtgatacaatcatagtgaaaatactttttttagataagggtatttttactcggcctctacattcaaccggatatatgtaacatttttaaattaggaacttggccccctaaacagtccaatcttaaattcgctcttataaaaatttgaaccaaagaatttagggtgctactcatgttactgcaccattacatgccatttcgctagtgaaaatacctttggcctatgtctataactaagatgcatattaagaaaaaaaacctcaaatgcatatgttagttatctttaaaaaaaagaaatacggaaaatgttaagaaccgccaatcaatatacaagatcatagtccatgctcctaggtacaacactcgaatgttgtaactagtgagccgtccgatcctggaggagtggtctggattaattaggtgcgagttgattaattcctcgtttgatagggagagtgacaaccacatgccgtccaccactagcgagctagctctgccagtgtcacactgccagtgaagcaagttggcactgtcaccaagagagcggcattgcattgcatttgcgtgtggaaattacactaagctgatgctaatcctgcatcatgagctgctcatcaactaaatgaccctcacttttggtaattaatcccttccttcaggaaaaagttggagattcagacatcctcaaatcagaacacagtagactagccaaatttggttgcccagctcatcctgatactttgcactaacagaagggttcttgatgatcaagtacgctttgatcaggaaataattggggatggctagtgggaaatgaccaaatatctcaatcaacaaagccaatcaatctcacactgcaaaaactaaagcaagcttttctctctcccggctgggtgcgtaataacatgatccaaaaagacatcaggtagtactcttgattgcaatttgcaaactaaccacccaaaaattatattgatatggtagaaatataatagaaaaggtacttatctagtttatactatatatgcatattatgtactgagagatctgggtgtcatgtcgatctgatcatctccaattctttattaattagtcatgtataagttgttgagtcatccattactgcctttttctttttttttctttttttgataactcacagccttaaattgtttcatatacttccagttcactgtattggaacaatgtaacattatgagaattgatgggcaatcaagaaatgaacaggataaagaatcattctcgtgctttgcatagtgatagcactgtagtgtatactttctgttcgttacagttcatatggccttctctagggaggcccatctacagtgggagcccagaagcgcggtgccaagagcggggcccacgacagcaccaatgtattcacccatctaatctgcaccgtacaacttcgatcgaacgtctcacggagatcaaagcgagtcagagttttactctccgatcccccttggatccccaccgctataacgtactactccctccgtcctaaacaaacgaatctaaaatagaatataccacatcctattacagtgaatctggataaaaggtacgtctaaatttgtactactagaatatgtcacatccagtactaagttggtttttatgggatggagagagtagctccatcctataataagcgcagatgtgggttttagtgtctaactttgaccatccgtcttatttaaaatatttttatgattaatagtatttttattgttgctagaaaaaatgctcgtgcgttgcaacgggtgaatgctattttaattttattattgttatacggtttagttaagatgaaattcactttcggaattcgcttggatatttttttagaaaatcatgaactgcaattaggagtctgactttcatctcaagttagcatgcgagtttttttaaaagatatttcttatacgactccttttatatttctaaaagcaaaaaaatttaaaatccgactcaaatacagatctatattttgaaaagcgaacgaacttaaaaaccgactcaaatacggatgacataccaaaataccggcaaaaacatctttaatttttataatagtaaagattagatgataaaatataaatagtactttatgtatttatgacttaacttttaaaattttttataaatttttcaaataagacgaatggtcaaacgttaggtacggaaacttatggctgcacttataatgggacggggagtattactgtaacgaatatacgctaacacgtggatccacccgccgacggcgccactccggccaccggaaagccgtctccgcttttctctggatggcggccatgcatccgccattgacggggtgaggagctccatgaaagcaagcggtggctcaaaggttcagagttcagaatgggcaatagatgctacggcatatccttgtgctctcacagtagcttgaagtcctgcttcatagtctgtaaaaaaaaaagaaaaaatttgatccatagcacataaaaaacccggtaaaaaaaatagcacaacaaattttccacttcgactaaaagcacagggcaccaattttcttgcgattcatagcactcccgtcacatttgtcatccaaacatgtgagttgatatgaaaaaaaactcatctacccttcttccccgagctagtgctcttctccctcagcgatgttgccgcgcccgtgtcgccgatgctcggtgagctgacggagccgcgcttcccgcccgtccgctcgcgaatcatcccaacgtccgccagcgcgcgctgcaacctgcctgcataagcggcaggtcatcgtccccgtcattgtcgtccccgtcgctctcatcgtcgtcgtcgtcacgtagaagcagtggcaagccggcgcggcgctgcgccgtggcgagggagaggctgttttgcggtgccgagtatggccaccacgggccacatccatccacgtcgaagctacggccgcccacgtcatcgtcgtcaagcggccgccggcgtgggaggcttgccctcgatcagcagcgccgagtgccagacgggatccacctcatcgtcggtggcgacggcgagccacgcacccacatcattgaagagcgcacgcgcagctcgctcggcagtggcgggcgccgcgcgccactgtccatgagggagcggaagagaagacctggtgggtaacgtggggaacgaagggcaaatgtgtccgacgaaaattttgtccactccgatctaacgccgttacttcaaaatttgacggaagtgttacaaggcgaagaaaaatcggtggcctatgctatagatcgaaagcggaaactttttgtgctattttttggtaccgctttctttcctgtgctatggattgaattttctcaaaaaaaaaaaagggttgtggaagaatttccacggttttcccaggtggattattattcacccgattaagtgagacaagaatatacatagctagtcagattgatcataaatagcatcgcatatatcagaataataagtatcttgtatcgttctgtattgtttggggtttgctgaaatctgaaaaatatactacacatgttcagagttcacaacttcagactgacccatttcaatctgcgcatacagagatgatacatattcatacttgttttttctgcaaatgttgtctgcaatcggaagtgtgcatacatgtgggatgtgttctgattattgcaatcggcagcatgcatccatacggctcggtttgtaggtgaagaactgaagatacaaagatttccaagagggttcggagttttattctccgaacaccttgggtctccaattttttttatcagtaatttctcctctcagtagagtaagttcggcccgataaaattccaaatgcgtgacatgtatgtataataaaatgaaatccaaaatgcctatgtttatttcggtgaatatatttacctacctgacgattcactgacgagcatgtatgcaccgctatgaaggaggcttcaagttcagaatgaatcagatcaatagacggtacagatacatacttcagacttgctaccccatttttcactgaagtacaccacccctctctgaacttctcatgcaggagtaggaaccacacaattgatagagagattgaattagcatgcccaaggggggtctgaacccccccttccttttttaaaaaattatcttctaactgtccactacttttttttagaaaaaaaaaacgaagcccaaataaatatgcacaagatcgatgcatgtatgcatgcaacagcttccatatccatgcatactgatcgatatggcatatctccagagttcagaaattcagaccaacccattttcttacagttcaaatctgcgcctgatcaacggttcgtttttcaaactatctttttctgcattgataggcaatcgtgtaatgcagaaaaacggttgcaatcacagattacatatgatgcgtacgaacgtgttgctaaatggaactaattcaataatcatacgcttcgtaggcaacccaaaagaggggtcggagttttcttctccgaaccctcttgcatcccccaatttttcaatttgtgatcttcccactggctttttttctttcttttttgaaaggaaggtaaattaggcccgtttaaattcaggcacaaaagcagcaatatgaactagtggctcgatcaaagccggaaactttgagacacctttgtgcctaatagatattctgctgtgtcctaacacaatagcaagttgcaatgatctgcttcacactcgagaggcatggaatctccattttcctttagagcacacaaccagatatactctgcaactttaattgactttgctatgttcagtatacgatggtgtttggttggaggggctaaagtgggactaaactttagtccctctcacaaaaatataaatctctaccatagagacttatacttttgtgagagggactaaatttagtccctagttcccaaacacccctatgtacctcaagatcatgcatggatgcatgcttgctgctgactgatcgatcgattgactgcaagttccaactaaaacagtaacgtgaaattgcgtctacaccaatgtgttcatccatctaatcttgaccgtacaactttgatcggagatcaaagggggtcggagttttcttctccgaactcctatccatacacgacggtcatggatgcgtgcaggaagcttcaagtacagaatcgatcgagagatctacatgctgattaaatggaagtaatcagatatccaaaggagttcggagttttattctccaacctcctttgaatcccattattttttctttgatatcttcccactgactaatttttgttttgagagaaaactaagcctaaagtaaatttggcccggcccatctaaactggaaaaagttcacgtgcaagttcagtcttgacaacttcagaccggccaagttcaaataagcaccttaccgatggatgtttcagatgcaatgccgagaagagagggctgcaattgcaatggcaagctacatacgctcatatgtacgtgttgttaaatcctaaatgcaaccaactatatactgcgtaggcaactcaaagagggtcggagttttcttctccgaccccgcgttatcgccaatgaaaatcatctcgctgacttttattttttataaggaagctcggcctttaagtaatatttggtgagcctgaaaattaattgatacgatgatcacctaaacacaagtgcaagttgcaatgatctgcttcacactcgacaggcaaggaatccccatgtttgatcgggcaaaatagatgcagttgatgtggttcttggaagcctcctcggttcagtaactggaaagttgctgatgataaaaactaaaaagtaagacctaattatcgtcctctacactaatatatggattaggtccctatgacttttatggttatcgaagcagaagctagctactacaagattatggttgcaggcagtatttagaactacgagtaacagtaagcaggccacaggacaggagacatagtaattaaaatttacttatgtttcttcttcttcttcacagttcacatggaaatcagaaggaagtagcaaaaggaagagctgttctacactcgacagagtaacaaactaagagagcaacacaagtaacaagaggagagatttagtctcttttctggtgttctgcaaataaaactctcccctcttgctacccctaaaccccaacccaaggtagtagtaagtcaccccactaaaagtaaccggccatctcttacaaaaattggctgtctcctttgaatcaatcgaatcagatcatcatcatcatcatctacagctcgtcatgctcgtcgtcgacgccgccctcgccgtcggcgccgccacccggggcgccaccggtcctctggtagacggcggagatgatggggttgcagacggcctcgacctccttgagcttctcctcgtactcctccttctcggcggtctggttctcgtccagccactcgagggcctccttgagggcctcctccaccttctccttctcctcgctctccagcttgtccgccagcttgtccttgtcgccgacggtgttcttcatgttgtacacgtaggtctcgagctggttgcgggcgtcgatccgctccttcaccttcttgtcctcctccgcaaactcctccgcctcgcgcaccatccggtcgatctcctcctggctcaggcgccccttctcgttcgtgatcgtgatcttctccgacttgccggtgcccttgtcctcagccttcacgttcaggatgccgttggcgtccacctcgaaggtcacctcaatctggggggtgcccctgcaagtttaaccaacagatatcaggcgctggattcatttatccatttgagtaagctaacatttttttctggacatgagcaaaccttggtgctgctggaatgccagataggtcgaacttgccgagaagacggcagtccttggtcatgctgcgctcaccctcaaagacctacaccacaaggcgagattcagaggcgttaggtggtctgagctgaaattttctgaccaggatgtaatgtcaggactcaaagaagaaagtttgcttatgtctgttacctggatggagacggttgtctgctgatcctggtaggtggtgaacacctgggacttcttggtggggatgacggtgttcctggggatcaacttggtcatgactccaccgacagtctcgataccgagggtaaggggtgccacatccaggagaaggatatctgcgtaccaaaatcaaagcacgataagtatatgcaagacagatgatcgcagttgttaccaacccaaaggactatgtatgtgatcaaggtcgaacctttggtttcgtcaccgccctcgccgctgagaatgcttccctgaaccgcagcaccataggcaacagcctcatcagggttgacacccttgttgggctccttgccctcgaagtagtctctgaggagctgctgaaccttgggaatcctggtgctaccaccgacaagaacaatctcatgaatctggctcttctcaaggccagcatcgtccatagccttcttgacaggtcccatggtcttgcggaacagatcattgttcaactcctcaaatctggcacgggtcagcggctccgagaaatcggtcccgtcaaagagggactcaatctcaacacggacctggtgctggttgctgagggccctcttggcacgctcagcttccctcctcagctttccaagagcacggttgtccttgctgatgtccttgctgtacttcttcttgatcaacttgatgaagtactccatgattctctggtcaaagtcctcacctgaagagatgagacagttcagtcaaatatgaatcacagtgcactatccagataatcaagacgaccaactaactacaaaaggcatgtcattagtttaaaagcaaatgaatagtgccaatcttctaaaagacagcgtgcctttactgaaaagtctaatgagaatgtgcaggtataagataaccaatttaccatgatgtgttgcatgaaaatcattgaatcaaactacagtactctacaactgtgatgttgtacagaagcagatatttagtacctaagggcaaataaaagcagtcatacctccaagatgagtgtcaccattggtggccaacacctcaaacacaccgttgtcaatggtcaagatactgacatcgaatgtcccaccaccaaggtcaaagacaaggatgttcttctcaccacccttcttgtccaaaccgtacgcaatagcagcagcagttggctcattgatgatcctagcaacattcaggccagcaatgacaccggcatccttggttgcctgcctctgcgcgtcattgaagtacgctgaaaacatgaaagagcagaagtgagcaatggcttccacagaatcaccgcttgagttaactaagcacatgaatgtcttgtcattactaaccaggaacagtcacgacagcatcgttgatcttcttgccaaggtatgcctcagcagtctccttcatctttccaaggatcatagcactgacctcctcagggctgaagaccttgttctctccatccttgatcttgacctgaatgtagggcttaccgtccttgttcacaatcttgtaggggacaagtttcatgtccctctgaacttccttgtcttcaaacctgcaagaataattatacaggtcagatcaggcagcagtgatcaacaacaggaaataagagcgagcatagggtaaagtgccattactttcttccaatgagacgtttgacatcgaagatggtcctctctgggttcacagctgcctggttcttggcagcctcaccgatgagcctctcgctatcggtgaatgcaacccatgagggtgtgatacggttaccctggtcattggcgataatctcgacatgaccattcttgtacacaccgacacacgagtaggttgtaccaagatcaataccgatcacggtaccgagcttcttggtctcctccttcgcaacagaaaatgcaaacagggatcctgcaaacagaggagcagtggcagtatgtaagctacatgttctatcaattcaccatttatcgtgtattggcacacatatacacaggcatataattcatgtgattttaaaacagtaacatgaattatgagaccaagtaagtttctaaggtgaaaatctaggcagcccgtttcattcatgccattctagcacattttgcgcctctaaactattcagtgttgccctagaaatattttactactagcatattcagcataattgtgaaggtaaaaactctaccgctaccaatgcacaggacagatcatggcatcactgcaattaaaccagtatctaacaaacgaattccaacaaaatcactgagcactactaggataaatcataaataaaccccagatcacatatttcttggagtcgccagactcgccgccttcacctattggtggcatctaagtttaatcgcacctcaatttgtgaagtagtacaaaaaaaacaaatatcaaatatctcctaactaactaccacgatccatacgatccatcagtgtcactctaaaaccatttaccggaccatctcgttgagaaaaaaaaaaactactcccggatccgtgatccagtggaacgaacattcacagcccatcttagatcgaactccagcacaacatcaaatagacaaatctaagcgcgcgcaagcacagatccaaacgaggaacggggagatcgcacctgcgagcaggacgccgagcaggaacgcgcatccgcgaacccgatccatcgccgccaacaccaccaccaccacgcgctcgtctcctcctccacctctctctcgaagcttctcttctcttctcccttgtgcgagtttgggttgcgatccgaaaaccttcaagtgagtttgagttttatgggttcgtgggcgatttataaggggagatgacttgaacgggccgagatctagttgcgcccccgtcgcgttggccgggacgtcatgagtctgacctggaccagtccgagcacgacacgtggatgccccaaccaatcgcggtggtctctgtgctgggggagttgcggccgtccgtgggatcgatccgacggcggagatcgtcccacggcgtgaagtggtgggattggttgggtggcgtggctccccgctcgcggctggtcgggacccgtttactgggcgtggcctccccggcagctgacatgtggacctacttttttaatcggcccaattagatactcctagtttggcattagtttgaaccggtttcgtggatttgccatcacaaataaagggttgttcagattactgttaaaatcaagttagtaatattgtcaatttggtaaattaggattatgtgttgttgccaaaattttcaatgcaataatatatttgtcaattttaccgaacaatgttatgtcttaaaattgcaacaatctcaacaggcccaatgtgtaattgcatatctccatcaaaaacggttgaaacccattatacttgctattgaactgacagattagacgaataccattagaaaattggtttttattaagattagggcaaagatgcctttttgttgacgaaaaaatcgcacactgacctgggagatctgcttagctcctgtgcaggtacaaatcttgatgagatgtgggcgttccagtcaatttgatcctgcaactaacaagatatgcaaatagtagatcaaaacagccgatcggctaacaagccgatggagtagttatagctaatcgccaataatagccgatgctgataccagccgatagcgatagggtttagagcaatcggctatatgtccaatgtagattctaacactttagtaaataatgttatataggcaatcggctactgataataaaatataacaataatatagtccagtataaaccaatcggctagcattgatatgataaataagcatcgatccgaaggttaaagcatatatcggctggaggtccgatgtcatgaaatccacaagattatattaaacagtgaaacctctgttgtcatcggctaaatccaacttatatgtatatacaatcattatgagccgatgcaacgtccagataactcatcggctcaaaccccgatgaaacccttattggcagtcaaaaagcaggctagagattatggttctaaacacgacttagtagatcaaactcaactgatgcagcactaagtatgaaaagaaacataatatctagacaatcaagccgttgactaagttttcagagtggtagatgtctaagctaatctaatctagcaacacgatttagccgataccggcagaaaccctaaaacgagaagcaaccgatagagctaaattgatatgctaagactagattaacagagacatatgataaataggtaggcaaatatatcatcgaaaccagagcaatccaagaggtcgaatgtactgatgcagccttgaacgacgccgatatagatgagacaattgcttgggccgacggaacattggacttaccccttcgctggagatcgaacatcgatgcagccccgcgtcaggtgccaagtcccgccggacaataaaataaagtagaaaaggtaaaaggggtggcaatgcgacgaattgtattgatcgtgaggatagattacataggccccgggtgtacatatttatacccgtgggttgatacaagtccttgtcggacaagaaagaaactaacctaaagataaaaggaaaacataaagtccttattggacactaaacacactttcctaaagataaaaggaaactaacaaactatttctaattaatagataacttgccacgccgcatcctctttaaactcggtcacttagggataagcttcctttaatagattgatttccttaaccgaatatagcaggaatccgactattggcgacttgataactcccatcggctgattccgagatgctgcagccgataatgattctaagccgatgacgtctttgccgattaccaaatttcactgttaacacctttcccatgaaattgaaagattaacacaacttatccaaaatctagctattgacaaccttgactacacaatacaacattgatagaaggttacaaccatcttcctcctcctcctgcaggtgatgtagtatggctttgttgttgttgcctccttttttaatcctattaagcatatcactaatttattggtagtggattctaaattctcgatggatatcctcttgttgtttgcatgtcacctaaatggttacgagaaaaaaatataaaaaatcaacaagatagattaatatatgaaaaatcacttcacaaatatgtaagttaaaatttaacttctacaagttgcaacggaaaaaaaattaaattgtggctagttaatgtatattcgcagtcaaatttgtttttcgttgcaacctgtagaagttaattttgacattgcatgtttgtggagcgatttatcacatattaatcaatcttgttgattttttttaaaaaaatcataactatttaggtgacatgcaaataacgaggggatgtcccctcaagagtttaaaatagtttcccttttatcttatactaggagaaattttgaaatatcacacttataactttattactatcaaatgggtcaaattatactaaccttcgtataaaaatatgagctagaaatgtctgaaaaagttatattctggtacagatgtggtaacattttttaattggaagaaatttcacccaagaaactcattcgactgaataaattgaggttgacaatgtccatcggacagtagtacaagacgcaagtttaagcagacatgtgttgacggatacagtcccaatttgtcattacgccttcagaaaatgtgactcttcttttgaccatccaacaagatactacttccaaacaaaaacatgctcatgatagtggttgattctttttggacagagggagtagttatttttgcacaagtagggataatttaaacaaaacagttgcttcaggtacgaccttgtcaaaaagaaaaaagcacttgccatcacatcatttttgcatggattcaacaaatcttacactatggagagcagatttaaaagagagaatgtctagtggaaactgcaacctacgtggaaacatataaactacagttggatagaaaatgtacatcccatatatgtccacgtcgtccaagttaaaatattcagaaaaaacatcacctgattctgacatttagcatctcagtccccacatcaagcagtatcctgattcaaaagacatatccccaaatatgatgatgtggtagtgagggcaagggttgcggcgcgggggtggccactcatggaaaggagatggcagtggtcgctagcagcgccaccatttcacgcaagtcacagcaacacgaatcaatccccattatgctccggtgatgtcgaggcatctaccaacggggttgcctagtatttgtcgtttgctcctccaacattaggtcattatctcctcttaatccttgctatagtgaatgcatgttctttcatgggatatgcttcttgttgatttggacaccttcccaatttcaaatgagctagggtttcaatgccgccggcactcccaatttcatatgaactattgatgctgccaagacagctacaacttccatcgcatgtccttccctctatcttggaatattccctcattggtagaccagaaatttgctcccacacaaaaggtattaatggtgttcctctatattgttgatgttcgttgagtttgtgatgagctagtcttgacactcttctatgaatccatctctctcacaaacaagatgggatcagtttgtgttgatgtcttggttgctttgagccccccattttgttgtgactttcttgcttggggaaaaagcatattattttcattaagaaaacctgaaatgttttcttttcttcttttctttgctagtaaaatccaagtactttgttgggttgttatactttcctaataagtgaaattaattgcagtttattattgtttcggtgcatcaatagattccatatgtatggatgaccctctaacattcttcttggaatgggttgttagcattatatatggaaaagtaattatatatggaaaagtagggaaaaagaaggaaccattgtgttttggaaacactttgggcgttgggtaaatggtgtatatgaaaaatgtacacaacatgatgaggagagtattttgtaaaatgtatcgtggggatggcggggctgacaagtcttcatacaggctgcacattttggatccaatgatccacgatcgaatttacaattttccatgtaggttgcaatttccactaaatacatatttttcctagatcttacaggcactcttcaatctaacttctcatttatgttatagactatttttcctagatcttaccggcactcttcaatctagcttctcatttatgttatggactatttttctaccaagtacaacacacgggtagcaatgtctgggtgatttcaacaacaacattaaattcgctggtataatctacctccatgtatgcctttccttgatgctccaccaggtcacttatccgttctgcaactgatatttcacaaacaataacaacaaatcaaacaaagacgacaaaacaaggaaacaataacaacaaatcaacaaagatggcaaaacaacgaaacaataacaacaaatcaaacaaacaaagagggcaaaacaaggtatgacttactgaattttttcgtaagttgcgatgctgatcctgctaacgatagcctatatattagctttgttgctcaattcatactcaatttttttcagaacaacatcaataaatgtccttggatgggttgcaagataatcagcaattaagagttgctcacgcggtttatacagtgttttatcctataacctcataagtaatagtaggtcaccgaccccctttgttatgtctcattgtgtagtacccattaatagacccatgcacatttgaattgtctgtccacacaactaagttgtcaattcccatatcttcacatgttatgaaaccaaattcaactccataagctcatgagtatttttacatgaaatatctctaaagaacttggcaagttggaacttctcctcaaaccatatggtaatttaaattgttgttttcccaatatttcccgcttctccatcacgaaacaatgcatcaactaataatttatgaaatcctttaattccatggtcaaaactcagtctcacaattgcctaatttatgaaatcctttaattccatggtcaaaacgtagtctcacaattgctgatgttattcaagaagtgatcccactcggcacagtccacgtaatagcagagaaagacattactcaacattgtaatagctaacaataatcaagcaaaagaactcgcgcatacatatgcggtggcatgtacggtggtatgcttatcgatgagctaaagtaagaaaatgttcacgataaaattaaatacataccacctaaacctcgtgatgtagaaactgcaaccacctgaaactcatactaatttttacctatctaattccagcagtaatgtgcaagaaaatttgaaaacttattcagcatgaaggcttaacatacattggataaactaatcaatgtataaatgtcataaatgagctaaaactattgcagaaatgctgctgagataacatgaacagcctcttaaatccaatgttgagacatgttttttttcttctggttttcagttgtactcgcttttcagttggagactaattagaattttaactgatcccaaactaaactaaacatatcagttttgtcatcgtttatggcttcaccaaaataatgctattttgttctgcaatagattaacaagcaccaaggaaccagaaacacgcaatataaatgatcaaagccagagaaaaccattgaaatgcaaactagtacaaaataaaggtgcaaagtcatgtcccctatttaatatattgctatatcactacgcatagagcttatgtaatttatcccgggttgtggagatgcttggggccctcttctcaggccccctaccccctcttatataggatgagggggagggtttacaaggaaaatatctagttgattgcaactagatctccttattctatttataaaagatatgcatgatccttgggatttatatcttatcctgggaatatctcttacttaatttacaagtagcctagggctcttggcccaccctatgccacgtggcccaagggcctctccttggttacccgggtaccgtgtaccccacaaatttagaatatgatttttttttactagtgcgagaaatttcatcctgctagctattgctgcaacttattgaaatctttgtgttcttttttagtgttagaaagtatgacgtaatttgttgccttcatttgcaagaaaatcaaacaaaacaaatcaggtgcatttagatgctattgtccatttttcttaatattgtatgaaatccattgcatttgtaaaaactgaaattcgaattattgaataaccaaagattcaatttaaatacatgagtgcgttgtgattcatgatccataccttttgatgcttctagattccagttcagaaagccgagacaaggcatacttcatgaaacccaatacgcttccattcgatgtgattgtaaccctgtaactatgttagcaaactgttctattgcctaccaagtaccaactcgtatggtattgtcacaattttctttaaattcattcttttcaccctctcctggaaaccattggttatatgatgaatgatattgcatgatatattaaatgtgtctatatgatatatgtattgaattctcccgtttcctttttcatttatcttatacaaaggcataaatgtcatgcagttcccaatgtcgaggtccttgagcatgtttcatctattcttaaggattttgggttttgcctcactagagaaggcattgatgcgagaaacctgtattgctctttttttttgcaatgattctgcatttagttttcttgatcatgtattattctttctcttattcttgaagccgtccctatgactgcaattttacaaaacatctgatagagagttacatgataaaggtttgtgttacttatttctacctttactttttgttacttttgtgaagcgatttggtatgtgggcggcttttcacataaacagttcccagtggctctataagaaagtcattaagttaagagaattatatattatatatttacaatccatgtggatcaaattccaaaattatataaatggatagaagaaaaaaaggtaaattacatatatcgacaagggcattttgctagtattaaaaagaaagatgctagaagtatgctttctcattgaaaacatttatatttacgtcatcctttttcactttcttggtgcttgtgggaaagatgtttctgccatgctctgtctgatttatcatcttgatatgttagcaagaaaaaagcaagcagcaagtaattgtcaaacaacaaggcccttcggtactgctgcattcatgggcaatggatattctcgtaatccaaatcataatcttttgttggaaagagtttggaaaccaacaagtaatcatcaatcaagtaggctctttggtactgtcacaccccgaagttctcctcccaagcctaaatttaatttataaatgaccctaagaaaataccggtgcaaagcaagagtaaaccccttttaaatcaatgcaagtaataatcggaatgggaatgtggaatttttcttgagttctacatgtcgaaattcactaacagaatttttagtgaaattttcagagccctagaaataattttaaccaattaaaattgagcaagcaatattttaattccagggaaaatcctttttttcctttttctttttctttttccctccctttttcgaatgggccgctggcccattctctcctttcctccccctcctccctgctgggccggccgcaggccgaggcccaaccaggccgccccgccgccctcctctcccgaggtcgccgacaggcggggcccacctg

SEQ ID NO: 68825 - DNA, 29798 bp, Oryza sativa
  unsure (1)..(29798): unsure at all n locations
tgggccccaccattttaaaattattattttgtgcagctgacatgtggggccattctttttattatttttccggggagaaaattgccacgtaagcgctacttcaatgccacgtgggacggaggcctagtcaaacaagccacgtatgcgccacgtcagccaaaaccgccgagggaccatgtttgcccggttttcgtaagttgggggatgggtcgtacccggttttacggtcaagggacgaaaatcggactaggtgacaaattgagggacccaaagtaaacttattcctttatataaagaaatactttgaccattaatttattttatgttgtattatgtgattaccaacttagtatcacatgaaagtattttagaatataaatatgaagtataataatatgatatgcataataattatcatagatattcatagatattggtaatataattattagtaaaaaatgttgagtttgatttttttttaaaaaaaagggtgccctcttatttggtacagagggagtattaatttaacagtttgaaataagaaaaatattattactaaggtttatctcacataaactcttcttttagtttaaatcattacaacttagatcccacctatataggtaggtatatttttattagctttttctcatactcttactataatatagcgggtgcatatatttttattagccttttctcatattaatatggatttcctaggagtccttattactttggggctaatataccaagggatctcgtctcctatcggtatcagatctgatactctatatgtgtctgtcggtattcgtcatggaacaagccgatacctgttggtatcagccaccgtgtatcacgtttcatatcggagctaagagggggaagaagaagattcaaaactgttgaggacgagcaacctggaagggcttccttccttggcacttggcaacaacaatgatcggtggtggtctccatcaacaacgatggcaccggcactcccccctgtcccttgttagcaggcacgccctgctatcaccggtgaaccctacacagttagcaacgatgttagaggagaagcaactgctcaaagggaacgcggaccatacgaagcgccatgcgaacaggtgagaagcaccatgggaagtggacaacacgacgtcatatggatgatgggatcccatccaaatgatagggacgagatcatggtagttcgtatttccacattactttactcggtttttcccttaggctttgtttggtttggacgggattacagaagattggagagaattaagaccatgttcagttaatcctcgagagagattgggagttattccttctcaatccacttcaattccttccaaaccgaacaaggttttaaaggggaataataccatgttataacacatgtgaaataaattccctccaatccctcccactttaggccttgttcggttaatccctgtgagggagggattggagagaatttattccacacctattgtggtttggaattatttcccatcaatcctcttcaattctctctaaaccaaacaatgccaaggatttacccaaaataaccttattagaaagaagttagaagcagagacataatcggagatgggtctatttggtagagctccaactcctaaatttagcttcagcagttgggtctggagtggagttgtggagcttcataaacccaccttcacctctctaattcattttgtgagagagcttcacccaactccgctcctgcttaaggtggagctgaaactgtttggctgaacttcagctccagaaaagatggagctgaaactgtagctgtgccaaacaggcctgtaatccagtagcgggcgtaacgtaacccggaccgactcgactaaagcaacggcctcttcgcagtacacgtatagcgtgggccggctcgaccgcacgtccgcacccaaccgcgagctcgatcgagttcaggagcaccagaacaaccaagaaatcacattttggcccactccacccaccgctgtagtacacgagctttcgctttggcctcgccgacgaccgcacggtggtgatccacaacacaagtttcctcgccgtcgccaagcccggcgacaagtgctggacggcggtcgacctcagcgatcatctccggccgatcatgtcgttcgcgggccccttctatgccgtcaccactcaccagcgatgccatcatggtggtggaggtcagccgggagaaccagacgccgcagctggtggaggccgccgcgacctgacattgcaacacaggttcagcaggatgctcggcagcgcgcacctggtggacaacaatggcgagctgttgctagtgcaccgtaccctaagtggtgacaagaggttgtaccaggcgtaccgagtggatttggatgggaggaagatggtgcctgtccgtggtctcggtggtcgggccgtgttcatcggccatgactgctcgctgtccgtgtccccagccacattccctccatcgttggtgacgccgtctacccgggcttcggctgtggggatagaactggccgggagcacatcgaaacctatgataacctggcagatggaaccattgaacactcattctatgaaaacagcgaaaaggattgggaacaccctttgagtatcgccgattatggctgtgtttagttcacactggaagtttggttgaaattggtacgatgtaataaaaaagtgtgtgtatgaaaggtttgatgtgatggaaagttggaagtttgaaaaaaaactttagaactaaatagagcctatatatccttgtgggtgtgaaagtctggttgcaaactcagatgcaagcagcacccgtgagtcacgcgcgcgcgcgccctgaactgcctagccgcgtaccgccgctctgagtggggaaatcgtgtggattaggtaggttagggtttgggccactggaatatatacctctctgatttatgggtcaaataggccaagagaatagaaaagacattatattactggtccaaatttagtagtgtgtatataatacagggtcgggcatgagttatctatggataaaaattaaaacccagctactacccattacttcttcgggtttcggacgggcatgcccatgggcaaaaaaacagacccacacccaaacccatcgggccaggtatccacggatacccggacccgtgggtaaaattgccaaccctacccgtgacaaaattgtctttcagggtaattgcccctaaatactactgggaacacctcagcataaaatgtcacaacccacttcagtgctgttgtacaagcattccaatttctgcgtcactttctgactttctaccattgcctacatttatttagatattaatgaatctagacatatgcatgtgtttaaattcattaacatctatatgtatataggcaatgctagaaagttttacattgtaaaatacattgtgaaatggagcgggtaggaagagtattagtcgtcaggtacagtggcaaattaagcaaaaccgttgaagggaaaacgtgttcacgaaaatacagccaagatagaagtcgtcataatgaaaaaaaaaactagaaacatcttaggtttctgcgccatttccaaacaaaatatcatgtcgataactcgagaatcctgtcttattgaaaagagacaagtgagcctcaggtaggccatcttcacaccgaagataagcaagaggaaaggctagggtaaaaggaagatttgagtagttccgcggccagcaatgcggctctacaaaggaattgctcgctgttgcccacgagcaccaaaaagttttccaatgtttctctactgtaccatttgctctccctattctaacattccgcgttgcttgaaaatttcgaacatagttgaaccaatcttcgctggtgactcaacaacagtaaccccagcctctctgagagccttgattttgtcttgtgccgtacccttgccccctgacacaattgctgccataagagaagagtgaaagtagattagtacatgcaatagctgaacttgatttaaaacgacaaaagagaatgtatatcaacaaacattttttatggaaaaattgggattcatatcctgtcatacataatgttaaccatgttttaggagtaggaatcaaactttgctgaccgctaccatagtacttgatcatggtgtcatacataatgttaaccacgttataggagatggaaggcaaaggcacgatagaatccgatgcaactaaaaatctggtccaaaaccaccggtttcgaactgtataaatgtccatactggttggaagaatgaagtatgcatttctcatatattactgatcgtgaaccaataccacattcgacccagtgaatctttcatagtaaaatctgtggaattttagtatttctttacttatcagtatttgctaataatcataaaatgtagtctagcgacagtaagagtcccaggagcatttgtttcaactcaagattgtacaattgattgaatggagaaaagaatatgcataatccagaaaagcatgaatcacaaaagaaaaatcaaataaaaaaaacttattaagtgaatacctccagcatgacccatgcgacgcccaggtggagcagtgagtccagctatgaatgcaacaacaggcttttgtgttttgctctcctgaaataattgcatgtcaacttcagtaagttgatatgttattgctcatctaatattaaaacacataaaaatgtaagtttcagcaatcatgcaactggacacacacaatagtattagcaatgattgacttcatctgtcactttagtacctggacatgtacagtcctcgagtcatttcatatcataacaaaaagttgaaaactgaatttgttgcatttatcataagacagcaagaccgcttgagtttattgaaagttgaaaccgaactattgtgaataactttaatagtgacaaaggttaataggacatgtacataagaggttatccaaattactattgatagccgaaatcctgattcccaacaaacaaacctgaatgaaggctgcagcatcctcctcagcagtacctccaatttctccgatgagaacaatacctaataggcacagggaaacagttaccaatgatattcattctgtcacccacctagtagtaatgatactgcctaactccgtgactctagtaaacaattgttagaaacctcagtcccttaactaattaatatgtgggatttcaagataaagaaaattgtaaaaagcaggagctctgttttccatatacaatccattttgcttatcctgataaattcaactaagtcagagcaaacaattgtgaaaaatcactaggttggcatatacagggtaactgatggtatacaatgaaaatcaagattaagcctgtccaataaattattgtcaaatacaaaagcaagtagaatattgaacttaaaactaaacatgcagatctaactgagaggctagaggtaaagcagaacatagcaaactaaggacaatttgaattaatattgtgcaacctcagtcagccagtcacagacagggtacctttgtctgaggatcatcaacaaacttttcaaggccatcaacaaaatttgggccaatgaaagggatcaccaccaatgccaacacacgttgactgccccaagcctacggctgttgtttgaaacacctgccagtgaagaaagaaatacaccttaggcaaatgttttcacagattgttagccacactaaaattgatgtgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaatgataccagggcaatttggtccaatcaaccgagtttttgattgcttgttcagagcagccttcactttcacctgaaagttacaaagaaacatttaaatgggtcacctcattaatttcctttgacaaaaggcaagtaaaaatagaactgagataatctaaaatataggaaagagtaaagaacgaccaactatgaaacagcatgattgataacactgttttaaggaaaaacagattaccagctcaaaagattattgacaccactgcaattgaactgatcggtggtcatgctgaaactaatggcagctaaaatctcttatttatatgtgtcgtgtgtacagccacttgaataaagtgaaaataatcacgtatgttatttccaatggtctcactatttttttttctagcttctgtgtacaattatgatgaagagaaaacatttgggaatcatcatgcacggaaagaaacatcatattaatggcatgctgaaattgttgtaaattaccatgtcatgctgaggtatcccttcggtaatgcagacaacaaggtcaagttcggcctccatcgcttccattattgcagcagcagcaaatggtggtggaacatatataacagatgcattcgcctttgtctcagccttagcttctgccacagagttgaacaccggaaggcctaggtgctcggttccacctttcttaggggtaaccccacctacctgttattgtgagaagtacttcaattaaatagggtaaaaaaagtacacgacaagctaatcagtcaaattacttttgtttccataaatcaaaattgtaacactaactaaagcattgcagaaacaagtaaacaatgataattaaatagggtaaaaaaaagtacacgacaagctaatcaatcaaattacttttgtttccagaaatcaaaattgtaacacctaactgaagcattgcagaaacaagtaaacaatgataagacatgccatttctttgttgaattgcattcaaaaccaaactagtgctataccatgtaaaaataatcatattttaacaatttcagtgtcaaccttgtgagctgttagaacataatgaaattataacatacaatctgacaagcaccacactgaggttgtcagaaccctctagctggtgcgagacctttatgtaatgagatcttactacattccgtaagcacagaacactatctaatgtacatagcaaacaaaccacaagcaaaacatgccttggtgtatccatccaactctttgaagaatgataagatcttaaattcttaatacaaaagatctactttggtcggattttccaagacagcttacaaggtttcaatgtgtgcagaaagtactactcagtgtacctagcaaccaaaccacaacaagcaacacatgcttcggtgcatccatatgacatttgttcctcatgcaattttccaagagcatcttaaaatgtctcaaagcattcatgatggtatttgtttctcatgctaatatgctgttttagatcaaccagttcctagatttacaaagcatcaagaaattcataaaaacttagtttacttaaggatttttttccctcatcagtaatttgttttccatgcgtaatcactagattgcagtgaaaaacatcactagagccataaaattactagataatatgaacagagtcgtcattactgaagcaccatcaccattcagatttattgagacgtggcaacgaatcatagctttttagccatttcacataacttcgggcaaccaaccccatacggagggaatttatggtagcacatttcaactccaagataaccccagttcggtgtatggcgcaaacaccgttcttctctttccgattgtgaatccagccataaacatagcacctggctggaaaccaaaccctaaaatccgagaaaatgggggatcggcgaccacgcatctacgagatcgcacgccatcggacaccggctctccctcaaaccctaaaatcacgccgccacatggaacgaaatgcggggatcgaagaggacaaacccgagccgaccggggccgcggggatgtgggggaccgggacgtaccatggtggtgccgtactcgatggcctgctcggtgtggaaggtgccgttcttcccggtgatgccctggcagatcacgcgggtgctcttgtccacgacaccgccggcgacggcgcggccgcggccgccgccgcgaagccccgcgcgtggaggaggcgggaggccgcggatcccagcagctgggacgcgcggcgggcggaggcggccatggtgggtggctggtggtggcagcggcgggcggcggcggcggcgcgtgccccttttctcctctcgattcgatttcgtttggggtttttgggcgagtgcgctcctcctccgtttttgtttacttttctggggtctcctcgcgatccattcttgcaggggaagttgggtggtcaaactttccacctagacccttgtatttgtcgctattatcgtgatgataaaaatatagaactccaaattatgctttttctgattgttattgtatttttttttctcattggaaaataataaggaatatactccctccgtttcaaaatgtttaacatcgttgactttttagcacatgtttaaccgttcgtcttattaaaaaaatttgtgaaatatgtaaaactatatgtgtacatgaaagtatatttaacaataaatcaaatgatatgaaaaaaataaataattacttaatttttttgaataagacgaatggtcaaacatgtactaaaaaatcaacggtgttaaacattttgaaacgggggagtatatgagagacatggaagtcaattgtaaagcccatacaaggatgtttcctccctcacaaagaccaaaaagaaaaggaatcttcctctctcccttagtccctctacttcattttccttcaaatttattattcctacccagatatgagttgtcatattccaaagtctcgatataatgcctttccatcattccatggggttgtcaatgtatgacctaccaagaagtttgaggtttttcaatcttcttgtaattcgttggatcaaattacacctaacctgacatgtaattcacgatatttctttttttttccttctaatgatttggtggtaaagtcataggtatctcctagcgatgaaaataatgtggaaatttttcgaccatgccaatactatttttgtaaaaaaaattggtatcatttcttacttttttttctataaaatttagcttttcatcttcatcatattaaagttgccattacttaaattcataaatatagaaaaaattccaacgataccatttccataaaaataataaaaaataatattgtttccgaccatttccattcctacctccaggggcggatccaacatggatgttgggaggactcaacagggggcggagctaaaacgaaatgaaatgagtgccacttgcttaatttactctactttagatcgaatttaagctaatacggatgtctaagtttcatgaccagattccttggcaccccgtaatatactctgcctttgtccatggacccaagttaccctaccctactagatcaccgttgatagaaggatagaggaaggggggaagaggaggaagagaaggggggagggagtgctgaagaaggaaaaaggggatgagtcccccccccccccctcccccctaatcttatcatggatccacccctgcctacctcctcttatgaaactaagaaataagggtacggtgtcactgattgtgcaaaggttaattaggtagattgaaatgaatcaatggaaacccatgcttggcttgcctgtatgtccctaccttctcaatctgaatcaagaggataaaaaacttctgaatatcatattgaactggttgaggcctgagggagaaatcagtgcgtttgttttaacgctctcataattttgaccacgacgagacgatgaaacctaccgattaatcaaatcagtcgtgtgtaaacagcttctaactatgttttgcactaaagctgcattcgctggtctcacttctacttcttctacggttttctttaccctgtcgctgcaaactgcctctgaacactgaacccgtgcatgaatcatgatctcatcaacattactgagcctactactacggtactactctgctacataaatcacaactctgattcagtgatgaagagaacttcacttctaaaagagtatcaacttgttttttacatcggttacatcatagtacaggtacacaatcaacaaggcatgcagtgctccatccacaattacatcccaatacaccaccaccattcacagcctactccgatcccaaaaaagagaggtaagtcgcgtcgacgaacagtcttttcatcttcctccattggcagccattgctaacactccaacacctgaagaactcctcatttgggggtgaaggcctgaaattcacacacaaacatcaccaaattagtgactgaatcaatgtggtatctctgatgagatattcaggttgcaggagaggtgcgtataggaaactgaaactcttttaatcactcgggtgaacgtccactcgtttattacacgtcaactaaatggttataaaaaattttaacaagataaactaatatgcaatagtgtttatggactacggacctggaagatggtggcgtggccggggtcggcgagatgggcgaagaggttgtcgatggggccggtgccggtgtactctgcctggaaccaagctcccatgacggcgagcatggcgagccgcccgttcttgatctccttggtgcgcagctccttgatcttctccggcgagccggtgccccagccgagcgggtcaaaccacagaccaccagggtacctgaacattacgtttccaacacacgaacacgtatttcagccacttgaattacgtcttcgaacaagctcgtgacacacttccatggtgtcagtgagtcggtgtgtgttacccgacgtcggtgccggtgagcttgttgttggggaagatggggtcggtgttgacgcagccgggcttgatgatgtcagcccaccggcggccctcggcccagccgatgaggatgagctcgatgatgaagagggtggtggtgtcggtgaagtattgctgctcgccggcggtgtaccacgacggcgtgttgaggatgccgatcttggtcaggaactccgggatgaagatgcccgccgcgcccagcatcgcccaccggcagtgcaccagctccgcctgcacgttccaccgcaagctctccgggtccgatcctgcgtgtgtgcatgtacacatatgtcagtacgcatgtccagaggcggcggcggcgtcgccggcgacgagctaggaagaagatgagggctcaccgagacccagggggtcgaagccgaagtcgccggggaggctgcgccaagatcaatggcaagtatacgatgtcagtagagagcgagagtgtgtgtgaacgcgtcgagcaagagaggtaagatggatataccgacctgccgtcgagccacggcggcggggtgctgccggggaaccagattggcctgtcgggcgccgcggcgcgcacggcgaacgacgcccgcgcggacgacgactcggcctgcctcagcagcagcctgccgctcctgccggcgccgccgaggaaggaggaggccctggcggcgccggggagcgccgcgacggcggtggtggaggaggaggcggagacgagcgccattggtgcgtcgtgtcgtgtgcgcgtgtggtgatcgaggagacggcgcgtgtggtgaggggcggtttaagggatctgcacgcgcgggaagcgtagctgggatgggcggcttatccgcgaggggatagcgagcgcggccgcgtcgcgccacgcggcgccgggaatccaatcctttggctccgggtcacgctgacgtggcgggatcccaccgggctggtggggcccgataaaaatcagggcgaggcatgccattggacgacacgcgagctccacatttttggcacatgactcgctcgctcgctactcgctacgtgagtggtgagttgcagcagttgcatgtaacgcagtgtcctaaccaaagaaagttctttctatcaagatataatctattcattttatattataatatgttttgattttttaagtgaaacatcaaactttaagcaagttttaaaaaagaatacgtagcaacatttttaacactaaacaaatataatatgattatactatgagaggtccagattagttatactggatgataaaccctgagttccactcgaaactaaagttgttgttggcccaatctttcagtgagttgagataattacgatttgaaaaaaaatattgacgatctgattacaaccgtacaagacgttgcgttgcaccttagcgatcgatacacctctccgtgggttgttgatcttgccgatgcaaatcaaccttattcatgtaagcaaatcgaagaaacaagtaagaataagataaaatcaatatgatattgcaaataggaattaaatacacactataagctaaggttctaaagacaagcagacggacagtctagccgacacgcgcgctgcaagcaagtagcaatggctaaactttgatctaacaaaacccgagaaaccctgaagggtacctagctatttaaggaggtggaagaacgaccatgagggtattagggttgtgctccaccagattggggcgcaccccacatgggctccacatgggccggggtcccagacgaagttccaagcccataggcccactacaggtgacacaacacattgtttcctcaattgcggatgattggaatggaatttggcaatgaagctagatccgttggaaagaggactccgagatctttcgatcaagtactcacgggccgaaaataaagttcgtatgtatatttggcggccctttgaagttagtaatttagtaggtgaccgaatcgaattctagcacttagaggacttgatctttgtcttcttgctgatccatatgatgttagcaatgtttgtagcagtggtacccatggtcacatcactggattatgtcgaatctagtattatatattttaggaccaaggacgtatagaattacgaccttgttagaaaatggattacgcgcctatgctaggtgcgattgagaaatgaaaataagtgtatggttatgattaaatgtggtgaaagaatgaatggttaggattaaactttaccctacggtggataggaaatcttttcctaaacctatttgccaagtgagaccacacgactaatggttaacactagttcaatatataaattcttggcgggaaaaatatcatatattgtatcgtataaatgtcgctacaacacaacgacgtcatgtaattcttctaggttaagggacgtaattttaagagtaagagatactatgtaaatactctcttagataaaaaaagtatcatgacatttgagttttttatagtctttaaggtgtgactttaatcataacattctgtataggtttgtaaactctaatccttttattagttttcctttttgtgaaatacaataaagatgtattccagaggactttgttattgatgggtacatcatatatcactgaaaaaattagccgtgaatatgaacatcctgaacaagtctaagacttcaaccaaaatgggcaggttatactaccatgaacctaatcggtttaattatgctcacttcactaagtttattaggttatgaaagtaacttttcatcaaaaatctacacttaccattttttattttgaaactaagtttttttttagtatttgttgataatcaaagtcttgcaagtttttttaagaaaaaaaaatcaaacatcacgtatatttttttatcgaatagaggaacaagatcctatgagtctggtctggtttactccctccgacccgaaaaaagtaaatctaaaactatatgtgacatatcctagtacaacgaatctggacagaggtatatctaaattcgtagtactaggatatgtcacatccagtactatgttggttttttatggaacgtggagtattttaagagtcgtatgtgtctactctcggaatataatgttcctgaggacttctaaaaagctactagtattaagtatgactattacatctaacaacctatccatatttttcacaattacacatatataatttttgctccaagttccctttcagaggcactttgtcctttctggcaggatgtcttctcaactcataaatcaataaatcgatgtcagtgggacatatatatattttctagtactactgccctggttagttccaaagttttttttccaaactttcaactttccatcacatcaaacctttcatacaaacacaatttttctatcacatcgtaccaatttcaaccaaacttccaaacttcagtgtgaattaaacacaacctatattttaagttctacagatactactgttctgtccaagttcttttttaaagccactgtttttgcggttttgccatatattatatattttaagtagagactactgtttctacagagacttagtatattttaagttctacagagactactgtttttgccctttcgacaggttttgctctatgtcagttgatatactcaatattaaaagagaaattaaaatctcacccatagaaattaaaagaaatgtgaagccatatgctttgaaaagaacacctgccttgcaaacccaacgcaactgcaaaaggcgacagcatcaaaaaccgtgacagatcatcaaaagagcagaaatatgtgatgaagtacatacttgttggcatgttgcatcctcaatcaagagcacctcacaaacatcacaaactcaatttttttttcactaacgtgcactctcaacattcatcatgcatacaccaaattgaaaaggggacgtgactctcaaaaagatggaaagggagcgtgcaccaacaccatctctgaccagagagtgtcggtagaactgggcaattccctcgtgttcatacttcgtgtagtaactttgcagaggatgcattcaaagcgcgtgaactagctagactctgatgtttatctggtacatcattgagtaattacattgctgagcaaatgccataaaacaactcagataatacagcaaatggatgataccctactagttgatcaagattattcgttcaggtagatggttatccttgctctagagtttcttggcagattctgcacatctgaaactatcctccaaaaccatgtttttgcattaggtgcattattatactgagatgtgctgattctactagggaactctgatgcatgcatgtactcacttgattagaaaggtttgttcttcttggagccatgcttggccttgaccatctggttcagtgccttcacgcaacggcgaatcactcccatcgacttcttccccccgtctgggcgctttatcaccatggccaacgtcgcgccaccagcagccggaggcacgggaagtttatgatcagcaataatggctttctccccatttccgagcttgctggtggctttggcttctccgacgatgaggagctgcttctcttgaatcagatcctgaagggagaaccggggcacgtcgtcggcgaacggcggcgtgatcggcttcttcacagttttgcgttgctcctgggccttctgcttcgtgtcttggcattgctgctgtgcctcgagtgacttgtgctcttcattgtgatacttctctgatgtcttctcttcttcgcattgttcagctgtcttctgctccccatcttggtattgccctgtagtgttgtcttcatcttcgtattgatttggcgccttctcctcatcttgacattgctgcaatgtcttctgatcctcatcaagatattgctttggtgttttctcctcttcgtcttgatcctggaacagtttctcctgctcttcatctagataatgatgaagtttcttctccggttcttcatccagatgatcctgaagtttcttctcctgctcttcatctagataatgatgaagtttcttctccggttcttcatccaaatgatcctgaagtttcttctcatgctcttcatctagataatggtgaagtttctcctcctgctcatcacggtgttgattcagtgtctcctgtgcatcaacttcgcattgcagtggtgcctgtagaatcctcaactcctgatcttcatatggacatggtggctgcagctctgtatcctggcactggaacaatgtcttcagcttggcatcttgacgtagctgctgcacaaggggctgcacctgttgatcttgataacaagtgatgagacttgttgatcttcgtgtccgcctcgacatgccaagatcgaagcggcgagatttgttcacatcacactcggtggccattgtcagtggtatgaggagaaagatcaccaaaggagcaacttgcttcttctcaggggtggagttgttataggttgcctgatgtgattagtagatgcatagttcgtactgagaataggtgagctggtaaaatgtccatttcagaggtaatgtctggtttggtcatttggaagatcagtgcctgtcctagtaccctttaacccctacatgaagtgaaattaaagttagtatcagcagacaaagtgatcaatattctgccacaagcccacaaccatctagaatatttgttctgcaataagattttaatacatcaaaatttattttgcaagatgacaatatatattaatcacgcggcataacgaattgtaggaagtagggacaaagttctgaaataaagaaatttctgtgcattttaagctattcccaactacctaagagctgagaaccagcaatatttggtttcaagcaaaagatttgactgacacgtcttcacatactttgactgcaatgttaatctaaagctttattttgaatatatcactgacacctcagataagaggtaatgcccacttgcccaggtccaataaatagcatttcagaaacttactcgtaggttggacgaactgattctaaacaaataccttgataagtacaataccattgaagccaattctgccacctaaaagctaacaacataataattgtctaatataaaatgcacaggtacatcttatgtcacagtcaacctaaacaaagtattgatcttttcccaacattgtacatctcagggtacaccaaatatattcatttacggagttagtgatcttgcttagctgcagatggaactccctatcttgcaaacctcatcgtccactccgcagctatttcatcatgcttagttctatcagtcaagtataaatgtccaatgctcggcacaagtgggcagtctgcacggaaaaaacaatcataatatgaagttatcaagatgaaatgaagcaaaaattatgtgtatattacatagtttaaacaggactgcatgttttatcatggaagatagtgcagaaacagaacaattgtgatcatactgtaacttggaacttacatggatctgggtttgttatgatggctttaatggcaagtagcacctttgaaatagttaaagcaggactccatccttcccttaaaatgtccatactcaagttaccagtggagtcaacattgcagtgataaatccttgtcttgaaagttacctagcacagtgacagaacagttataacttgtaaccacgaattgaggtcccctaataccgaaatatcggataaaattacagcagtggatctcaattgtttcatacttctatataaacattgaaattgctgttccttcaatattgaaattttagcatgttcaactggaagagtgtattaccttccatattattaattactgaaacatcaaatcaagccacaattgccagcccatgtgtatttcctctgtattatgagtgtgctatccactctacaaaaacttgagaaattcacttactattgccaaattatatggagtgtagcattagcagaattaatatgattgccatgttggactgtattgatgtttgcatggttccatgtgctggttaaggtaaaaggtagaccactgcagggctgtgtgttaggtcaaatcagtcctagcattgccctaggcttccagcactgctatctagagaatgggggagaattccagatgctccatcaaatactgaagagcagaaatggaggttggttgttcggatccttcatatcctacctcccatcaaggaattataagttgatggtaatagctgggcaaagacagtaacagtcttactgtcttagcaaccaacaaaccatgaagcaggtgatcatgtagggctgtgtaggctacagccagcaggtgtatactgattagtcaatgtcaacactaaatggaccaaaaatctgcatttagaaggctcatttttttaccagactactatgcaaatagtatattgacataggatgaaggtgatgcccaagcacattaggcttccaatggacaaaacctttctctgtaaaattttaacacagcactatcaaccaaaacaggggatgtctaggaaaacaacattttagaaactctgcgcagttattttcttgaacactaagcataaaacagacttcagataagttttcttcataaataatcaagatcatattgaaaagaggtaaatggtgcttaccttaaaaagaacgcaggtcgctttaattaataacaaaataaactagctttaacataatctcttttgttatctatgcccttctaatcatcacactgtttgctgagttagcccttgaacagaagcattccttgtccccaaaaagattcatgagatattccattttaggatgaatcttaatccttgcagacaactcgacacattttcaaaccccttccaggctaaaatgcatagatcatacacttattttgaagaaactaaaagaagtccggtgaaggtagacttttgaaacaaaataccctatgcatttactaaacataccaatgttcatcacttttgtaataccctgttcacatagtgaagtagaactagctatacaacaatattatcccaaccaattatccatcctatttgaatttctattccacttcttcaagattttagacatgcgcatgtctcttaaaaacatttctttggatgcaagcatttcccatgttaccttaaccacacttccacgcggtaaatcaatagtcgtctatcaatagttactgaagggaatgccatatttattctagatatttgttccaataacagcgatatgatcactcatgaatcacagcattaggtagaatgcacacagacaaggagagaaaatgtcaagttacaacttaagcttctatatgatctcgtagaaagccagacacctcataaccaacagcccatttaagcaaacagaaaaaaaaaaaagaagctaattcttagttcttaccatgggaggtttaaacggatagtcaattgggaatacaatatcgaggaaaaatatccctccttcatacggagatcctacaagatgagcactgcattagatcagcaaagtgaaggtggtcataagactagttcactctacactccacaccctaattccaaacttgaaaaaaaaaaaaccgcgatttcaactagtgaaattcgcagagccgcagtaaaattcgcacgagctttatcggctgctgctagcaggggggagtaagcggagagggggaagggcgatgataccctgaggtccgatgatggtggagagccagtggtagaggttgtcgcccttagggccggcggagcagtcggaggcgttgaggtccatcagctccttctgaatccgcttccccgacgacgacaccgacgtgccgccgctggagccccaggggcgcacgccgctccatcttccacccccacctccgccgccggagccccctcctcctcctcctcagcccccgatggtgccggcgccggcgccggcggggaaaggggagcgagaggtcgggaaggaggaggaagacgacgacatggcctcgacggctggcttacgacttggccttgggggtgagggggagcggcgccgccggcggtggtggggggatggagagcgacgccggagtggggggagagcggcggagaggggaaaggttagagggagtgacgggacgatgaggggaggtgcgaatttatttatttatttttcataattgttgtgatgttcagtgtaaaatactactccctccatttcacaacataagtcattctagcatttctcatattcatattgatgtctgtttcacaatataagtcattctagcatttctcacattcacattgtgaaacggaggtgaaacggaggaagtaattgcatttcaatataaattactctatccatcttaaaaaccaaactagaggagaatttgcaacatatgttcagaaattttatgtggagttaaatcgccacctacagtggtttttttagacgggagtacaaaatatgaaaactaaaatttgagagaaactgatttgagacgtgcttttattctgcgtgacagcctgatagctccacatatactcttataaatccatttttgctgttccagtattgccagtaataatgggccaaaagcgaccaagtactcaaattttaaactgaccacacataaatccaaccctgaaaaaccataaataaatttcggtgccatgtaactgtaacatatggactgctttagaacgtagaaatttttatgtaggacttaattcttcattgtacaaaccaggccagacatttttgcatctgctgcatgagaccaaaaaaaaaacttaacaaacatgtagtactcaacaagagtataaatttagaagaaaaaaaatattagtgagtctgagagaaaaacactgttactcaacaagagtgacagtttcagtactgaagcgatatgcagggagcacaaaacactttttgagtcatacaaacatttcagaaaagaaggtttcacaattcaatactcccagcctggcattcaaaattgatgtatttgactcctttctctaggtcaacgaattttgagaaacacatgccatctaacctcaatacatctaagacaaatatggcctcctacactcctactgacaagatccacaataaatttcgggcatctcatccaaaacgcatcatttttttacagggttttacatgaacaccatgatagacagcaatgtaattaggtgagtcaaccagcacgagtgaatttgtgtagcaaaattgtctgggcttacgggcccagacgccgcaccaccgttgctgccattggagccagtgctgcaagaagaaccaacactgcatcaggacgtagagccaaaaaaaaaatgtagaaccgttagcacaaaaatatcgagaaaggactcaccttcctgcaaaaatgcatgaaccatggcctgcatattttgatccagggaaattgtattaggctcatcaaacagggaaaataagtaatcacccggtccaatctaacagtaaatattcttgatctctttgaacacactaaaaaaacttcaggatgccttctataagaaaatgcatgaaacttcaggatgtgatcatgcatttaactagtggtaaacacattttatattagcatgatcagatatctaaagtctaaggtttcttcaaattttctcgcttaccattcctatgtaatcagaggtccatgtcagacatacacaaactcaaacatgttcaattataaccttgtttgcagctccaaggtgtttactggcgttcaatggcatctaagtcatattaagaataggcaaacaaagtcccaatgaatgagccaatcagttcttttgcatgcacttgttacatttagtttcgcttggatcagaacagtttgtaatagctgccatgctgcataccaggaacaggaagacaccgtagaaatcatgtagtcatgtggatactattatagcatgcgacaggataagcccctataagtttcacagatcttaagcaagtttccatgtaaccagtaaaatattgggctggttaactaataatctaaccaacatgatctaaactgctatggtggctggtggctattagtttggtgaaaacatgcatctagttgttttaatatataaacttagtttttttttcctgcagtactaggagcaaatgaagattactaaaatgttcagaaagtaaatgtccttttagtgctgactgctgctaaccatgcttccagaaaactaaaccaggtaattaccaattgtgcaaaagtgttagtacctaataattgcagggaaattggtagtcaaagagaaagaaaccggcttacttggatcagtagatgtcaccattgccgtgctattgaagttgcatgttccgccacttgctcgtgtcctatggtaataatcattgaaagcataagaagcaacagcgacaatgtcatctgatttatagcatggttgcccaggttgaattgcactgcagtttgcagagccagggccacaggcccaatccaagctttgcttcaatgcgctatgaggagcactagaatttgctacacagaatgtccctcgcaaaactggtgaatctgtattagttgtggccatgtcttcaaatgtaaggctgtacacagtagttgcattggggaacatgatgccccaatttttctctgagacaggtccagcccgaagatcctcattgaacaactcaaatatgaatgtgcttacttgattgtttggctggccaggagtaccagaattatttaatacatggcgtatgaggtttgtattgtaggccaaagcattatccacattagcagccttctcattttgcccaccatgcgatggccacccagaagctgtgaccataacagggatcccagtgaaattcattgcttgcattgagttgtatgtagcatcaaccatagcatcaaacatattggtatagaacaaatttgtgttgggatctgaaatttggctatcagggttgagtgatcgaaacagcgcatattctaaggggaatacgccttgccctttgacatagtcataataaggttgggcgttcagcatgaagggagatgctgtgttgttcagaaattgaagatactgaagcattattgagctccatgtcgaattgaatgtagcagtagatggaggaaatggcttagagatcatgtctgttgaatgaggacttgaaattttcacctgggtattgagatttgcagccaaaagcgctgactgtaggaattgcaatgcaggtacaagaacaagagctgcatttggttctgtagtaagaacctcattccctacagcaatatgcgttatgttagtcgctggaatgtatgcagcaacattcttgttaatccaatcagcagctgtagaacgagattgccccactcgaagtagctgatcatttggaaccccaaccaccacttctattccagtatttgcaagggcagatagcatctgatggtctgaatcaagcagacgaacatgttgaatcttcttttctttcaggatagacactgtgtctgatgctgatggtgggttcgaaatatcagtgccaacattgataccaacaaatgctcctgtggaagtgaataaaattgttccatgaatatatatatggcaacagtcataaagcaaccattttgcagttcaaagcagtaatttgtttggtgtactagcttaactcttcgcatgtattcgagaaaactatctctcgcacaacttggcaaatcaaagcgcaaattgaataaatacaataaagcatcaaccctaattgaaagcaccgtgttacaataaagccatattcatagaagttaagttacaaatgtgctgttacctgaaacattgaaaaccatgagcattaacagaatcaccacgccttttaggctcgctggccacatatttcggtgctctagcatctgatttcttattatccaatgacacttttctcactttctcagaagcacttaaccgaagctgaaatatcaacattgaagaaattattcccttcaaacaatatagcacaaacttcacttaacttctatctttaggaggtaataaatttgagctgagaaaactttaatgatgagaaatacaattccccgcaaaaaaaatgatgagaaataaagaatgcatccacatttgtagaatacagccaaatatgatattaaagcatcgacctttctggttcttcccaaatcatcatcacaaaataacagtttgggacataaatgcagttcaaaagtattcagatactactagttcaaagagcttgccgaatactctgcaaatctgcaaacatccaagaaacaggaaccaggcgctcatccaagaaccaagcaattcagggaatctgagagaaatctatcagataacccgaggtggcggagagctgtctgaagaaatgcctgggaggtgaacggccgaacgggtaagaagaatgaagaggaattcaagcaagaaaacccaaaggggctacgcatgaaagcacatcaacacaaagatgaacaagcaaatcaagcagttacctctcaaaacatcaggacaaatccccaatactaacgctgcctaatcatgaggaaatcagaagaactccgttccccgacagttaaaacttcactgaatataaagcaatgagaaacgtgaaacaggaggacaagagcatggtgatgggctttgtttctgagtgaaacgtgaaattaaaatttgttttggagtcataaacaagcaagctttgaagaacactcccatcacccctcacggttaaaattccattcctttccaagaaacctcggttggtgaaaggtcacgagcacaaaagatcacaagcctccagaaacaaagcaacaaacgggaacatcgcaatcgtatcaacagtacatgaaagaaaaatgaaacaaaccaacaagagaagagaagaaaataattaagccacctgatcttgtccccggagaagagacctttcttccacttccacttcccctttccagatacacacagccaagaacgaagcacgaacttcagattggaggctggaccgctggctggagccagcaccggactactactactggaagcagtgagaaatgggaagccctcttctctctcacacacacacagagaatccgaggaggtagagtagtgtgtgtgtcagtctctcggttcttggtttggattctttcctgcttctgtttcttggaggattaaaacctctccaaggagaggtgattagtagtattgatcaaagtgcataggagacgggattaaaaagaaagaaaagatgaggggattgaccgagagctcagctcagtctcagctcagctgcgcgtgtcacagatccaattaagtttcttgggagacagacatggaggattaaagaaaagaggtgggaaaggtggaggaggaataaaaggttgagcttttctaggctcggagttgggggcgggttggcgaactgatcagcgtggtgtgggatgggatgactggcgaatgtgctggactggagcgtgcacggcgtgtgtgtgtgctgtgctgtgcagcgtgcagttccagaggagcagagaaggccagcgtagcgtactagcgtttctgtgggcacaagcacaatcggtggccatctcttggacgttcggctcataaatccagcgtattctcgagttcattttccggcgcattaagggtgtgtttggtgcaagtcacagtttgccacgcctaaggttaagtaaatttgatagttgtttagttatagttatagttgtggtaatatttttctccaacaaattcggtctcacatgtcaatggctcaaaaaatgtggtaagattcccttagacttagtaagttgtggctaacaatttgatcacctcatcttaggcaaggtgtggcaacttttattggtaagtaatggtaaagtgtggccatgaattaacttccttcaaaaacgattttggtggtgtttagttttcttcaaatttccaaatatttctgcatatcaaatgtttggacacatgcatagagcaataaatgtggacgaaaaaaacaattgcacaatttgcatataaattgcgagacgaatctttagagcctaattacgccatgatttgacaatattgtgctacaggaaacatttgctaatgacggattaattacgcttaataaattcatctccagtttacatgcggaatctgtaatttatgttgttattagtctatatttaatacttcaaatgtgcgtccgttggaggaggaactaaacacgacatttacagtaaatttggtgtggcattccataggagcttcagggattcattgaaattcaggattgaaaaagaaacgagaaacgagaaaaatgcaagtgcaaataaagtattgtaaaatatagaaaaatgctaaaatggttgtttgattaggccatggaaaagaatgcaagaatcaaataagagtatttaaaaatatagaaaaaaccaaaataatcatttgattaggtcaaagaaaaacgtaaaaattgaataagatggataaaaggaaaattttaaatatattgaagcttttgctaacttttttctaaatctttcttgtctcaaatatctttatataattgttttagggttaaatttcttgtgtttttatacaaatcaagaaaggcccgactcttcatccgctcaaaaagcgaaagcatctgaaacaaggtagcctcgagagagaaaaaaaaagggccagaaatccagataaaaggagaagaaagaattcctcacctctagcacggtgctccgatgagccatgctctcttaccacttatactactatttttgtcacataatattgtaatctttgttcatatttattatatgatgtgatgggttttattttatcttaagttataatattttagaatgaataaagtatattgttacgctatgttataggattcacacgatcacatcgctacatcagttaataaatataaacatcattaggaatgtaatattctcctttacttggcacttccccagcactgaggccactgctaatagtagtaactgaaaaccgattcgttgatgaacagtagtgttaaactggctagatctttccgaacttttgtcgccggccagtaatgcatgtggaggataggtacacaaaaccacccaaatgcaaaattccatcagtgatgcaacacatgggctttgtgagttgtaacaattgtttatgcgtatatttactactggtttgaagttgcttttgaacgattgagctatgaccgataaaccttaaaaaaatagcgaaataataataaaaataattatgagcaaaaaaattatactcgtgtcgttagctaaaaggcaatactaaaaatagaatactataaaaacaaaaatgaactctaatattaaatctcaaaatttaaatttcgggcatgcctaacgagctaaccaaaaacaattcaagtgcaaatcatcaggcctctaaaacacgagaatttattacagaaatttggttcgacctcaaatctaattatggaaatttctcattcaaaactggcccgtaaatttgtattccactgttcccaggagaagaaaaatgagaaatactgtagtctctagctcgagccactcacggcaagtcttttaaaagtacgcttctgtatatgtgaattcaaacatttctgcccatgttttgctttttgcgctcccacttttaagctgagaaaagcaccggctggacagcaaggcacgcagaacaaaaggtctttagccgtaccaatcgcatggaactataccgttgtaacgcagctttgtgatactactcttcagatgggtcatttttcatgctaaaaatttctcagtttgcatcccctttttcaatcatgaggagttaaaattttgagaaacaactacccgtttttcagaatatggaaaagctgaattttccggtttctaacttctaggttaattttttgattctatactatagctgcgttcggtagcggtacatcgagagaaaatttttctcattctccacgcccatgcttttcgaattcgaactaaaagacatgtttttgaaaaaaaaatatattggaaagttgctttaaaaatcatatcatattaatctatttttaaaatttaaaatagttaatactcatttaattatacactaatagctcacttcgttttgtgtatcttctcaatgtaatctttttctctcttctcaaggacaaccaagacggtttaggggagttgaagcttatgggaaaagctgtgactagtagtttacatgccaaggatgagagatttttcttttacgggaaaacaacaacggattcaggcatgtaaaccaactcatagttccatactctgaatagtaatgacgatgagtggtgagtctgtcacaataaaaatggtaaaaatacctcaccaacaactttctactttttgtgagaaataaaaaggatagtacgggataaaaaggcatacatgtcagtaataaatacgtacagtaattaaaagattatggaaatgatgataataacaacttaatgatttttttaattaaaatcctgatacaacgcactgtctagtctgaggaaaaattatgttcatgcgaacctgaaatttgtaaacccacatggtgccattgcacgtttgcacggctgggtcggtgaccctattcgactctcaaagatcgtcacggaacaggagtcaagggtgctattaagccccgatctctggcccttgtcgcactcgagaaaaaccaaccctaaaagttgactgtcctgtgctgtcggtagtggagatctgagtaagaggaggattacattagtgcaaacagtacttgctccattattttgtcacagtaggaagaatcacaatttcagttcccaatttcttttctgaaaaaaaaatactgtcactgctctgcttccaagactgctgcgttgactcagcggccgtttcaggttataaaacgttttgattttggtcaaagttaagctattttaaatttaactaaatttatagacaaatataataatatttataataccaaaaaagttttattaaatcaataattaaatacgtttttataataaatttgtcatgggctgaaaatgttttttttatttttctataaatttagttaaatttaaagtagcttgactttcattaaagtcaaaacgacttatcacctgaaaagggagatagtaccattttgcattgcacactttgggattcgacgtagacagggcgcgtttcgtggcagtgatcaatgcggttgttttctcgtcgctttttcgtgttcagatctaccggacgcccggcaacggagacatggcaacgttagttgcggtgagtgggcgaacgacaatagcagcggcggccggtgatggtgacggcgccggccgccggggaacaggggcgcggtgaagacggcgggaacctacgtgcacctcccgcaggccgcagcgctgtctgtgtgcctgcctaggcaggtggcaccgtgccacggcgaggtcggtgtcgctgaattgaaatcgtctccccgcggcgccatcatggcacgcgcgcgcgtgcccgggaccgaacacgaacacgaagcgacaacgccgcgtcgtgcgcggcccggcgttcggtcggtcgggtggcgtcgtcctcccgtcggcaacggcaaggcccagagcgcgtgttgtgctccaacgcactgaggcctccgtgccattctgtggcctgcttggtgacgtatgtgggccttttttattcggaattactaaagctccgtcgacagaaaattctacctcaaatcttgtaaattttggacttcacgattcgtgctcttcttctccaactccggcgaccaactcttcttctctggcgccgacgaacccaaactccggtagagggccgacgaattagggtccgggggtgggggtggggtggggggg

SEQ ID NO: 68826 - DNA, 3376 bp, Oryza sativa
aggtcgtcgaccgcgtgaaggaagcgctcgtcttcgtcgtcgtcgagttccgaggccgagccgcagcaacagcgccgcctctccatcgagctcagcatgccggagatgagaaaggagggaggggatgaggatggaaacggagacagcgtgagagaggagacggaaaaaggggcgagagtggcatgattctcattttagaaatttctagtggcatgtagccgatatgaagaatagtagtggcatttttttaatttcacaaagttgcagtggcatagatccaattaaccaaggaaaaagaccctgggaaaaattcccccgaggggattttttgggtgacatgccctaccccctccgagaaaattgacattgtgccatcgtcaaaagtgggtttcgcccaaatgccacttcacagaatggattcgataaaatgccactatcaacacacggctacacgctaaaatgctatgttggaccaaattaccctccactcctcttcttcctccttccaacaccatcggctccacccgtaccgtccgcacaccactaccgcctcaatggccgccgtcttcttcatcctcctcctccttctccccttgctcccgtccaccaccctcgccgttgttggaaatttggtcataattcggcatattttaatccaaaataacaagataataatcatgatatttacaataggatttgatccagtgatagtggtgaatgtaatcaacatgagcatgcttaacgttgaataagcatcaacaattacataatgacacaatgttgacattgcgatgaacattaacagtaaaacttctaattgaaataatgtaataaggttataccccaagaatggtcctccgctggagtttgaggcagtattgcctcagttggtgttgatgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttcttcttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacagccgtcttcccctacttcctcgcctgcggcgccgcctccaacgtctccttcccaggcgactccccagcgcgcaccttcgtcctggacgctcccttgctctcatctaccggccatgtcccggacacggtgttcttcccgaacaacctggtggagccacatcgggaacccgtcgaggcgacgtgctgggcctccttggcgcgcaccccgtggttaccctggtgacgctgcaccgtacctggactttctgcagccggtattcccgacgacgaggtcgcggacggcagcgctgaggcggttgttcgaggggcccgcgaggcttgactcggctggcgtggcgcagcagtcggtgtgctacgacggcgagtcggtgacaagcagtggctctcgccgacggccacattgcatattcgttctgttctaggctagctagtatcgatctgttttagtgtgtatcgaactatcgattataaacgaatcgagtgtgtcctgcttgtgctagctagtatctaccgtgcttgtgttcccgtaaaggctgcaccaatcgacaatggtgggtggaggttgaatcggcggctcgagcgtggtggctgcatctcaaagctgccacggtgtcggccgagcttgaggaccgcgcgagcggcgactggcggccgagcttggggactgcacgagtggcgaaagcgacggccgtgcttagaggctgcgacggcaatggctgtgctcggggaaggcacatcctcacgtgggtgggcgtacggtgaggagcaaccggagttggaagagaagatggcgatgagagaagccaaggttaatttggtcctagaaagtattttggcgtgtaaacatgtgttgatagtggcattttatcgaatccattgtgcggaatggcatttaggcgaaacccacttttgacgatagcacaatgtcaattttcacaccccctccattcccttggagggaatcccaggctcccagccgaggaaagcctcccctgtgtccatttggaaaaccgatttaccccctgaactatcgcggtcgaccgatttactcccctaaactcgaaaaccaaacattcgacaccccaaactcttaaaacccaacaaattaccaccctaacacagatcgaagcggttttctgcctacgtggaacacacgtgacgatacagttagcaaaaacaaataaagaaactagtggggctcacttgtcagcatttttttcctctcctcctttgcctctctctcggtgagcagaggagagaacacgcggctgcggcgagccaaggacgcgctctgcctccgcctccaccgccgaccgcccgaactcgccgcctccatcgccggtcgcccgagcttgctctgcgttcgccggcggacgtggttggacggccacgatgccgacgaccaggacgacggaccgttcgccgcctccaccacgccaacgagagaagcagagaagggaagggaaaaaatgcagagctcgagcgtgcggccgtccatcctcgccgacccttccgtctgccccatgcgccgccgcagcaacctcatccatggcggcggcggcaagaagtgcggcggcgagcggcggtgcgcatggcgatgctgcttggctcggctcggttagctcgctcggtgtatatgcatggacacaggttgtacagatgtgtgctgcttgccggtgtgacggggtagttttacagaagcagcagcgaatttgggaacactaggagcagcagaagaatcaggtgacatcttgagcggcaggcgcgacggccggggaggggaaatcgatggc

SEQ ID NO: 68827 - DNA, 3969 bp, Oryza sativa
tcctcctcctgatccatcccgatcccgtgcctaccgccacagccgccattcaacgaccggccgccgccaccatcaccgcctcgtgggcctcgtgggcggtgggcgacagccggtgggggagcccgcgcgccgctgctccgctaccgcatgcacgccacccctcccccgccacctgccccgcaactcctccacccatcatcgtcgcgtcgccagtcgctgccgtcaccgctgctgcgcagcccgtcgccggccgccaacgccctcctcctctcccccctcgcactgccgcaaagaagggagagagagagagatagatgaggaagggagaaaagtgggaggaggttgatgacgtgggtcatgctgacatgtgggcccacgtggggtcccacgctgactcagccaccacgtaggacaaagccggggtcaaaaccaccgaaggatctaaagtgaacggtttttgtaaatggcgggatgtcctatatctggttttgcggttgggggacgattctgtaactcgatgacaagttgagggaccttcggtgtactttttccgacataatatatatagctaaaataagtctattttacgtccctactctttggaccgtgccatataatacatctatttatctaacgatcagaaaattgactgaaacgaaataaatttagtgccatatctgatcacgaaacgatcacaaataacaacaaagacacaactcaaaagatcggacacgtattcgtatgattaaaagccattttattatattattgtgtcattaaagcagacctgctattgaacatgataaaacatttatccttcctgatctagctcagttaagagtaaagtagggcctcaaatcattgctttggtcagtgatttgaggcccttggaactaaagtgtcgcatgactaaagcacccaatacatcatttcgctgttgagcttgtacatctcagacctgtgcttcagcatgcggagccctccaccattggcaccaccagcatcgtcgtcatcatcgcagcgctccacctcgacggcggttaacacggcgaacagctcctcgccgtcacggtgatcctcatcggtatggaagaacctggcgatgcagaacttgccgtgtccaaggttcacgaggtatgagctttcaagattgagggcgtcgggcggtgtgaactccagaggaaggcggtgaagcaccggcagcttcgagccgccatcgaggtccagagcggagaggacaaagttcctgctcatgtctctattgctgcgtgagaagccaaaccaaaggccgtgctcatggcaatactcggcgagaccggtaaatggcaacgtccagccggtggccactgtgctccacgcatggctcaccgtgtcaaagcagtagatgccaccgccgtgcgtggacatccagatctccgtgtcaccgacgacggcgtaggagtggacatggagatcggacagcggcggtggcggcggggggagagcgcggcatcgccaatcctcattcaatccatcctcgtagatgagcccatagaagcagccgtcgccgtcgtcgtcgtcatcttcgtggcgcggcatgtcgaggatgtagaggtcgtccccgacggtgacggaggtggtaggcaacctcacctggtagggaagggcgggcatggtgcggacggcgtgctcgccggggtcgtagaggacggtgcggcaggtctggtcgacggcgaccaccgcgttgctgtgattgcctccaaggaggaggaactccatcttctggttcgcaaacaacttggagaagggagggtagaaggtcatggctgggcatggcaggctagcatactccaccgcgtcggcggcgccgacgccacggatggcaccggggttggacgtggcaggaagaagcgctccatgtcaatgttgcgcagcgtatagttgctgcggcggcggccaaactcccccagcaccagataaacaaaccgacgggtgctcatcataaatcgatcgatcgatcggattgaattgctgtggatcttcttctcccccaccacaaacaactaggctgctactctgaagaatcagaagagagatctagatcgatgggtgcctcccacccctttgggttagggttagagacagatcaccggagagaaagtattagtagttttgaacagaaaacctggtatttatttatcttcgttttggactaaaacttcctatcccaagcgaagccaaatgatctttctcgttgcaaatctcaccttagcagagagagggagtggggggagccgcccaaccgctactccgcgagcgaatcggagagtcgccggcggcggacagacgacgggacggggatggcggaggaagagagagagagaggtggggagggagttggctccggcagcggtcgttctggtggcggcgcccggggagcacgccgggtgggaagggaggaagaggacggcttatagttggccatatgggccgcctggcacggcatgggccagacccggtcatgcccgggacaagttttgtcgggctggcatggcccaaactacatgacaggccgggccgtgccagcccacgtgctccacctccgtgccgtaccgggctggcctgaaggcatgggcaccttatcgtgattttttttttgaaaaatcatatgctttaggtccttcaacttacaaaaccatccgctttaggtccttcggtggttttgaccccggttttatccgacgtggcggctgagtcagcgtgggacccatgtaagcactacatgtcagtgtgagccgtgccatgtcatcaccatccttctcacccttctctcccttcctcatctctctctcccttctgtgcggcaatgcgatgttgccgacgtagacaacgcagcggcagcgggcacggggtagtggcacaaccatgctcagagtggcgcgagacggggagagatggagttttgcctcgtgggcttcatgggcggcaggggagctcgcgcgccgctcctccgcttgccgcccctccaccgcctcgtcgcccggtgccgacgccctcctctcccgcctcgcactgtcgccctcgcagcgattctccaccccggctcgcagcgcccgcctcgccgccagcaagctcgccgtaacgcgtgtctcctcctcctgatccgcccccatcctgtgcctaccgccgcggccgccattcgcgatcggccgccaccgtggacgccattcgcaaccggccaccgccgccatcaccgcctcgtgggccccgtggtggtgggcggcggccagtaggggagcccgcgcgccgctcctccctcgctcccgcgcattactccgccgccgcccctcccccgccgctcttccacccaccaccatcgcgtcgcccgttgccgccatcaccgccgccgcgcagcccgtcgccggccgccgacgccctcctcctctcccccctcgcactgccgcagagaagggagatagatagatatatgaggaagggagagaagagggaggagggtgatgacgtgggtcatgctgacatgtggggcccacgtgggtcccacgcctactcagccgccacttaggataaaaccggggtcaaaactgccgaaggacctaaagtgaacggtttttgtaaattgcgggatgtcatatatttggttttgtagttgggggacgattttgtaacttgatgacaagttgagggaccttcggtgtactttttccgacataatatatatagctaaaataagtctattttacgtccctactctttggaccatgccatataatacatctatttatcctccctataaaaatcaatatagcaaacttggccttgaaaagaatgttaagcaatcaatctgcatgttaacactgaactatcttagactcatcaaggtagttcacttttcaagaactctcttatcatctgttatttacttttttaatctaacaattggtttagtgtaggtaatcaccgtaacatgta

SEQ ID NO: 68828 - DNA, 5202 bp, Oryza sativa
agagaaatgccacatttgtcacttgtgcctatctgacccaaccaatcttgccgcgagtctgcaacaaccgcagctcatggcgcgtagtggtggttactggttgctgctaccaacgttcagtttgcagcacgtttttttctctcctgttccaatgatatggtacatcatactacagttcaggaagagtacaattgtacaacgaacctatcatactgtcatgtactcctgtctgtccacgctgacctccagctaacacacatgcatccacacaagttgaggcaggcaagaaacactaaacaacatcgccgtgttttcctcatggaagtgacgctgacatgcgtcgatgcaatattaattatagtgtgtctgcattagacttgtgtcgtgggagatggaagagccgtcaagccaagccacaccttcttaaagacggccaagctatgcgggtagggatcactagaagtgaagtcattgccatcaggcacagccgcacaggcagagctgagagcttaggagcacattggtttcttgcaagtaaccataggccagaagtagacgataagctagctagctaatccaagcctgtgactgtgaaggagtcgagtcgtctttgccaagtcgctgtgccgttgaaagggacaagggtctcctggacagagatctcgcccgttaaatttgcctctcttttgcttctttccctccgatctctatagctgtgcaagtgaaggaagaaaggaacagcctgaattatttctccggttagtccccgtcctgtgtgtgtgctatgcgaaggagcaagtggtgtttgccttgttttcccatggccagcacggcggcgctgcccatcgagacggcgttctctcttccggctccgttgccgtcgtggccgtcgtcaggtacgtattgcatatttgtgcatacctcgtgtttttttttgttcttctggttattatgttattatttgcacgaatggttttgtgtacctctcgaatggaattgatttcttgcaaaacttggtgatcctgatcattacagcacttcgcttcttttgctaaattactaaggtttgcctttcgatactcggttactgttcttctcacgcacagctccacttagcaaattctgattattattatttttttcaatcttgtcctgatcacgcattcatcattaattttcctcttgactacaagtccaatatgattggaacatatccagagaaaaatacatgcatggcaaatgcaggagttatatggctaaatgcaaataaggcagctttaggcgatgctggcgaggtagcttacctgcaatgacgactaggaacatactttgctatattcatgggctacaagatcctcctctagtcctcggttgctctgaaatgctcgtattggtgtgcccttttctgaacagacactgataaccatgatttccaaagaatatatatgttatcaaatgagaatagaaagcatataccagcataatcttatgccttcatctagctagccagggttgtttggaagacaaatgcgcatctctatccagaacaccacaacttgaatagaccatttctgctctctgttgctatcattatgacttgctaattttttcagctctataaacacttggctaaacgaatttctattcttagttatggcctgccattttgataggcccagttttgtggttttgtcaactctgtaacatctttgtctgactggcgtttgtttgtttgcttgcttgcttgcttctttttcttttcgagatgctgactggcctttctgaattttcagtttcagatggaggatttgcaaagggtagcattgaccttggtggtctagaggtgcgccaagtcaccacgtttgccaaggtctggtccaccggccaagacggcggcggcgccaccttcttcaggccggagcaggtccccgccggcttcagcgccctcggccactacgcgcagcgcaacgaccggccgctcttcggccacgtcctcgtcgcccgcgacgtctccggcggcgggctccttgccccgccgctggactacgcgcccgtctggtccagccaggacgacgccgcccacttctggctccccacgcctcccgatggctacagggcgatcggcgtcgcggtcacggcctcgccggacaagccgccgcgcgacgaggtcgcgtgcgtccgcgccgacttcaccgacgcgtgcgaggcggaggcgacggtgtgggacaaggacgggttcagcgccgtcgccctgaggccggcggttcgcggcgtggacgcccgcggcgtgcacgccggcacgttcgtcctcgccaggagcgacgcgacggcggcgagcgcgtcggcgctggcgtgcctcaagaacaacggcgcggcgtacacgtcctgcatgcccgacctcgcccaggtgaacgcgctcctcgccgcctacgcgccgcagctgttcctccaccccgacgagccctacctgccgtcgtcggtgacgtggttcttccagaacggcgcgctgctgtaccagaagggtagccagaccccgacgccggtcgccgccgacgggtcgaacctcccgcagggcggcggcaacgacggcgggtactggctcgacctgccggtggacaacttccagagggagcgggtcaagaagggcgacctccccggcgcgaaggtgtacgtgcaggcgaagccgatgctgggcgcgacggcgaccgacctcgccgtgtggttcttctacccgttcaacggcccggcgagggcgaaggtggggcccctcaccatcccgctcggcaagatcggcgagcacgtcggcgactgggagcacgtgaccctccgcgtgagcaacttctccggcgagctcctccgcatgtacttctcgcagcacagcgcgggcgcgtgggtggacgcgccgcagctcgagtacctcgacggcgggaaccggccgtcggcgtactcgtcgctgcacgggcacgcgctgtacccgagggcagggctggtgctgcagggcgacgcgaggctgggcgtcgggatacgcaacgactgcgacagggggagcaggctggacaccggcggcgccgggcggtgcgaggtggtgtcggcggagtacctcggcggcggcggcggcggcgtggccgagccgacgtggctgctgttcgaccgggagtgggggccgagggaggagtacgacatcggccgcgagatcaaccgcgtggcgaagctgctgccgcggtcgacgagggagcggctgcggaagctcgtcgagagcgtcttcgtcggcgagggcccgacggggccgaggatgaagggcagctggagaaacgacgagagggaggccaagtaaaaattttggcggttctcaaatttcagacgacgacacgcggtgatgacgagtgaaaagtttattatatggggtttctcaaattcaaatcagattgttacggagcaattctgaaaaacgatgacagagtgcatggtgaaatatattcttttaagataagatttaatcaaacttaaaattccaatcacaattgtttctcaaatgtttggttttttaaaaaaatactgtacatagattcaccataagaactcctataataatatcataaaatttattgtattttgtaaacttactctaaaaaaattctaatacaaaatgtcatcttaaaaagtaaatattttttaaacatcaaatatttatgattgaataaagtaccgttgtacaaaatttcaagtcaaactcgaccaaatagatctatattttttttcctttttctttcaaatgtgtatatcgaacttgcagttcactttctttacgatggtgtatttgtattgtaaatatatcatatttctagtaatatgtgaaaacaaatgtaatttctggtaaatttcacttttaagtaagttttatatttttcttctcattttgacgcaacttatgcttatacttattagccaaaatttaatttttcaacatttaatctgaagctgattttaggggtttttcatcgaattttatttttcatcactaaaaacacgtacataaaagttttatttataaattatatttcgtttgtataaatatattgtttggcttcttccccgaataagctaaatgattgggctgtaccttcctctccgcagccataggataacaaacgcacggttctcatcttccatcgtcactcaccgacaccatccgtaggtcttccaggagctccttcctgccacgtcatcaatggcgatgatgggtggctgacagtcaaacgcaccccacgcctcctccccttcccccctctctccctccatggcttccctcgcctcccctcctctcccctgccgcgccgccgccaccgccagccgcagcgggcgtcctgctccgcgcctcctcggccctccgccgccgcccgcttcccctctcctctcctccgcttcggcgcgcttcccgcgtgccccctgcaacgccgcacgctggagccggcgcgacgccgtgcgggtaagcttgccaaatcccggtccataatttcctattagttagtcaatgcgaggtcattatctaaaaaaaacgtcaatgcgatgttacctgccgctgagcacgagtaatttttgtgtactattgctctgattgattacagatagaaaaacataaggctaattggatcgattaaacatgagcagcttgtaataagttgttaatcttgcggagagcctaggtatgcttggggatatagtaagtgacattgccagtgtgccgcagcaagttcggctgctatgctcgctaggttagctagcaggaaagtgtgacacccgaactcccgaagcaagtgtatattcatttttcggggctacattatcacttcatttcactatatttcgtctggagcatgcaatgtcgctgtttctttttctgaatgtagcattggcacacataatgatcttgtgctgcatcttagatgaatgtttgaagctaatttggtttgattagttccagagccaacattgtacaacatatgttatctcttgctcgaaatttgtgaaagcttgtgcctagatgaggcattctttgctaaagcagtgattctggctggaagcaagccagcaataaacacaaatgattcaggtttaactatgaataagcttgtagatttaaggcacttagagagtgcaaacatggattctattatgtaactcaatctgagtttgaaggtatgg

SEQ ID NO: 68829 - DNA, 2669 bp, Oryza sativa
agtcgcgtgtccgagtcactgtagtcgtcagcgtttgtcgttttgttctgtaactttctttacagctgtgtgtgtgctgagttatccaagagtgtaatcgatacttaatcagcccgatgaggaatgaaagatatgacgaaaaactcaattatctttgtctcataggagtagaatagatctagtgttagggttcttgcggcgaccaccaacttttcccaaatttctactcccgagtgctgaatccgtccatttctgctccctaggtcctgacagctccggcctggcttgactgagggggacacgcaccacctcccaccgaaacaggatgttataaaaccagccctggaatcacatcggaaaccaaaccacggaagaaaacgccataggagatccaaacatgatgacgacaccgaggcacgatatttgataatggagttcagctgaggcctacatctccggggcactgattacgggcgctcctccccgatccagcatatatagcgtatcagagttacaacgactcacggccggtcgccgccggcagccgctccctctcgctatgctaagtcgccatgcggttacaacaggcacgcccctctatttatgagagaacctaggatagagtccgactcttactctaatcttatacctagtacaactcaaagtcctaaactgtaaccgactttgtacacatattcgacacaaactctaacaaactccaccttggcgaatatgccacgccaacctgaatatgttacttgctcgaacctcgtgtactcggacttgagttggttcttccgccgctcacgccgagccgccccgacaagcctccaccaggcttaccgtaaacaagagactcccgctatctctgtaatttcttcctcttgactccacctgcaacagtgctccactttctcacctatcaccacagtcgtcttgccaagcgaaatttgaattccttcctagctgtcacatcatagacttcccgaagaccatgttcacctccatcttccattttcaatttgacttgaactaatccatggctagataacttgtgtcatcaccaaatagataaatcaaactcaccagacatgaagagaaccatttattccttgttgtcttatgaaccgagctaacgaattcaacatccacgccttcccgcatccatagactgaatatccgataattttgagaaaattcaccgttgccttgaatcacccgaagaaattatcaccatagcgctcgctcttcctcttcagtgacgcagatttcatatatccccatcatgtaaaccccacagatcctggatatatcctgtactgccaaacagcccgctgacaccctcaacgatttttacccgctgttgcccgggattttcttcacgcacctttgccccactcctgcaccaccgcagccttgccttcgaatcataacgcagaagccctgatgcacagttattcttgctgtcaattccagccacctagcctccgtgctgatctccacgtccatcgcgactccgagttgataaacaactccgcaaccgtgtcgacctccaccagctacacaaactgcacatcctctgcaattggattccgataccaatttgctgctctgtgaatagacctacacacaatatgccaatggacacccttgccgcatgcatgcacacatccacagccaccacgaaaccaagcttgttcctcgtgactgcatgcgatccatggcaaaagtccaagaagctcctattgcttgatccaattttgttgtgctgctcctgtgcgcaccgtcaccgcctccaatgaccggagccggcccgcgccgaatcccgccggcacctacacaacgaccacaccaagccgtgttcatgccgcacgaagttcgtcgcaaacaaatccgctccgacctccgattgatcagccgaagccgacaaatcgtcatgccgtcttcccagccgccgaacgacccgagcgctacgtctagccgtctccctgtcaaacgcagctcatcaaaaggcccgggccaccccgcccagagtgttcgatccaccgaccgagaacgccgatcgcctccagcttcaatcaacccgagcgtgtggccacacgtctccctgttgagagtagctcaccagaaagttcgagccacctgcctgaagtgtccaacccaccgattggatcgccaatcgcttccgccgccatcaacccgagcaccacatctagtcatctccctgttgattgcagccatcgaacggttcagaccgccgcctgaagtgtccgattccaccgatcaaattccgttgatcgccgccgtgctccaccttgcgtccatgtccgtccctggacaccctgtgtagtcgtcgcggcgtggagcacctccgtcgtacctctaccatggatctcccgcaggctctgataccacttgttataaaaccagccccgaaatcacatcggaaaccaaaccacggaagaaaacgccataggagatccaaacatgatgacgacaccgaggcacgatatttgataatggagttcagctgaggcctacatctccggggcactgattacgggcgctcctccccgatccagcatatatagcgtatcagagttacaacgactcacggccggtcgccgccggcagccgctccctctcgctatgctaagtcgccatgcggt

SEQ ID NO: 68830 - DNA, 4982 bp, Oryza sativa
aagcatattccacgagcatgtcatcgatgtccaaagagtcttcctcttcatttgtcggagtcttggttttgctcggtccctcttcgtcaggaatggggtccatagctccagtctccagcacttgagaggcgaagtgtgcttcatgcttttggttggtctgtgtatgacccatagacttcatgtacagatcaacaagatgtttaggggttctgcatttcttagcaatatgattgtagcaaccatacctgtagcaggcggttttgctgccgctatcattattgggcttagaattgcctttcctctttttgctgttcccacgttgctttttggctctgttgcgtttgcccttgccaaatgaacttccagtctgggtattcccgctgggaacatttttcttctcattcgcatttacttcaggcaatggtgcagtgcccaaccggcgctggttcgagttccatacagtaagctcatggttcttttatgcctgtttcaatgtctgaatgagtgaagaatagactgtgaaattcttctcacggtattgttgagtgatgatccgttctgatgggagcattgtagacagagtcttctcaattttctccgcttcagaaggttcattcttacaaaaccggagtttagagcatatcttatgaacagcatggttgtattcgtctatagttttaaaatcctgtagatgcaagtgattccactcgtgcgatgcctcagggaggataatcgccatatgctgttcataacgatttttttgagatgtccataaaactcgtgggtcctcctctagcatgtattccattttcaaatccgggtggatatgattccttattattcttaaggctgaaaatttgacgatatgacacggcggagatgatgggtctagccatgatgagggcagaaggccgtgaccacgtccggcatgtccagctgcggtcgcacccgtgcggtccacccatgggacgcacaatggtgtggtgcctccaccaggattctgtccagcgttgtgcacatgcccggcgtcgccggagaccctcggcgagtggcgatggtattggagtcggtgctaccggctccggcgttcctttgggcagccgcgccgttgccgcggcgtcttcctccacgtccggcgaagccaggaggaggagatggggggccacggccggcattgccagcacgacggcccctgccacgtcgagtatgacgcacgggagcccgaaggatcgtctcgagctgctgcaagagacgacgaaggtggcatgcacggagattgcggggaagggaggagtcggcagtgaggggaacatgacgagccattcttaccacgcacgtgccggtgagtcttttcactcttctctcttggtagagctctgataacgtattagagaacaaagatgaacagtgaaaaacagtgaatcctccaagtcttattaatctcaaaatgtccccttttatagtggggatttacatatgcacaagcctaggatactcctaggaatcaagggtgatttaagccactaaatatggctgattatgtgtcacaaattcaccataatatggctgttacaagtcacttgaatcctgccattgttgctctttgatgagtctttgatgagatcaaaaatgtctcatgatgcttttgtaacacttaactcctgcaatttgcatcactgctgaaggttgaaatacgcatgattctgaattctaatgagttatgaaagtaactgaatcttctgaattctgtagcattcaggtcttgtgcttgtctgtctatttggggaactttgatggtgccaacttttgcatgcagaattccagattgcttgaaaattttccattgccaagtttcccatattgattaatactccgtactatttttcttgatcagcttgtatggtggtgatgcagcaatagtaaaatagttgtgtcgctgaaagtagcctgaaataaacgaaacggacatgcagtggaattcggcagacttcagactttcagagttcagacttcggacatccaattttccttttctttttggatcgggctttgttaccgtttacgtcggcgtggcttcgtcttatgagtttccctcgataaactgctggtcttaagctcggtgttcacggtaacaatgtcaggttttcaccggtttcctttaaaataccttataccgttataagttcttttaatccggttccttcaataaacgagatcaactctcctcttcttctaaagcgaaattgcacgttcttttttcatattttccgtttgagcactgctacacgcactaaatttctttttacaaaactcttataaacaatgatctcaaccataatataagtagatgaaagatatataaaatctaaatgtactcataacatgatatgtagtgttagtaaaagttcagtaagataaaattttaataagtataggacttttcctttctgggtttttttttttttttggcaaaaacaaccccgaaaccactggaaatagtagcactgagccacactaaccagtcgtctccctcacaagtcacaactccagctaccttcttccttccgctatcccccagccttctctgccgctgcctccgccgcctcgccacgcggcggccggcaagcagggccccgcagccacggcgtgggcggactcctctcctttccccccgaccacctccgccctcgccttctcaggcctcctcgcgcgcccggccggcgacggcgagcatctcggctcgaatcgaactgaaggtatccgttcttctcgtctccctccctcctctgcgcgccacttcgtgtgctggattgggtagattgggactcatttgaactcgaatcgatccatttcgctccaattagacctcccagttcatccccatttgcttcgtttattgcgtgctttggtgaagcacttactaatggcatttttttttttggaaaaaaattgggggttcagttgaatctgcatgctccaggatggagatcgacgggcaggagcctgggcacgagcacgacgggatgatggagccgcaggtggtggacctcgaggaggaggaggaggacgacagcatcaacttctgggcctcgctgggcgtccatgccgtcgaccagatgccgctgcacggcggcgtccagatcgtcgaccagccgtcgccgccgccgcaggagcaggcgcaatcgcagtcgcagtcggtccgcaaggacctgttcccggtcgactccgacccctgccttgagccccgggttgggatggagttcgagtccggcgaggccgccaagaccttctacattgcctacgcggggcgcgtggggttctccgtccgcattgctcggtcgcggcggtccaagtgtaacgagtccatcatcatgctgaggtttgtctgctccaaggaagggttcagcaaggagaagcatgtcgtcgcggggaagaagacgaggaagcggcctgcttccatccgggagggatgcaatgccatgctcgaggtgctacgcagaggcgatagcaagtggattgtcaccaagcttgtcaaggagcataaccatgaggttgggatgcccagcagagtgcactacattgccatggagggtgatacggtggtcgacccttacattggtatggagtttgaatcacttgaggccgccaagacattctactactcatacgcgacccgtgtcgggtttgaagctcgtgtgcgtcagtcccgcaagtcgcaagatgagtcactcaagatgctgaagcttgtgtgctcaaggcaccgataccattcaggaagagagaccaatggaggggatcccaagagagtgcaggccttggatccctccagggatggctgtgatgcattatttgagataattcggaaagacagagatgcctggacggtctctaaactcatcttagagcatactcatgagctgaacccggcaccaacaagtagagttcgctgtattcgctcacagggtgaggtacttgttattgcaaagaacttctctgacacacgcaatctcctattgaacggtctagatttccagcatcctagagagttccagtataatgatttagggccagaggatgctcaaagcttactcagatatctcaagaacacacaaagcgaggatcctgcttttttctatgctgtgcagcttaacagtaatggacacacagccaatattttctgggctgatgctaaaactaggatggcttactaccattttggtgatgttgttaggcttggtacactgtgcagaaacagcaagtatatacctattgccatattttcaggcgtcaatcatcatttgcagcctgttgtctttggctgtgcactaattgttgatgattctgaagcatcgtttgcatggttatttgaaaaatggcttgaagcaatgcctgtgggccctcctgtctcgttggtattagagtttaaccaagaaatggctgccgcagctaccaaaatactacctgatactcattgtacgttctgtgagaagcatattttgggcactgtcagggaagagctaggaagtttgtatccagaaccagaactagaccatttcattactgatctgagaaagtgcattgactgctgcagattagaagaatcatttgaatcatgttgggattctgtcatcagaaaatatggcttcagaaataatgaactattacagtctctatatgaaattcgcagacaatgggcccctgcatacacaaggaaggtattctgtgccagaaatctactgccacaaagctgtcagaatcttgaaaatgttatcgagaagcacttctcatccaagacccagttatgggtggccgttcagcaacttggacaagctgtttgtaatttttatgaaaaggaaactcaggcagattatctgacaacatttcaaatggcaacagttaggactgcatcacctcttgaaaagcaagcaagttcaatattcaccaggtcaatatttgaaaaatttcaggatcagtttgccgag

SEQ ID NO: 68831 - DNA, 645 bp, Oryza sativa
agattaatgagaacttttattttattttactatcttgtgcataaatatttgtagggctaaacataaataatatactctcgtaaattatatctattgcttgaatgcagctcttttctttactttctttgtgatcatttacggtttggcaagcaatagcgatcataacaaccagcatgacgcaaaagttttaaaaagttcgaaatttttagtgatttttattgttgggaattttcaggatgttacactcttcctagactatacctctctttctcctcaatttgtatccctaaacacttgtattcttcagtggattgcaatatatcggtggcatttgtgtgagagatttggtgtgattgtgacagtatccaggtaacataggttcatatagacacacacgttttagtttctctgtagcttcgtagtaaaggctagtagtagctagcagaagtgcagaaaacaaatgtaatttgatcaatttcactctcatccagctgagaaccaaacgtctccgacaaattaaggagacagttaaagtcaaaaggagggaggaaattagggcaaaagttgatgctagtgaatctgacatccacaaagagaaatgattggtttttggatccatctacagtgatctgatcccgttgccat

SEQ ID NO: 68832 - DNA, 1830 bp, Oryza sativa
ttcaaaaatggtaaaggtggtgcctgatagatccgaattccaatatgaagcagttcgcataagtctaaagaaagcaatcttgcggatgttcttgtagtgattgagacatttatttttcttgagccaattgttttctagcaaatagtcagtactttaacagaactgtgagaattagtgttaccagatgcagggttctaaaaaggcttagatatgttgggcatgatctgttgggtatttggccttataacaagtatgatggctgagatgacctgtttaaatgcattactctgctcaggcatattattcatgatagctatgaatgaataatatgcctatgaatgcattactctgctcaggcatatttttgttacttattttctatgcttatttaaaaacactgtgtgccttgtatgcataacgatgttgaacctggtacaggtttgctctcaagctggtgcagctggaccagccccattatcgaagacattgtcagacctcaaggattcctgctggagatttttacggccacatacaattcgaggaactgccttgggatccatgtgtggttctagttttccttttatattggtcaaatttgagttttcatcttttggtgctaattttgctgtgttaatacagagcattagttgctagagctttgatagagaacccccaactgataaattggtggttggtattcaaagcgttctatgggctcgtggcgttaatctgtggcaatggttacatcgttgggatcaatcagatctatgacattagaatcgataagtatgtataatctctctatagattcatataagaaattatggtgatgttatgaattaccattaagaacaaaatttccttgcctatttcttttaactgtattctgacatttctaattttatgctgctttacagggtaaacaagccatatttaccaattgctgccggtgatctctcagttcagacagcatggttattggtggtattatttgcagctgcgggattttcaattgttgtgacaaactttggacctttcattacctctctatattgccttggtctatttcttggcaccatatactctgttcctccattcagacttaagagatatcctgttgctgcttttcttatcattgcaacggtactttgctcctatcttctctttgttcacttcagtaaccattggatttttttttatctgtttgtttttgtgtttagaagcattcttaacgtagtttgttagcaatgtattgctggtcgaattgtggttactcaaaataaaatagaacacctaatcttttcattcaaagtgcatgtaatcagagcactttaactcatctgattcaaagttggactgactgaatctatgatatattttttgtcaacaaataatctgtgagatatacctagtaagtatctgaactcatctggttcgaagcttatgaaagtgaaagacctatttgccaactgagcatgactgagagctagcagtgcgactagcaaatcacctcaaccattcctcttgctattctaattttcgagaatagatcttgtaataccttctgaacaattgttccttggttccctaatagttagcaaacaatgcactgtgcaattcagaaactttaaaatccccatgtttatgctgcatatgatttgattactaactcatatttatttttcaatatttcattcattatatatatatatatattttgacaaaccaccattcaatttttattaggtccgtggttttcttctcaactttggtgtgtactatgctactagagcagcactgggtcttacattccaatggaggtaaaatagt

SEQ ID NO: 68833 - DNA, 2664 bp, Oryza sativa
ggtggcccatgcttccgggccgccagggcgtggcgctgtggcagcgtggccattgcccattggctgttccccctatggcctggaagcgggagaacactttgccgagagtaggaaagccgtgtccgtgagctactcggatacgagccgcggcagaaggcaacgcggcttcgaagccctaaccccccaaattcgctgtcttgactctgctatcgaaacccgcgcagctttcggattcgagggcgaggcgcgcgcagggaacgcgatcgatcgtagccatggccgccgccggagaggagaaaccgttgccggcggaggaaatccaggggatcaacgacgaggcggagccgcatcccccgaggcgtaagcgtaacgacgacttactccacgacgaggagttccagcgtgtggtgcgcgacatcgtcatcggcccggataacgttcccggcggaggtacgtgattgccccctcctctttgccatgtgagaactatatatcatccggccattccggccggtccgcgtaattggcgaattagtctggctaatcctttgcgaatccggccggtcttgtgcaggacatgcgttgaggattatcagagaccctgctactgcgttcgaagagctcctagagtgctaccgcaaggccggcctgctagaaggtcaagtctggaagcgttgtaacatcttcaaggggttggaggggttggataacttgcaggatgaggtgaagatggaggagacagtgaaagaggaggaggaggaggcgacaggttgccgatgcagatacgcgagccctgatcgtcccgatgagctggcgaagaaacgacgcttggatgggccttgagctggattatggatgcaacctgccatttgagctgagctgtatttagtaacactgtcaatttttacaacagtagagagattcattcagtaactagtgattgttctgcgtgataacgaccgcagttaccatccctagataatactagtatagctagcaatactggtgagccacaatcagcagtaacccatgttccaaattgacccttaatttgtaacttcgttttctgaagactgaggtttagttgaatagttgatgtcatagctggtcttgtggcctatcgaaccttgtgtgtgttttgttttctttaatgaaagcgggagcggtgtggccttctctttggaaaaaaaaagggtcttgtggctcactagctctctagtattctagtagttacaaatttataaatcaggatgatgagcacagcacattgctgcataggtttcatcctatttgaattactttggagtattggggatggttggttcacttgagaacagggatattccaggtaataggctacaatttgtgtctattgcgtgacataaattttcatgttgaattaaatttcgtgccatgagaaaattgtggcagttactcctacttagagcaggtacaatagcaggctattagccagctataaacatattttaatgagataaacgatgagagagaagagcagcgggctacagatttgtagccaaccgcagcacggactccaagacgcaatgtgtgtatgacaggtgggaccatatattaatagtatagtaagctactattgtattaattggctattagctcggctatagatgaattggagctagtaatgggctatactattgaacttgctcttaggctatgttcgcacatagtgattacggaaaacggagcggtctattagcgcgtgattaattaagtattagctattttttttcaaaaatggattaatttgattttttaagcaactttcgtatataaactttttgcaaaaaacatactgtttagcagtttgaaaagcgtgcgcgcggaaaacaagggagaggggttgggaagaggggataccgaacagagccttagctttcttgctagcctttgggtaaatcgagttttaaggccccgtttggcaaagctctagctcccaactccaacttacctggagctggagctatgccaaatggttcatatgctccgtttttaggagtggagttagcagagctactcctgaaaaatgaactacgggggtggtgctgggtttttgctgctccatagctctactacaatctaagactcactaccctctaattttttagtgtatttatgcaaaaatgccattgaactaccccttcctactcctctcctcttgttctctctcctctccatcttcctccctaacctcctcccgacggccacttcatctttcctcccaacctccttctgacggccgcccgcgtcggcgcctacggcggcagcatacggtggcgggggcgacggcgcgtcggcgcacggtcagcagtcgacgcgcggcatcggcatgcggctacgtcgacagtggcagcgtcgtaaggcggcgcgggtcggcgatgggcgtgcggcggcacgtgggagtagcatcggcggcggcagcggagggcaacgcgcgcgtgctgagcagcggcgttggcagcgcgagctgagcggcgtcggcgaggcgatgctaacgaggtgttcgatgaaatgccaacaagggatgtggtggagtggagctaaccaatatagtcaaacacttttgtatccactttagctgctataggagctacttcctccgtttcatattataagactttttag

SEQ ID NO: 68834 - DNA, 6322 bp, Oryza sativa
agctccaccggtgctctctgtctgggaggaagaaggatagagaaagaaagggaagaggagatgggggaagaagtggccactaacgtgtggctctaatttttatttttagttttatttgctgagtagacttccacatcattgccacatagatgaaaaccagctgaaaaaccacttgagggtgtaaagtgaacggtattgaaagttggagggggtgaaatatctggttttaaagttttgggtgtattttagacaagacaaatagttggagggtgtaaaatggacttatccctataatgtatgacaagtgggtctcactattttttaaaaaataaaatgctgactgaattaccacgtgtacaccacgtaggacaaaaccactttagattcggtcgagagggtaatttgtccagtattgaaagtttagggtgagtaatatctagtttttgagtttagggggtaattcggtcaaccacgataatttaggggataattcgtactttttcctttagaaacatgccaggggaaatttttcatgtagccaaaaaaaataaaagaataattaaaaaccatataaaatctcaaaaaacagaaatatcgcagaaatatattaaaaaggaaaatctagataaagtgaaaaacccagcagaaaatctagaataataaaaaaataaaaaaaatattcaacaagaatatagaaaatactaagtcatatttaaatgaggtacccttttcacaagatcagagaaaataaaaattgatctatgcaacatactgagatcatgatgagctttataatgtaataaaatatcataaaagctgcagaagtatcaatggcatccatgcatccacacatgcaaataatatatttcatacaaggttataatgtcttgatcaagaaagaatgatgagtaatcaaagaaatagggctgaagtctacagactatagagaacccatactagctagtacatgctagctagcatttgcttatatcacgatgggataaaactctgtacaaaatctcccaaatgttctccaggtacaaaaacttgatgaaatgcatgtgtgccaaccatgtccataaggcatcttgaatctcccaatcatactctgcattataagaataattgttctgcatattcgtttgaaagagattgcagagtgtcataacatatattatgggcacttactgaaccagaaccaatacgacagtgtatagctaagtgaaccaactacttagtatgacagctatttgcttcctgaaacaagcttccgagagataactaaagaaaggatatatgcagagtattatttgtcgaattaaagaaagtatagcgaaagaaggactatctaggaagattagtaaaaacaggatatttacttgatacagtacaggaaactactgctagcaaaacaaaactaatcttccctcctcaatcgaaataaatttagctctgttcttatctccaagttcccaaaccctcttcctcgttttccgcgcgcacgcttttaaaactactaaacggtgtgttttttgtaaaaagtttctatacgaaagttgcttaaaaaaatcaaattaatccatttttgaaaaaaaaatagctaatacttaattaattatgcaataacacttgcttcgttttactgccatatctgatcacaaaatgattacaaatgacaacaacgacacaactcaaaagatcgatcggacacatattcatatatgattccctttaaaaccattttattgtattattgtgtcattacagcagatctacctgctattgaacatgacaaaacctttaatccttcctgatctagctcagttaagagtaaagtagggcctcaaatcattgctttggtcagtgatttgaggcccttggcctactaaagtgccgcatgactaaagcacccaatacatcatttcgctggtgagcttgtacatctcagacctgtgcttcagcatgcggagccctcctccattggcaccaccagcatcgtcgtcgtcatcgcagcgctccacctcgacggcggttaacacagcgaacagctcctcgccatcacgctgatcctcatcggtctgaaagaacctggcaatgcagaacttggcggctcctaggtttacgaggtatgagctgacaagctggagggcgtcgggtggcgtgaactccagaggaaggctgtgaagcaccggcagcttggtgccatcgagatccagagcggagaggaccaagctcctcctcctgtctccagtgctgcatgagaggccaaaccaaaggccgtgctcatggcaatactcggcgagaccaacaaatggcagcttccagccagtggccactgtgctccacacatggctcactgtgtcaaagcagtagatgccactgccgtgcgtggatgacatccagatctccatgtcaccaaccacagcgtacgagtggacatgcaaatcggacttgtgagacagcggcggcggcggcggggggagagcgtggcatcgccaatcctcatttaatccatcctcgtagatgagcccatagaagcagccgcaggggacgtttccaccgccgtcgtcgttgacatggcggcgcgacgtgtcaaggatatagaggtcgtccccaacggtgacggaagtggtaagcaacctgactggtagggaagtgcgggcatggtgcggacggcgtgctcgccggggtcatagaggacggtgcggcaagtctggtcgacggcgaccaccgcgttgttgtgattgcctccaaggaggaggaactccatcttctggttcccaaacaacgtggagaagggagggtagaaggtcatggctgggcatggcaggctagcatactccaccgcgtcggcggcgacggccgacgccacggatggcaccaccggggttggacgtggcaggaagaagcggtccatgtcaatgttgcgcagcgtgtagttgctgcggcggcggccaaactcctccagcaacagataaacaaaccgacgggtggtgctcatcatcaataaatcgatcaatatgataatatactgtacaattgaacatagggaccccgcgtcgctctcgcgcgggcggctcggggggcgaaaaccctagccgcccgcgcctcctccccctctcccccgcctcgccgccgccggagctcgccggcggcaaagccggcagcgagcagggaaggcggcggcaaggtcctttcttcctcttggcagctccctcccggcgcgacgtggacggggcgacgtcgatgaggtaccccaccgccgggagaagtggaggcggcggggcggtgtggggtggcggcggatccggcacccccatggccggatctggcgcggcagcgcggcccggcggtggtgcgcggctgggggcggcgacggtggcccgacggcgcgatgcggctgggcagcggcggcggcccggcggctgggagcggcacggcaaggcggcggcggctccggcggcgccccgcccggatccggcgtccccacggccggatccgactcccggatggccagggtcgttatggccggcgtcgctggcgacgggaggacggcgcgtgcggaaggacggcgcatgcgcgacgggaggacgccggcgttgaggtcgatgcgtgcggcgccgtgcagcgggccgacgcggcagtggctggcgccggcgatgcttgccgccggacctcgtgatcctcgtggatgaccgccgatgggggctgctgccagatggatggctgcgttgtgggggacccgactgggacaccggcttgcatggcggcggcggggtcgttgcacgtcgcccgtgtggcggcgctgcaggtgttggccggtggagatgccgccggatctggggtcgagctcggattcagccgcacagtactgccatcacgaccggcgatgacgaggggacgccatgtgggtgccttctcatctccttggagctcctccccttcttgaccgcctggtcgtggggagctcctttgcgagacggtgaagacggcggcaaggttgccccaggttgttatcgatagtgatgggcggtggcgggcactctctttgtaggtgacggcatgggaggaaggctagctggtcgccgaagtgcagcggtggtttggtcgtgctcgttccaacgtgtagctgtgggggtcgcgctggcagcaggttaggtcgcttggagtccagccgacggaggggcgtcgttgctgtagaggccacgtgttgacattgcctgggagttggtgaggtagcggcaagaggggcattggcaagtgctaggcgaaagccagcccaattcttgggcggcaacggcgatgtctttgggcgttgcaaccctcttgagggcgttgttgaggtgcctccctccccctcttcaaggatcctctaggtgaaaacctcatcctttcgggatgggcgatggcggcgttttgaatgtcgtgaccttcttgaaggcatcgttttggaggtggctgtgtgttcctctcggtgtggtggtgtgtaggcacgtggcggggtgtgttctcttgtccggttcccctgtcccctgctgcttttgcctttggttgtaaatgtctattttactcctcttaatgcaaaaatacgcttctagcgtattcccgaaaaaaaaatcgatcaatcggattgaattgctctggatctccttctcccccacaacgaacaactaggctactactctgaagaatcagaagagatctagatcgatgggtgcctcccacccctttgggttagggttagagacagatcaacgaagagaaagtagtaaaacttggtatttatttgtcttcgttttggactagaacttcctatcccaagcgaagccaaatgatctttctcgttgcaaatctcaccttagcagagagagggagtggggggagccgcccaaccgctactcctcgagcgaatcggagagtcgccggcggcggacagacgacgggaaggggatggtggaggaagagagagagagaggtggggagggagttggctccggcagcggtcgttctggtggcggcgtgagtgcggcctgcggcggcgtccggggagcacgccgggtgagttagcgaattttttttatttttaattttttttattaaaagttttacaaaaataatttttcattttgaacattgccagacacgtggtcgcctcccgccgtccggcagggcgattttgcaccactccgccatcgtacagggcgcccaaactgacgtggcagacggccgttcgctctcgaggcgacggccgtccaggaaatttgcaggggcgcccccttgccgccctccgctagggcaattttgtagcggccggggggccgcctgcaaatgggcagcggggggcctggaattttgcaggcggcccccttgccgccctgggggagggcgatttttgcctccccctataaagcccagccctctctctgaaatttcattatattcagtaaaaatccaaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtattgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtatcggtacaagagaaagatataaatgtttcaatgcaaaccgaagatgtagagggtcctatcaacgcaggggatgttgttggaccatcgatgtaaaatgaggaaaatcaaccaagggaggagcaggccatgggcatggcggatgagggggagagagtcgg

SEQ ID NO: 68835 - DNA, 1043 bp, Oryza sativa
aagggtaagaaaccttctcaccgtgccactcgttttgtcaagaacaatggtaagtattgctccaagtgtcgtgaggttgggcatttggtgaatgattgccccggtggtaagcctcctaagacatgcatgtttgattctcattatatgcttaggaaggctcatgatggtagcattgttgctagatatgtgggttcccctatactcggtggtaaaaagaataccatttgggtgcccaaagctttggtctctaacctccaaggacccaaacaagtttgggtacctaaaagagcttgatcttcttttgtaggtgaactaccacaccagtgggagccattgggtgcttgatagtggatgcactcaacacatgaccggtgatagggctatgttcaccacatttgaaataggagtgaatgaacaagagaaagtgacatttggagacaatagcaaaggaaaggtaattggattaggtaaaattgctatctccaatgatttgtcaattgataatgtctctcttgttaaatctctaaatttcaatttgctttcggttgctcaaatttgtgatcttggcttatcatgtgctttcttcccgcaagaagttattgtttctagccttcttgacaagtcttgtgtgttcaaaggttttagatatggaaatctttacttggttgatttcaattctagtaaagcaaatttgaaaacttgtttagttgcaaaaacttcattgggttggctttggcataggaggctagcgcatgttggcatgaatcaattgagcaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattggagctcttgcatatggatttgtttggcccaacaacctataagagcattggtggtaatagtcattgtcttgtgattgttgatgattattctcactatacttgggtattctttttgcatgataagtcta

SEQ ID NO: 68836 - DNA, 1772 bp, Oryza sativa
ttcctgcagcccggcagaaggcaacgcgaaaccctaatccccaaattcgctatctcttggctctgccatcgaaattcgaaacccgcatagctttggagcaagccgaatctgcaaccaatccatcagattggagggcgaggcgcagggaaggcgatcgatcgaccgaagccatgcccaccaccgcagaggatcagaaacagtggaaggtggtggaagtccagcggatcaatgcggagtcccatccccctcctcggcgtgacgataggtgtgacgacctccgcaacgacgaggagttccagcgtgtcatggacaacgtcgtcttcggccggggttatgatcccacaagtacgtgatccgatcctcgatgtccctttcctgcacagtgagatcaagtcttccgatctggctgatcctcggtatgttttgtgcaggagatgacctcaggatcagcactgaccctactgcgatggtcgagctcatagagtactaccacaagatgggtctgatagaaggtaattgaaccctcttctcgtcttcctcttttgtttttcattcccggaggtcaatatggatcctttcttcttgtttctttttgttcgctcaggtgaatgggtggcttagagcttcttggagggggtggatggggtggaattggaggataagacggcgatggatgagaagccagtgatagaggaggatgatccactggtagagaaagggtttttcctcccggttagtaaccccctatacttccggttttgcaatcgggagtagcaatccgggactaaagatactcatctttagtcccgggtgaaataaccgggactaaaaatgtatctttagtcccggttcgtatcaccaaccaggattaaaaatggcgatggcagcgccagtcccggttagcaactgggattaaagatggcgatggcagcgccagtcctggttagccactgttttttttcattattttttcccaaatcgagttggaactacacaaatctcttcccaaatcaagttgctccctttatccccaaatcaaaatcaaagtatcatcacaaacatagattcacatcataaattctcaagaaaaaatacatcaagaagagttggaactgcacaaatctcttcccaaatcaagttgctccctgtatccccaaatcaaaatcaaaaatatcatcacaaacatagattcacatcacaaattctcaagaaaaaatacatcaagaaatacatcatgtttgtacatcacataatgaatcacaacttctaaaaattctcagatccaatgaatcacaacttctaaaaaattctcagatccatcacaaattcttaaaaaaaaaatcaagttgctgccggccggcagccgcgcgccacgctgctgcccgccacccgctagcgcggccacgccgcctccctcccatccgccgccgcccgcccaccctccgcgcggcccgccgtgccagccgccaccgcccggactcggccgcctggagaggatgaggtagggaggggtaggagaggtgaagggggaggaagaaggagagagatgggagacttctgagatggagatctctagagaggccggctgttaatttaatgcaaagaggggagaggaagggagagggggataagatcaatgacgacgactgtggactgatacagaggcgggcggctcggggtgaagtttagtcccggttagtataaacaaccgggatttttagtcccagttatttataccaaccgggactaaagataattggggccctgactcg

SEQ ID NO: 68837 - DNA, 7576 bp, Oryza sativa
cacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggttagggccgtcatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctatcattgaattcatccttacggcacgcaagcctactttagggatcgatacaagaaaattggtccgtccatggccgataacaacatagtgtttggcaacatagtgacaaagtacatggaagataaaatcaaaaaggcacggagacatagagttgttgctcaaggcacacaagtgcatcggtatgaaataatgtgtgttgataggagcaggcgtggtatctattacaagcaagccgtgcaggaatgtgtcttgaaggcggatggtggatgtacctgcagttatatgaagccgaagcttcatcaccttccttgctcacatgttcttggcttcttgctgctgccggtgattgtggcatatctcccaatgtgtacgtctcaaattatttcaggaaagaagcagtctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttagaaaataaaatgctgttgtgatgtgatgagtgttcagactaaatacttctatcgtgtaatttcaattgaatgttgttgtaatgagtaccttcgactattgttgtactagtagtattgcgaactattcggtgttgtatcataatgttatcgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatagcgtacgacacaccggcgctgttcaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgttgtggacttccggctggtccactacgcacggtccatcgcggatgctcagccacaggatgtgccgcagtggagctggggttctgccgtgctagcagccacgtaccgtgccctctgtgaggcgtgaacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagcagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtagcttcctcgcacttgtgcgcgtgtgaccttcactccagacgccccagagccgcacgttgccgctgtcacggacgcgtatcccacgcaccgtgaccgagactacttcgtgggggtacgtcgaatttgtattagttcttacaattatttcatttatcttgcataatataggacaattactgaattttttatttccatcttgcataggctgatgccgcacgggatatcagtgccgatatcaccgtagtccaagtgaggttgaacagaggtttgcacttgactgacgttgagcagagggtgaccttcgaccggatgcaggagaagatgcatgcggtcatgcgcgtcttctcctgtcgcagcgccgtggacgtcgtacctccagctggtccgatacaaccacggcctcgcgcgcctaccgtcggagcaggaccttgacctacggcacctgtttcgcatggtactgctcagcccagaggtttcttaagttttgtttctgtttttgtatgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttctacgagctccgcaggggcgttcgccacctcttcgggcgtgttcgccagctcttcctctcacggagcgtcgatccctccccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccatgacgtactaggctcctctcagcttggaggagcaccagaggcgcacactcaggagcagccagaggtcacacctgtacaggcaggacgggttggccgtgctgtacccccggaccgactcacgtactcccaggggcacattagggcgcagggtaggagggacaggggtaagaggcctcgtcagtagtgttctacctcttcaatccttatgtgaccgtttcttttggcttacaaacttgtaaagcagtactacttttgctattactactgcagtactacttgtgtttgtctcgtctacatagttcttttcattcatatggtgctagaacaacttattctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacacgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggtcaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactagaggaacaatccattagggttacctaaatggtccgagcgtccaaagtgtgggtgcagagatcgctggcaggtggctacatcctttgctgaacaaacatttggaaggagatattttgtctgccccaatgtagacaacgatttcgttgtatgtctaaccatttacaaaatccgctatgatttgcacaaaattactacccaaactgaataacattactatttttacagggcaatccaaggatgtgtggatttactcgatggatcgacaatatcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttttctacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttataaaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgttaattttcaaaatgaaaaattatttttgtaaaacttttaataaaaaaaattaaaaataaaaaaaattcgtgagttagccggggggttatagttggccatatgggccgcccggcatggcacgggccagacctggtcgtgtccggtacaagatttgtcgggccggcacatcccaacctatatgtcgggccagcccacgtgctccacctctgtgccgtgccgggctggcccgaaggtacgggcaacccatcgtactatttttcaaaataagtctatttctcctccctcttctttgagttgtgacataataggaaaaagtacaccaaaggtccctcaacttgtcattgagttacaaaatcgtcccccaaccgcaaaaccagatataaggcatccctcaacttacaaaaccgtccgctttaggtccttcggttattttgccctcggttttatccgacgtggcggctgagttagcgttggacccacgtggactccacctgtcagcatgacccacgtcatcaccatccttctccctcttctctcccttcctcatctctctctcccttctgtgcggcagtgcgaggcaggagaggaggagggtatcggcagccggcgacgggcgacacgacggcggtgggggatgagctgcggggtgggcggcgagggaggggcggcgtgcgggtggcggcggagcaacgcgcgggagcgggggaaggagcggtgcgcgggctcccccatcggctgccgccctcaaggcccacgaggcggcggcggtgggaggagcggcgggcggacagcgagggaggggcgacgtgcgggcggcgaggagaggagcagcgcgcgggcttccccgccggccgccgcccacgaggcccacgaggcagc

SEQ ID NO: 68838 - DNA, 10611 bp, Oryza sativa
acgacaccgaggcacgatatttgataacggagttcagccgaggcctacatctccggggcactgattatgggcgctcctccccgatccagcatatacagcgtataagagttacaacgactcacggccggttgctgtcggcagccgctttctctcgctatgctaagtcgccatgcggttacaacaggcacgcccctctatttatgagagaacctaggatagagtccgactcttactctagtcttatacctagtacaactcaaagtcctaaactgtaaccgattttgtacacatattcgacacaaactctaacacaggagattgacagggacgctgcggcggggagccaggagattgttgctgccgcgcaggtagcgcccgtacctgtcgcgcaggaggacgacgccgcgggcatcgcgaccgccgacgacgtcggagccggagcacgcgacgggctgccatatgatggcgtccatctccaccctgtcgcggtcgcgctgcgcggcgtccaccgagaggaaggggagcggggagccgtaggagtcgggggccccgaggtagcggccgtaggcgccgcggaggcgcacgtactgcggcagcggcgccgcggcgtcgatcggcggctcgacggcccacaccgcgcagtgcctcgagtcaccgccgccgtcgcgggggaggctgccgacgtagacggacctcccgtcctcgtcggcgtggaggtaggagccgctcttccagatcctcagcgccgcgaactccacctcctggaaaacctccatcatcggctgccgcgcgaggacgttggacaaggactccatggccgcgccgcggtggtgaggcgagcgatcgatgcgcgcgcgcggtggcgaggcgaggcgtagcgagagcgcgcgcgcgatggcgaggcgtggcgtggcgtggcgtggggaggaagacgagagaggcaagtagccgtggaggagtttgttagcgacggttacgtttcgacgccgagggaggcggtggcatttgaaggcgtcgcgactcgcgagaagacgcaggtcgctctctgacaggtgggtccgacggtcagctgtggtcaaccgtagtcaatgacgagtggggcccaagaacacggagtgtagaatttgctcaaaggaagcgcagattcaggattggatttgaaagagtggactctgcaagattcatataaacgagttctgaacttgttctcatctctgcagcaaacaaaacgaatctgcccagtcctttccagtgagtgagtttattgtgaaattttacatacaaaaaacagagttctggacaaaatttgttaggatgatcccatagccaccatggatgcttgatcgcctgaccggttcagtgattcagaactcagaagattcagttacttactgtcatcactcattagaattcagagtcatgcacatttctaacagtaatactatattatattgcaggagtttgatcataaatgcatgtctggtttcattgaacaaatgcagataagtcagaatagtgcggcctcgatcaattggtccagtgattccagaaattcggtgtctgaactagctctcatgacataatcactgcattgaactgcaatgctgcatgccattttgttactttcatgttgattaatttcagtggttctccactatttttacaggcttgcagcaccagaatcaaatagcgagggtaatttaaactagccaaaacatctcagcaaagttcatggaaaatagcaactataacaaagttcaattttaagaaacaatattataactgatgccatgttctaaaaatgacaaactggtttaaggtgatcacaagaacgatggcatgttctacttgttgagctttgatggctcatggctccatgcctccatatgctcattggattttaagtgggtctaattccgatctcttggaggtacggaggttgagagactcggaagaaacagaagaaattcctgatggtgattatgaaccggatgaacctgatgaggattgatctgataaatggtttacagaagaaattatgttatataaagttgatattgataagcacaagtttgttaagatgcgcagcattggggatcgtgctctgttccttcagtggtgtaccttctaacaaaggaattttccctatgttaaaacttgattgtgcttatctttctgatgaattttctgaagaaatgtgtggaaataagattaggcctctgtggcattggtttagttgcttgtagacgtgcctctctgtttggcgagggcacggccaaattagggctatcgtttaattgtaatctcgttatgtttgtcattggctactacatttatgtgtcacaatggtcaaaattgctcggtaaattcggggccagtactatctaagtttggctgacatttagaacgtatgttgcacgtgcacgaatactagaaaactcaaaaggccgaattggccatcattccacgagaaacaacttgatgcttcacaagattcgccaaatttttatcaagaaatcaagaggacaataattcatattgacaaaataaataaataaataaatgcgtcaaaaaaaataaataaaatgtgtggtgctatagctgaaggcacgagatgcgctagtagaatgttggcgtgatctagacaggagttggccagttgagccaaggctgcgacggcgccgccacgtcatcttcgccggagagcctttccatctgacctctcttcatgtcccatctgccaatgtctcgccggcaatgctttctcatgctgacgagttcgtggtcgtcggcgaggtaagcgcatccgggcttcaacgccgggaagtgctcagccgggaagcacgccgagaactcgtagccgaggaagaggacatgatcctccaagctcgccgccgacgcctccacgagcttctgctcaccgccgtcgaccttgaggatctgcagttgtctggtgaagagtccggcttcgtcgtcttcgacgtcgtcgccgtcggcgtagtcgaacctccaaacctgcaggagatcttcggaacatggcgcgcccggacgaggtacttgctgccgttgtccaggtccgtgacgccccgcatgacctctctcgtcgccggcggcggcggcggcgacgacgacgcggatgcggcgcgtgggacgtcgatagcgtagatggagccatcgaaccgcaacgtgtagaagaggccgtcggcgtcgtcgtagatggcgtggcgacaggcggtggagcacgcctgtcccgggtacgcgacgggcgtccaccgctcatcgccgtcgggccggtgcaggaggagcgcgacgcaggcgctcccctcggcggggctgcacgagaggaccacctggtggtacgcccattccctcgcctgcgccggcgagtacacaagggacgcctcgttgtatgccatgtcgtcgtacaccctgtacctcgtcttgccctttctgctcgtgaacctctcgacgttgtggaggctggtgatcggcgggagggtcgccatggcgccggtgagagggttgacgagaacgagatggaggttgggcgcctcgtcgacggtgaccagccacccctgcgacgcgccgaacacgggccgtccatcgagcagggcggccgggagcgggacacggagggacttgccggtggcggggcagtagagcgcggcggcggcggggccgtaggcgtcgcaggagtagagcaaccacggcggccgtgccgtcgtggacggcaggcggagtcgccggaacgtggcgtacgcggcgcgccaggtggagcagacggcgccggagcggacgaggtcgtcggggtcggccaaataccccattacggtgatgacgacgtcgtccggcagcgccgaccagtctgcgacggcggtttcttcctccatggcggcggatctgccggaggcggccgggagccctactggaaacggatgaattggcggattttttttttcttgctctgctttgcgactgcgatttgcgatgataaaacggccgagtcggagatcgaactgttcagcccatcgcagtgtcagagactgaataattatctggcatggttgtgatctttcctttcctttcccaactcatactctccaatttttcttacgaaaaattgttattgaaaagttattaaaaaaattatattaatctatttttaaatattgtattaatcatgtgctaataagtttgcttgttttccgtgggaggaaggttcccaactccattaaacaacggaactgctatattaatttttttaccgtcgattccgctctaagatttgtgttgagatattttacaatcggatctagaccctctttttacaagttagtcccattatcgcatgtttatggtagatttgttcaagttacattccagttacatactagttacattgtagttacactctaattacattgtaattagattgtaactacagtgtaactacactataactacattgttatctctatataaattggatataaagttgcatatattattttaatacatatatacaagttattattattatagtatagttctagtgaaattatatactatagttagatttgaaagttttccccttaaaaaacactcgacagttttttagctagtcccttaaacaaacgttattgtagtcttaatttgctcttttggtaaaatgttcagcccatcgtcgagtccgatgataaatttgattcatattcgtgaaataggataccggatatctccacctctcaactattaaaatcggtgcaatttgactcccacgatagtttcactgacgtggcgcctatgtagtggtgttgacttgatcttcgactcacgtttttcacctctcttttttgatttgacatggaaatatctcccatcccttctttgactctttttccttttttatacgagaaatgatcccaaatgaaaaatgaataggtgtggaagttataattgtaaataaaccacgatcgaatctatggaagcattggtttatacgttccttttagtttcaactttagggataatttttttcgctatcttcttccgagaaccacctaaggttccgactaaaaaagtgaaataatttaattgaagtaagaagtctccccatctgggagacttcttacttcaattagtcctctgttcttcgaatggatctcttaattgttgagagggttgcccaaacgcggtatataaggcatacccagtaaagcttacaagtaaaccagatatggagatggtgactaaagttgttgtttccatttttatagaatttcaagattacaatggatctacgaaaagatcgtgtatttacaactacaatggaatagtatacaaagtcaacacaaatcattaaatagaatttatggctacacaaaccgttgaagatagttctagacctagaccaagacgaactcgcgttatgtggtgttagaattaaaaaaatatatgtgagacccatttatccgcagagtgactgagtgactggcgcctacctcgggaggccatgcgccatgctgatgttgtcgacatcaacaccgatgagcgcctccttcctcctcccagtcaccgctcaccgacaacatgtggaggaagagaaatggttaggtttgaccgatgttccgtgtctttctccggtatccgacaataacccctcgttgcacactttgcacaatgccgcgtcacccttctgtcttctaagagcaagtttaatagtatagcccactactgactctaattcatctatagccaatttatataatagttgcttactacactattaatatatggtcctacctatcatacacacaatacgtcttagagtccgtgttgcagctggctacagatctgtagcccgctgctcttctctctcatcttttatctcattaaatatgtttgtagccggctaatagtctgctattgccctttgctctaacaacgctttaccctttgctcaacttccttaccttttatttccatcacacgcgttttatcatctgacatcattgcaatatctctctttcgtgcaacacacagatattttgctagtggtaaattaatttcaaatgctcggttggacaatatgtcatatcagggataaaatttgatcctatagcaaaacattattagctattatccctatatcaaactgaaaattttattatgcacaacaagtaaaagaattcatgttttttagcattcaaaaaaaaaggagagaaaatgtaaaagggctagattgatcacaaataggactctaattattatcggcctccctctctagccttcatttcttcgtggatctcttttagcgtacaatgacccatgacaggtatcccaagaaggatgaccaaacagaaaacgatggcaaataccccctcgatactgttgcaccgtggaactaacgggacaacaaagaaagcaagcaacacgagagcaacagtgttcgcgaaccactgcaatatatatgaagaagagttaaaataagaactaatggttagttgaatatataacgaatgtaaacaatagtagctgataagacaacgagacaaaatatacagatatgaactttcaatggtatagctttaatgctctaaattattataagtataggtttgtccttgatcaaaccatttatagaaacagaaaaaaaaaatataacaatatctacaacaccaaattgatttcactaaacccataattaaatatatttttatagtatatttatttttttgaaaaatattgataattctttttataaacttggtcaaagtcaatgatgattttacttgaaacaaactgatggagtacgatttaaagccacataacttatagatggccatctggaccgtccggcacggcacgacccaagcccggccatgcctgggctgaggctagtcgggccggcatggcccgaccgacacaccgggccatgccgtgccagcccacgggcggcatacacggcccaatactactcgggccggcccgaaggcacaatggctcatcatgtttcctcatagaaaaagtctatttttggtccctcaactctgtgggttgtgtttaaatggctggaaagtaagtctattttatatacctcttgtcttgggccttgccttatacaattatttaagtctttgcatccctatattttttttatttgatcgggttgtgctaggccggccgccatgccgagggtgcagcccaggcacaacccggctgtcaggccatgccatgcttgggctgggccaaaattgcatgtttcgagccaggtcgtaggcctcgggccctatggccatctatacacacactcaaagtgggagagctgattagcgactgatcgcgcacggtcgtaggcgcgtggtcagtccagccccttaagtccctcctatatactactaacacattatcatcctctctttttatactactatactgtgtatagtatttatatacatatgtagtgtaaactttgtattacactatgtatagtgtgtatatacacatgtataaacatacgtatataagatatatatatatatatatatatatatatatatatatatatatatatatatatatatatataaactttgtatacatgcgtataaaaaaaaactttgtatacgtgcgtaaaaatatatacatatatataaactttatacacgacgtatacagactttgtatacgagagtatacaaactttgtatatgtatgtaaaaatatatacatgtatataaactttatacatgtacatatacaaacttggtatacgtgcgtatataaagtttgtatatgcgtttacaaactttgtacatgtctttatatacgtacgtaaaaatatatacatgtatgtatacaaactttgtacacgtgcatatacaaacttgctactaaaaaaccgaaaagggagagaaaaaaccgaacaaagacgaaagaaaccaacgtagaaaaacgagaaaaccggacaaaaaaaacagaagaacggcagaaactaacgaataaaacgagaaaaccggaaaaaaaaccaacgaaacgaacggaaaaaagggaaaaccggaaaaaaaccaatgctacctaactcctccgcgcgcaatccgccgtcccctctccgcgcgcgccacatggctagtcgtgcgggaaggaacgcgcgcgactagtcgcgtattagcgctttcgcactcaaaggctgtactagagtgcatctactatataatcgtttaagaaaatagaaaagaaaaacgatagaaggctcgattgcctctaaaaatgtacttcctccatcctaaaatataaaacttttttggtgtatgtgactatgaatctgaacaggaactcgtagttttaagataagttacatccatcttaaattccttatattttcagaacgaatgcagcataaaaaaaataaaaggctttggtcgaacttgtgtatgtcattatgtgcagtcgtacagagaggggtactgaccacaagtgctctgatgccagcaggggcaccggtaggattccatatatctctctcgatcatcggatgatctgaaggctgtgccgccggcggccgtgccggcgaggccagccgcccttgttccagcaagctgcacaggagatcggggccctccgccgccgcggccttctcctcctcctcctccttcttctcctcccccatggcgaattggcgattcgatcgacaatcaatacagctaaactagctatgcgcgttatgttgaggccgtgtgcacgtacgtacgtatatacgtgtaggtttcggatgcggcacgagcaaaagaaatcatgtcaggttcgagttagacaacttcccggggtgtttttctctggttgtcagctagctagctctacctctgctcatcttatatcagatagtgtgttggaatttccaggcgtcaggtaaagatggggtgaaaagggaaaaacacctgacagacattgtgatactacagtgcatagctagtgaatctcatatatagtatatactagtaaaaggtaatatatcccacagggtatgatgaccaattgaccaatcgggccgacaagtgctaatttgtaacacatgtcaggcaagaatctggacaggaaacacatgtcaggggctgtttggttgaagccctgagccaaaagagcctggcctgatatgtccctgagggatatcctgtgtcatttggttggtggcctgatggtttcattccctgcctgacctgaaaaacctgataggttcattagcctagctcaggccaccaaaaacgagcgcctggctcagtctagttacacaaaacaaaacgcgctaatcaagcttgtcctgtcacggacccacgactgtgcatgcaaaaggtgttggaatattttattgttgaatcttggttggtgcaaacgaaccgaaaatacaacatttgcttatatgcgatagattaggatatgagataccgttttatttaaataatatctaccttaaccatgtaattatgaaccatctaatctcaatttagtttcctcaggcttaggctactaaccaaacaacatttgctcaggctagcctcatcaggcaagttttgacaggatagctaatgcctcttaggcatgtagttttcttaggcacatcactcaggtagccaaccaaacaggcccaaatccacaggccaaacaggccaaattgctaacgtgagactatgcctcccggtcacggtcaacaccagtgtagcagcactgcaaattaagaatgccaaattaattattgcaaggactatatactgttaataacgcaagaacaggtaaccgatcgagcagtttatcgtacctttacccaaaagaatagatgtccaaatgaaactagaacaccaataagaccgaacactccttcccatgtcaaccccaatgacggcagcgctagagctggaactgaagctgaatgggtcggatcagcatgtacagccagtagatatatgccataaatcaccagcgctgagaatgtcatgtagagaatatgacccacatgccgactcaagctcttgcaaatcctctcaccgaacatgccacagggaaggcatacattacccagaccccaaacagatgcaaatgcggcgagcatccagccgtcataaccagccggcagaaaaggtcgggcaagaaacagaactgccaaagaggtgctgaggatgtagacgtagccgatttgccttttgttccaaatctcgtcgtccgcctgtgtatacacattaatatttatatagagagagagagttgtggattgttataataacggagcgttgcttaaggcacaaaactggaatgtatttttttcacaagacaaaaattactaaatttcttgaaatgaaaataacacacaaaaaaaaaggtgtagcagtactagagggggggtgaatggtagagaacaccaaaaacacaaaaactgagcctgagaacactgtgtttaaatctgctggcatcatgtcttctttgaatgcatcttcttcgaagtcaaatgttgtgaatgcaaaaccttctgttgatgcaaaatcattgatttcaaaaccatctacttcacaaacttgtcgtgagaagtacccttgttctttttgcggaaaagatggacatttg

SEQ ID NO: 68839 - DNA, 7721 bp, Oryza sativa
aaacgatcacgtttcgagccgtcggccatcgtcacagtgccctcctctgcagtggtagtgcatcctctctgttctccttcctcgctccatctcctccccttagactcgggtagtagcacgagtagaccccccgtagctagctgggccgccccaagccttgtcgccgctcgctgtgtgctcgtcgccgtcgccgcccgtgttcggtagccgcctctcgtcgccggcctctcccgtagcgtttccgatcaatccggcgcaaggaatggattcctgaggttccctagatgctctagcccctttgaatccaaccctagccgtctcgtcgccgtttccctcttctctcgccgccagttgcccccgccgcaatccaccgccgtcgatcatcccccggcgaatccgagccgttggctcgtcccctctcaacccgtgctacctcccggtgtgctcgctttcgcttgtatcgccgtggttcgccccgccgttcgcagccgccgtccgccgtccgtttcggccgatgccttcttcaacctcccgccggcctgcatggcagccacgtaggcaccacgtcggtgccacctcggccgcgaccgggtcaagctgaccccggtccgccgctcccctccgccccgctcgggcgcgtggtccaccgcgagccgtgaggctgcgcgtgggcctaccacattcgcacccaccgcgagccgcgcgcgtgcaccgcgtccctcccccaaaccctagcgcgccgccgcgtgctccctctgcacgatgaatcgtgtcaccgacaagcgggtcccactcggggccacgcgaggtgagcccggtccaccggctccctctctcctcccccgcgccctaatgggccgtgtcctctcgggctggccggcccatttagctcggccgagccgccctcttctctcgagccgcgccctagccgcccgagggaagtcaaatctccctccctccttcttttctttttcaaaagggtttaattaaatcctttttcctttagaccaaaaatccaataatcttagaaattcaataacttctcaaccgtacgtccgtttgactccgttcaacttccaaaaatcgtcaaatctcgagatctatctaatggcacacttagaggtcaataatagggctttattttcgccgtttgttgagttgtaccgtttcacgtgtagtttcggagcccgaagacccgcagtgcgaggatttcgaggatcaagctcaagatctcgagcaaggcaagtcacctttgatcatcttgcacctataatttaaatctaagtatttcttttctgcaaatattgcatgaataggattaacacgagtaattcggccacggcttgcgagatagcctgtcggccccaatcctaattgctgcaattaccctccttgaattattgaacacttaaacctcctttgtcaactgttgtgcttcgatgcacgggccttcggacacgcgcatcggaacacctcccctcaaatttaaaatatccaacggtgggtaaaacttggggttttacaaaagacttggaaaaaccctacacttgggtcggtgcttgcgaactaaaatgaatttccaaaaccgcggaccggggaacgtaccgggagtacgatttcccgctcttgcacttaaggaccgtttccttggaatttcattcaaacataaggcaagtgcgaccacatgggtagaatgggacacccctggctgagtaattagctaatcgggggaaccatgatgccaagagacatgtggattcaacggggtggtgccggggagaaccccccaggtttcctggcacagtatggtctgggacctaacctggtgttggtctaggacccctctcgttggcatatggtgaacctgtgtcggctgtcgaaatgccttgtcatgaaagtctcaaggtctccagacgtggccgttctgcacgggctgggtgatccgggttagtaatgtcgtgtgggtaaagtgtaccccctctgcagaggttattaaactgttcgaacaaccgtgcccacggtcatgggcggatgtgaggtgattcctagcgtagttttgtttgactactgcttgtgaaattactattgtggaatgagttcgatgtttggaaaatctgcggctgataggatcagccaggcccgggtggccgtttgaaagatgttggccgggtgccaaccttgaatcaaatcaaagactgatatattgcacatactccgaccggacgagacgcactgtctcatccgtgtcgttgagaagcactcacttagttgtttcaaaaaggagtttaaataaaatcaattgcaaagacaacagcctttcctttgaagcccgcattaaacacttaattcccatgacttgctgagtactcctgtactcacccttgctctatataaataatccccccagttgctgaagaagatgaagtagatcccgctgatgaggagttcttccaggagcaagtcgactacgatgagttttagggtttcggcctagttcccaagtcacgcctgtgatgattggtccaagtcttggcttccgctttcccttttgtaatgcagttgtgagctcgggatctgtccgcagcccaacatgaatgtactcctactctgtaataaagagacctctgttgttgtgatattctgtcttcctgtgataccagcactgtttcctaggactggtatcgattaacaggttaatttggagcgtcatgggctagtaccgttcggggctagttcggggcgtgacaattatatgaagttatagaagaatatattttgctattgagacttaacaattacacttgatataattgtgttttatgatgaattgttgactgctgaacttgagaattggacttgacaaaagtttgaagctcagtttgaggggtttctgtatttcgataaattttcgttaccgtatccgtgccagttcattttcgctccattttcggtttcgataatattcgttttcggggtttccgattccgattttggaataaatatgaaaacgaaaacgataaaggttgtttccgtccatttccgtaccattttcacccctaaatataacggtatccctgggagtatgtacgagcatgtgtgaagatcgacatgaaatcatgctaacatgtcctaggaatcgtgttgtgtagtacgaagaatcatatgatctgggcaacgacgtacatgatatccacatggactcggcgagtttcattcacttggtatccacatcaaacagagtctctttcgtagttcactctcgagtcgtgacttcgcaaagaatattatgcatgacgggaatcggatacggatgacgtaccatagttttgacaaaacatcttcaatttttaaatcgcgggcgagggcgatgcagtcccaagcgaacatgcggcaagggcaaatcacacgcgcgagggcgtcgcgggcccaatcgagcatgtggaaaaatcgcgtgcgcgaggacgttgcaggcctaattgcggcggcacgcaaatgcgcatgtggaaaacggactcaggcgcgggcctgattgctgcgtgcggcaaggggtgcgtgaaaatgtgcgggcccaattaattcgagcgtgtcttagataaggacactctagcgtaagaaaaagaaaagaatttgacagaaatataaaaatgaaaccaattcaaacatggatggcataccaaaattctagcggaaacatttttaatttttataatagtagagattatgagaaaatataaatatagaaagagtagagaagaattttatttttaaatcaccaagagaagagaatatggttgccattgtttttcgtcgcttttcatgctacgtttcttgagctgaggctgatctgacagcaaaatacatgcaagaaattatttatttggttagcttcttgtgcacttatttgttcttcaccttcttgagatcttttaggagctctgcactctaaaccaaaattttggttagcttcttatggggttatttgttcgttcttcaccaattgagatcttttaggagctctgcactctaaaccaaaattgcgctaaacttcactgcattttcatatgctgtttgttgacttcatcccttatgttgatactgatatagttctgcagaaggtactgaaagtagaatttgtttctacctgaatctctggatggatgggaaattttgtgtttttgtattgatatgattatgtcagtatcaaatcaggatttctcaagatataatatatccatctaaaatgtgttagtctaacaagatcgatgttgagggccgaaagtcactgagatcagtgcatgtactaaaactcttggctgtttgtgcaagggagagagcaatctagcatatctcggagacgaccgcacaggttacagtgggatcgcgctattgcgaattggtacacgaggggtgattatagacgaataacaccacaacgcaaaaatagcatatgacggatgaaggaacgaacaaatacgacaccgatcaagatgtgatggagacggatgccataaacgttatgaatcttttaagtaggtaaagatttggggaacttaaattaacaagtgtatgcaatttattgtcataaagttttttgagtcgtaaaaggacatatatgtattctataaactcgtttatttatgagtaaagtgaaaggtcggtccctaaacttgttagcctttctagatttccataattttaaaatgcagatttaggtcacaaaatttaaagtatgtcattttggttaggtctgtaaaaagctcgaggcttgcgagctactcgagctcgacttgtcctaggctcgattcgagcttaacaatatatgtgtttttttaatcttttatataataggttagttgggtccatgccgatataaatctcatcgttttgaaatctaccaatactattcgcataatgagaaccatgtctcaaaaaaacatccaaaatcagatccatgccacccgcctgatacgtgtgaaacacattttgaggccctcacagatcttgacgagcgcggtaaagcaaatcgggcgagtcaggcgacgagcttgatcgaccacaccgagatcatcatcaagggcgtcaacatctacagcaccttcggcaccgtccattgcgatgtctatgaaagccacgccgccctccatgtctatgaagtcgatggccgagcagatccacgctgcccttcgtcctccaccaccaagatcttggcctcttcccacatcagtccggggagttgtggccaagcccattggaagacaaccacccgtgctccccctcgccatcttcctctctttgccatccgaagcctctctagctcgcctcgccacgctgtcatcgccttgtggagctcagcctccccgaccacaccggtgagcttgcatcctccgccacgtcgtgccatacccagccccacaatggagaggcggtgatggccttttcaccaagagcccaagagagagagaaagaggggagtgaaggaaggataattacatgtgggccctattaattttaatgttttatctctgagcttgcatgtggatcccacctatatttaaagtttaagttttattttcttcattatggaatgtcatgtaagcaccacatatgcaacataccatattaaaaaaaaactactcgtttcatattataagtcgttttgactttttaatgtttgtctaactttatagaaaaatatatcaatatttttaacacaaaacaaacatattatcaaaatatattcaatgaagctaatttggtgttgtataagttgctgaaattttttttataactttggtcaaaaacaacttataatatgaaatagagggagtaagagacatacacgctctcgcgccgctctcatgcaggtggctcaggagcgaaaccctagccgccagcgccaccccctcccaacgcctccagctgcctcgccgtcgccggaaaccgtgcggctggccgggaaggcggcggtggggaaaacgcgccagcggcggagcatcccctcggcgtgggaggcagcgtgacgcacgcaaggtggaaggcggcggccagagcggccggcggggcggatccggcctccccggtggaggatctggccccctggcggccagatcgggagaagtgcagcggcggcgctccgagacggaggacggcctcgagctcgcgccgatggtggcgcggcaagacggcgggcggcctcacgctcgcggtgacggcggcgggacctcgagcttgcggcagcggcggcgcgcctcggtgggacagctcgcgacggcagcggccacgacggcacggcatcacggctcggaggagcagctcggccggcacgcagcgaaggctgaccggctggacggcaattggcgatgatggcgcggacgtgcctgccgtggtgctcgtggcagttggcggcggcgtcagctgacaacagcggcggaggacatggcggcggcgtcgggctggctgcttggtggtggagggcgacggtgcagcggtttgcggaggcggaggctagcgtcggtggcagcggcgactgcggccgtggctgtggaggcggtggcgatgccggcggatgcgggttgctagcgacaacaactggaggcggggaaggagtcgggtgcgagatgaggatggcggtggcgaggtgaccgtgtctgggtcagcggaggcatggcggactcggatggctagccgagggcgtggcagacgactgcttctggccggcgcgacatcgtttggtggaggggtcggagaccagcttggcgcagagaggcgcagccgatggcagcggaggccagctcagcgcgagaggctcaggcggcgaagatagaggccggcttggtgcgagaggcgtggccgatggaggaagaccggaatggcacgagaggcgcgtccggtggaggaggccagcttggcgcgagaggcgcggccaacggtggaggaggcgacctaggtgtgaggaggagttgccggtgggtgtggcgcagtcttcggcgcacgaaggctagccggcgggggacgccggtgtaggggttccacatgtcagcggagcttgtgtggtggtagagcatcggtgcgtcagccgtggattcgcaggtggtgagcggcgggtgaaaatctagtctggcctcggccggaccgacaacgattccccttcctgagggcgttgtcgtgctgtctcacccctcaagggtggttgccgggcaaaagcccagtcttggctcctttgagccccgacggacggcggcggcggtttttcggtcgcttgtcttcttgaagacatcgtttggcatcccctaggggagcgatctcgtctgtgtccctttgttggtttagtggcggtcggttacgcttagcggcggtcggtccggtgccagccttctcctgggcttgtgtgttggcgatgtcggtgtgtggttggtggaatttttttcctttttcctggttacgaccctccaaggttgtaatcttgtatttttttttcttgcgctatcaacagaacttcgtatcgtcttgtgcgagtcgttcaaaaaaaatagagggagtagattaaagtgacacatagaacgaaaccactatcaaaaacatcgagggagtaaaatgtatctctttttttttaacggttgagggagcctttacctttacccaattttacaccctgttttgcagtggagggacacgaatcaaacgtgcctatagtcgagggagtctagatggactttttccta

SEQ ID NO: 68840 - DNA, 15550 bp, Oryza sativa
cggtgtgggccgtggaggagttgctcgtacctgctcttccgtggaggagttccgcggaggaggaggaggccgccacgcggtacctgctcctccgcagcgcctacggccggtacctcggcgccaccgacgcggcccccggcgaggccgcccgcaacgccaccgcccgcgccgccgccgccagctctgacgtccgccaaccacacgaccgcgagggttgctgcggctgctgctgctgctgctgccgactccccttcggcttggtcgaggccacgcagcgcgaccgcgatgaggaggagccggaggtcgacgccatcatgtggctggcaaccaggtgcggcgaccaagacgtacaagaggatcgcgacgcccgcggcgtcgtccttctgcgcgacaggtccgggcgctacctgcgctgcaacaagagtatcctggcttgccgccgcagcatctcagtcgacgccaacttcgaggacgaagatacgttgctgtgggaggtggtgcgcgtccccccgagtgaagacatgccggagctcccgatcgccactcaggtgagcttctccgatccttttcccctctcttcttgcgattcttgtttttttgttttgtgtcttgatgctgatttcgtcggagattaatcttgatttcttgcaagaactaaccgtgcagtacaatttgtggattgatcgaatttctttctgctaccattgttgattttgcgcacccgggttcttcgtcagggtgtgcttcccccagccgctgcgggagatccagttcgtggacgaagccgacctcgacaacatcagcgagggagaaaactgggctacggttcagatcagagggaggtcggtgaggctcctgagagagaagatcgcggagcttgtgggctacgacgacttcacgatgtgcgtcagcgccggccgccatgggcagttcacccctctgctcatcgacctgcctcgccgccgggagaccctgcagatcgtccttgtcaggcccaacaccgatgtaagcagcctagttaaatatgaatgttgctgaattttctgaacaatgtttatgtggttctgaattttgctgtgaattctagtaacggatggcatggaatgggcaatgtctctgtttttttgatttttttttgtgtcagatcagcactgtagattttctagctttcagtagtttgtgcgctgtttggaatttcctgaaaatgcagtgatgatgtatttgcagaacttatctttcagtagagttaggatttgtctgaagaatactgtagaacagcagaactgcagaagtgaaatatatctgcacttatctgatgaatattcattccaatcatcatcagacaattgtgtgcaccttgggtttaactgaatgctgtaggattcatctgaatgttgtagatttttcggtgtgaaattcagcattcgagtagcattttaacatgtgaattactggcactgtttttacttacaagagctgtaattcttgtgtattactctttctaactgcgtgatttgtttgctatggctgcagcgtatgatcagttgatattcccgaatccgaatgcattgccgtcagccgaggccacagatgaagacgatcccacgattgagtgaatccttttgtgctcaagttctgacaggctcagggaactcgacagaagattagtgtgttggtatagagtggaattttcagttcagccgatgctggaatgcagttttacgttctctcagctgtagaatggctgaaaaacctcaaattgtctgtgtgttcagtgggtgtttttcgacggtttacgtactttgaaaccggtaaaacagggctttctgacgaaaatattggttttggtgacagttagtattcatgcctagtattgattgatgacaagaatgtgcttaatcctgcaatatattgctattcatgctagacttggttacaaatatgcatagcgtgtctgaattctgatgagtggttccagtagctgaatgtctgaatctcctgtagcattcaggtttgttctagtctatgtattttggaattttgataggttccggtttgcaaatgctacatgctagtatctgctggttctaaacttactgattaccctaaaccaattgttggatccagaagtaaagtacacaggattaagactatgtctgatgccctgaagcattcagggtttgtcccagtccttgtaagagtaattaggaattttagaaaacttatttttgtaaatagtcccttccactcttgtaataggtttttagttctatttataaaataagttttctacaaggtctaaatgtaaaaacaacttcagatatgcttccacatcaggaagtggatttttgtccctcgagaagacatcccatcgttttgtgtatggtgttcaaaaagttatcaaaaaatttgaaaacaattgtcaaaaaaatcaatatatgatatatcttttcacaaacatacaagttaaaatttgacttatacaattcgaaacaaaaataaaaaatttgaccgtgaattactcattctagtcatagtcaaatttattaccttttacagtgtttgcattcctaaaatggcatagatctaaccgctcacgatgaaaggtatcagaggtagaaaggtactaaggattaaaaggtaattgataacagggcaattatgtctaacaacgtatggacgtaccgaaaggtacggtgtaagtggatttgaaggtaccacaaggtaccgcgtaagtagtttttaaaggtaacgtaaaatatgatttatgtggtgggacaaaaattacattctcttctattcggtttccaatcttcggtcgttctgtttgcgtcggttttcaaactttggtccgatttacgtggtacatatcatattcgcatgatcttgataattatttccagttagtcattaatttacatagcaatttggtgaccatcgtttgatgaatgtaatcaaagatcgaaaggacaacaaattgagaagatttacgcacctaacaagaacaaaacaagttcaatgaggaagatttgcgaaaaaaaaactaaacaaatcgtctgacagatcgggaccgtgcggccacttctagctccggcgaacataggtagtcctggaccacttcctcccggtcctcttcctccgccgcccctccctccaaccaccgcctccggccacacgtccaccgccggccctcaattctccacctttcaacttatcgaagaacacgtaaaccttacgtatgaacagaacgtatctaagaacgatgcaacgcaacaggctacaagctaattccttcgataccttctcataccttttcatatgtgtaaaagacacatttgtcattctaatatcatcatatttatattaatgccacctattacaatattttctttccataccttgcccctcgcagatcatcggctcacgtcgccccacctcctttacctcgcaaacatcgtataaattgaatttgaatatgcatgtttgtgaagtgacatatcacatattgatctatcatactttttttaaggaaattttttgatgactttttaagtgacatgtaaaaacggggcatatccaaatagagtttcccttccacatcactgtcctttgtaaaggtgataagctcacccaaggatgctcaaattacatccagcacatccatggccatctcaaacgcaatgaaatttctgcgggttgggattaagttcaagttctttaatctcaacctgccgaaatttattttctttgcaattacccatttgagtaaatttaaagcagcaaataatcatgtttcaagcaaagtgagtgtttttcttgtgcggtaactgaagcctcaatttggtggcggagacctggtggccttctgcgtgctctcaacacagcttatttcgattgcttatccgccaaaaatggtggagcttgaacgaaaaattggagaggaccaatatgatagtttcatttaaaataggaatattatgctttgtttaaaacttgagcatagagagtcaacaaattcagtgtaacttttctaagactgaggagacatgattaaggttagcttctactcctatcgtcccaaaacaaaacttaatgtaagaggagatatgacccctcctaatacaatgaatgtgagaccctgtttagatgggactaaaacttttaagtccctatcacatcagatgtttggacattaattaaaaatattaaacgtagactattaataaaacccattcataatattggactaattcacgagacgaatctattgagtctaattaatccatgattagcttatgtgatgctacagtaaacattctctaattatggattaattaggcttaaaaaatttgtctcgcaaattagctttcatttatttaattagttttgtaagtagcctatatttaatactctaaattagtgtctaaatacatagactaaagttaagtccctggatccaaacaccacctgaataaccctttatccagattcgttatattaggaagggtcacattctctcattggttgagtagagtgatcaaagaaacaccatccggactgtgtattagattggtgctactaatgatgaaacaaaagatatagtattgggtaattttaacatcctcgaaaaagtaccgggaattaccatattttctagtataaaattaatttggtacctctagatactaaatatctcgagataaaaaaaatagtataaaatttagatacctcgagatactttttcaagtacgataaaatttctctatagtattactttgataacgtgctacatcgaaacaaatgctacagtgcccaaaaataaaaaaaacatatgcatgaagccaaacagttgatgaaatatggggatagctaactttgaattcagggattgcagaagtgtaataaatgacctaataatcctggataattaagaacttaaatctagctcgttaattaattatgctttctccttttggcacaaggcacatcatcatctgcaggcgcgtgaccctccccgtcctcttgaccctcctcctcgtcctcgtcctcgtcgtcgtcgttgtcctcctcctcctcctcgtccggtatcgctaacgccggcggcgtcgacggctgcgccggcggctggtggaagggctcgggctggagggcgacgtcgtcggctggggctgggcttgacgttgccggatggtgttggcgagcgcgctcggccttgaggcggtcgagctgctgctggagcttgagaatccggccgtaggcgccaaggatggggtcctcgaccctcgcgtcggcgaggtagacgacggccgccatgctaatcacggtggagccgttgggccggatcccctgcttctccgcctccgagaagccgaggatcctctccatgccgaacatgaggcgcgcgtaccagaagcgcttcggcttgtcggccggggggggggggggggcgcagttcggcgggcagctgcttgccccgtggtgtgcgcacgcggcgcacgcctgttgggtcgtcgtcgtcgtcggcgacggcggcggctccgccattgattaattcttcgtcagcgagggggtcaagaactcgatgaaatttcggcggcgtggcgtggcgtggcgaggcgaggctagtgtggtcggctcgcttcgggcaccgaagcaaaaatatagatatagtgcgagagtctgtgtagtgcacgtactgagcccgattcgaattcactgttaacctcttgtgttggtgggttaattcgtctccatctcaaattacatattcaactgcctctggattatgtgccccaaaacgcgaatattaccactgtaatttcctgctcacatcggcggtttcaactgcggttaaggatgaaaaagttaaaacggaaagtaagcagtcctccacagtaactatcaggtttcgtttcactcccaccgttcgatcatccaccatcttccttcggtagttaactgttcttaataactcattaactagctagtccagttaattctggagaatcgttccattggagcaagcttcaattctgaaactcctagactctgaatcagacctctaaaactctgaagattcagagaacatctgaacttgttctgctcgctggaaacgaaacgaatctgctcaaaggagttaatcttgcgagaatgcgagtcgttgcgcatctgagagcaacataaaactatattcagcatcggcagaaaaatctactctctgtcgctaatcgaccaacgaaacttgtgtcaagtaccaacaaaacaagttcagcacaaaaggattcacggagtctgtctctaataagctgacgaaccttctgtcgacggtcctgtcaagtacccataaacatctggggaaagtttcaggtggaaccccctctttcagtgaaaccatggaacctcaactgagggtgtgtttagatccaaagttttcatccaaacttcctacttttcccatcacatcaacctgtcatacacacacaacttttcagtcatagcagagaaacgacacagttagactcaggcagtgtggtacaatcataaaagcaatagtattcttgagagtaaaaactgggcaagtaattctgcaaattaaagatgctgaatttcacactaaacactggcatgatcattttcataacaaattgaaattaacattcataacatatacaaaaaatattttcctcaaatgaaaatatacagaaaataaagcattgaaggtgtatgagaccattcatttcaggtatactggagacaatgtcaacacatcatttcagctacaattctgtttgtgtacaatattcagataaatcctactcacagagggtattcccaaagtgcatacaattttgtcctgatgagtcctaaacttgtgttgttctacatgcattctcatcaacagaaaattcctcagatgagtcctaaactcaagtcaacagtatatttcgcttgtgttctacaatattcttcagactagtcctaactcaagaatcaaatgcaggattgcatttttcaaaaaattccacaacaagcacaaacaatctacagcgatgcactaacaaacaattacccgcataattgttcaacaattactagcgatgcgttcctttgacagcaaaattcagaatctacagtcatgcactaacgaaaagaacctggagaacggaaacactgccagcatgctaggctgcttaactctggtgttcagaaccacattaacagtgttcagaaaattcagaaagagatcgaactaggctgcttacctgcggtgttggacttgacaaggacgacgtgcagggtctcccagctgcgaggcaggtactcaagtctctgacccatcagcatcaagaattgccacaattagaactcaaatcgatataatctttggcgcaaacgagttcaagaatcgcaagaagagaggggacgaggaggaggagctcacatggcccatggccgggatgtctcgcctgaagagagttgtggggacgggaagcacctcccactgcatcgggatgttgaggtcgccgtcgttgaaggccgcgacgccggcgaggcacgggagccacctctcgttgacgcgcaggtagcgcgcggtcgtacttgtcgtgcagcaggacgacgccgtcgccagccgccggcgcccagcccgacggcacgccacatgatggcgtcgacctcacctcctccctgtcgaagtcgcgctgcccggcggcgggccagaagcagaagggcgcgcccagaagtggctgatggcgtcgggggcaccgagatagcggccgtaggcgccgcggaggagcacgtggcccgggaggaggacgccgtcgccgccctcggcctcggcgttgatcgtcttcgctggcgaggaggtacctgccgacgctgccgtccacccgcgaccgaagccggacggactccacgtcctggaatacctccattgctcccgccgccccgccggtggtcgcctcgcgcgcgcgggcgctcgcgtcaccaagcgggctcctctcctctcatcggcgacggcgaggcgtgggcgcgtggcgtgcggaggaagacgagaggaggagtttgttagcgacggttagagctgggacatgggccgttccgggctaggcacggcccagcgtgcttcgtgccaaatcgggccgtgccagcacggcgtcttcatggacgccgcccaagcacggcccaatggcccgatgggcctattcgtgccgggccggcacaagcacggcgcctgatggatggatgagaaaagcccatcgggccattatcgtgccatggaccatcgggccgtttacgtgccgtgccgcccgtcgtgcccgttgtccaggcccaggcacggcccacgtacgggctgtgccggaccgtgctttctagcgtgccgggccgtcgtgccttgggccggcctgataaagcacggcccaagtcccagttctagcgacgggtgcgacggggaggtgggcatttgaagcgtcgcgaagcacagcacagggctctgtctgtctgtgcaggtgggcccagaaacggtcaagtctggtcaactgcgtaactgacaggtgggccaccccacaactagccatagttcggagtggatgacgagtgcgcgcgctgacgagccgccgcggccgccacgacgacgagttcgtcgccttcgaggccggccgccgctcgacggcttcctccaccgcgcggcacggaggcgccgccacgctcgcgcgccccggcttccctgcgctacgcctccgccacggctgcatcggccaggtcgcgctccgcctccgccacggcctctcctgatctggccgcatcggccagatcaggaaggggctcgacgagatctcccccaactatgccgcctacgacatcgccggcctgggatgcccgtgctccctcttcctcctccgccaccattctcgccgtcaggtacgctctcgaactactcatcgttgtcggggaacagggcgatcgaggagggtggggtggaggtgggctgagtgcgcggcggaagccgtcggggtcggatgcggcggagatagacgagcgcggatcggacggatgcaggtggggaaggagcggcggcggaggaggattgaggtaggagttcgtcgcccggccgccggccagcttgatctgacgaccagcggcaatcccaaaaatttgacgaacctgattttttttcaaatacacccctggtttggattgctgtcattggaagcgacttggaatttctcaaaattgctcgaatgaggcgcagattcagggttggattttagtgaactctacaaaattcatacaacaaagtttgaacgaacggaaaagggagtgtccaattctttcaaagtgaatttacagaaggattttgatggccgccatgggtgctcgatccatcggtgcttcgccagctgtgcgaggaagaagacgacgacgaagactagtaggacatggatgcatcggctacgtgtcgagctcgaggggatcaggggacgatgaggcagaggccgtcttcttggtcgccgtcgtcttcctccggaacggccggcacgccttgacgctgaggtcgacggcggcggcgagcgccacgaacatggcggcgtcctccatgcacgtgacgtggcgcatggcgagctgcacgagcggcctgctgctccgggactccccctccacgcggcagctcatcacgaacccgccgccggcgcacgcctcgcccaggctcgccgcgcagtgctccgccccggcggccagcgccggcgcctgcctgtccatgtcgatggcgaactccccgcccctgtcgctgcggagcggcgtctcggccaccagcatgcacgcgtcctggccgtcggggaggagccgcagccggaggcacaccgtgtcctgcctcgccgcgccgccctgatcccgccacgcctccagccgcccccacggctgccagctctccaccgccgccgacgacgacgtcgaccccggcgccgtcgcgccggcgcgcgcgatcagccacgcgccagggttggaccgcgccaccgtgtcgcagccgctcgccgccacgaacggcgtcgccatgaacgccgcggcgacggcggagccggacaggtcatggatcaccaccttccaccccttcctctccctcctcctcatcatctccgcctccttctcctcgccgccggagctcgaccagtacagctgatccgaatgtgatccactgccaaccaaacaagaacaacatcaacgacatgatcaccaagacgagcacgacggcgtcaatggcgtcctctcaccgtctgtcgcggatgaacttgcagctgaagatgggctgccggttgcggccatggagctggacaacctgcggattcagcgcgacctcgtcgtcgaactcaaagatgtaccggggatcagcctccatcttcaccctcaagtgcagctccggcttggcctcaccgttgccaatgccaacccagccatggtgaagcatcaccggcttgccgtcgcgccactcaggcccaatgtccatcctgaccaccccaaccagcctcttcatcccggtgacaatgccacaatgcccgccacgccggccaacgtacaccgcgacctcgaggtaagacccatgagctccgaaacaccccggtgccgacagcgccttcagttcagattcgtcgagggagaagacggcggcattggtgtgtggatcaaggttgaactctgaataattgatcagagggacaggagctatctggacagggaatcctcggagccggatctcgcagtggaagctccgggccgccttcctcgcattcgcaccggggagtttcagaccaagctgtccaactgaaagtctgacaaaaatctggggatccattcttcgtgtcactgaagattagctacttccatggcacatgctgaaaaattcacaaatcattgaagtcagatataatttgatgtaacaatcaattgtaggaaaagaaatgaattctgcaaattagcactaggtgtgcagctgatcttaaaattcttccaatagtagtgtatggtatgacagtatatgctccaagtgatatggaactatgaaaaagactacatagtagcaaatccagaaagaaatgcatagagcatgtttcagtatcagctatgtgctataggaatggcacatgaaaagtagcaacattgctgttgcatgaagatatcactttcagattccattcaaaaaattacatcacttttacccttgtaggtatgaccaaattctacagaaagtaaaagcctaactccgtagccagattcagctcatcacttcaaaatcataggcttaaagcgccagatagaagctgattgcattagattagaccatagccaaattcagctcatcacttcaaaattacagatcacaggcacaatttctccatctgtaaccaagttttattaggtccacctaatctaaggtttaagatcagccaaaaaaaaacttaaaagtaaaagaactaattatttaggaaataaaaatgatttacttagtaagttagctgttttttttttctcaactcaaagtagattttgccagcatttggaattagcattcagacatgtctttaatcgtgattttgatctaatagaaggtacagttcaccttaaacattccccactaaaaaaagaacacgcaactgacgcctagatgcttgcctttcccccattttttttgtgaaacctttgggatccttgacaaaatttaaagaaagatgaatgttgatcaagtagcatattcttcccctttgacaatccctagtgcaagcactaaaaaaggcaagcattgctaatgccactcaacacctcttagcttaaacaactgaaagggagaagaaaggaagaaagaaaaagaggcatctggtgctttgcaatcatgccattgagtggttatcaatggcaattgccaatgccattagcatgccacctctgttcaaagctcctctcatcagtcaggcactgacagtgtcactgcaactgcaaaaaaaaaaaaaaaaggcttgtgcaaccaaagaaaagcatccaagaagagcagcatcaatggcgcggcgcgacataagctagcccgtgtgtcgcgaaaaggggcggcggccatggcagcaatggtggtgcatgggtgaggtagcccaggatcagaattctccctttgctcccatttctttaaccctccaagcaaagcttcctcctctgtcgtatgatcagcgtgcaaagtggagattccaaaccttcctctccaccaacaagtcctcctccggcgcaggcacgccacgccacgccacggcgtggacaaggccgagcacataaggcggccgccgccgcagccgcagccgcagccgcagccgcagcaaaagcttcgctgcatctcacaatgttaagcgcggcgaacggcggcggcgtccaccatgatcaccggggtgattacccccccgaccagcggtacggcaacggcggcgaggaggccagacaacagcagccttcgtggcagccgccgcgggaccaggtgacgcaccacccgcgggggcggagggcgcaccggtcgggcccgctggagtggacggcggcggtggtgttcacggtgctcgccgtggtggtgctcgtcgcggcggtggccgtgctggtggtggtgctgctgctgcagccgcgggcgccgtacctcgccatccggtcggcgcggctcgacgacctcgtctacgaccagcaaggggcgctggaggcggcgctgtcgctgggcgtcgccgccgagaacggcaacgcgaggtcgggcgccaccttctccgacttcgagctccgcctcgtgttccaccgcgtggtcatcgccatccttcgcgccgacccgttcgacgtcccgcccaaggggtcgctgccgctgggctacgtggtgcgctcgtcggggatcccgctggacagctccggcatggccgccatggaggcggcgctcgccgacggcgtcgtgccgttcaccgtgtccggccaggcgagcacgcggtggaaggtgggtggcctcgtcccgttcaagtactggacgcgcctacgctgcgacctccgattcttctggcccaatggcaccgccgtcgacctcagctgcagctccaagcccaaatccaagagcagctagctagctaaccatcaaaagaaaagatacttcatctttcttgctccaatccaagttctccatggatttctgatgtgatcaagattcaagaacatgccactgcctttcttggattaattcttcctttcatccttcctttcttcgttgattcagttcatgtatagattggtcaagaaaatgacaactacacccccaatttgtacaattaattagattgtgtaattgatttgaggtgtgcagattaagatcatagtaggtcctaattaaggggaaagaaagggtagtggaaacagtctggcatggtaaagtaaaaactgattaggaaaagatgtagtcttgttgcaagattgaacaagaccagtgacttcttttcttgcaagctttgttgcttggaggaaacaaattccatggaggggaggaggaaaggggcaaaaggataaaaagagaacaccatgaaaagaagcaaagctactcctatgtaggaaggaaatgtgcttttggtaatggagattgtggccctagcgccatgcatgtgcttcttctcctcctttccatcccttgatccttgtcatgttctttcgcttgcttttgtttcaaggattatctagaagaataagtgaataataaccagtctcagatcccaagaatctccaactcatccattattcaaccacttctctctgaccggatacatctttgatgtagaagttggattgattaattatccttatcggaataaaaatcctctcaaccactctcaagctcaaacaacacactaggaagctaccaatacatttctatgtaaacaaaaaaaaaaaactaccaatacatatacatacatcaacatcatgcagtatatactatagtagattagtaccaatagtaaacccctaaaattgaacaaaagcaataggcaaaaagaattgaaattgagttgaatttggatttcggaccatacctgtcaaaattggttggtttcttggcagaactcagcaacggagaagaagtgaagaacacctaggagaaggaagaagaagaagcagcagcaacaggcaggacaccactagagctcagccaagagacaggcgacagatgctccgattctagacgacgacgacgagctcaccggaatccatcccgccggcgacgacgacccgccctgcgtgatgacctcgccgccgccgaacccgaattccatgatcgattttcagaggccgaatcaatcgcaggtggagaagaagaagaagaacaagagcaagaaccagaagaatacagctgctgctactgttagctactatagcttagctatgcaggagagagtgggaagagagagagagagagagagagaggaagacgacgacgactttatacgccgcggccgctgcccaatgcgattgctcctaccacgcggcaacaaagagaaagtcattagtttaatttagtaactaactataaccatagtaaaagaaattaccactactcactgattcgagcatggataacagtaaagctaaaactaactggtgtggaaaaaaggagaaaaaaaaatgagaggtgttagctctcatataacaattagttctacacgtgttccaatatatttacattaaatccatagtgaaaaaaaaagagagttgagaaaaaaatagagttaattttagagttaatttattactccatccatctaactttaatagtcatatttcatcttgacacatagaccaaggataaacaattctacttatcatccattactagtcattcctcgtaaacaagcgattcattaatatttacatttctcgatgcccatgtagccaatcttgtgtgaaagaatggagagtcacgcattaaatccgaaaaagtcattaagatgataggttgttggcttgaaatatgcctatcaaaaataaatttttcagatttggaaatatgactaccaaaagtagattagatggagggagtatatatgtaaactctaatataaattaatagtcaatagctttactattaaacttgttgttaggaattgagctgattgaataagcaagcaaaggttatgtgccgtgctgttgctgctgctggtgctggtattagaaggggaattaagtgagtagcagtggagctgtgtgcgcgagtaagctaagcgcgcgtgattagactggtaattgcgtgattagactgctagtgacgccgtggtgggggggtacgtacgtccgcgtgatgggcttatgatgcgttaatgatagaagaaggggggattagataggaggagtataatgccggcgccagctggagtccaaagcggcaacttgcgacttcgctttcctgacagccaggcatggacagcaaccctctccaccgctcatctcaaattcccgttttgcccccactattttcttctgttttttttttctcatctcattgctatgg

SEQ ID NO: 68841 - DNA, 26134 bp, Oryza sativa
ctggtttccttgtgtgctaaaattttttcaattcacttgcccatgttccagactaactgactgacccataatttgtagcacttttttttagatatcggattaaaccggcctctggcacacagccaaataatttatagctaaaattattgggttattgttctactaaactgatttttggctagctattttgaagcttaatttgaagcctaacttaatttgaagattgtgaggatgactaaaaccaagaggcttggagggaatcttctacttgtttaaagttgtcgagtcgagtagatgaccaattacaatgtagaagagatgggcaattttctgaaggaaaacctttgcatgctatctggtcttagtcttatggcttactggccctctattcagtagtacactattagctaaaaattacaaaccacgaagatgattgtattgtttgactacattttcatgctgaattaaatttagtgcaatgatcaagttgtggctggtacctctagctagctttatcgctagtttttgggtaagtcaagatttaggtagcaatggtttgtcgctttttatgatacttttcttaagctgagtctgacaacaaaatacagataagaaattattactttgtttagctctttgtgcaaaatctgctgaacttcactgcatttacatcagctgtttgttgactttgatttgtgttgatatcctgcagaagttgctcaaagaggactggcaattggcacctgaatctccagatggatgtgaaatttggtaatgtctatatcaaaccgtgactcctcgagtctatcgtattagcataaaaatatatatatgtagagtatatatatcttgtctgggatgctaattgagatcgatgttgagaaccatgtataatcaatcattataaaaatatatgtatgtgctgttgaatgtattttgccaaggcagagtgagcctgagacgtaaaactagacagccacgaaaactgttatcaaacaaacgggagtgaattctaatattccctcgtataccttttttttctaaattcaatgcaaatagttgtgaaaaattctgaaaaaaattgacaatgtacagtataatgatacctactagtccaccaaaattcaagttcaaatttaatctacacatcgagaaacaaaaaagacaattttagatataaacagtacgctactattcgtacgcttaatttgtcttttttatatctcgacgtgtgagttgattttggatttaagattttgtggagttgtatatatgtgttgtatgaatgttgtcaaatttttccagaatttttcgtagccgtttaaatagtttttaagcaaacgaggaaacatcccctcgagggattagaatagtttccctcaaacatttcacaagataccactactggtgcagttagcccattttggtgcctgtaggcagtagtaaaaatccttcggatgcccatatatcttcttccctgtcattttttcatttgcgcaattcaactacttgtaacaatcagaaacaggttccctcttaccctcctggttttacccatgctcacaaagcttcattaactagcagacaacacgggatagaaatcacctgaactatttcaggcctaattaagcggaatacatgacactggtccatgaattgaactattttgggactatacagattgggggctccggaggcaggttgttgatcctagcgtagtttcttcaccagctcatgctgtctgcaatcaacagcctagtagccgcgaaagtctttctagcacctaggtgctgcggcacctagactagaaatcacacgatggtttaaagattcgtgcgtcagatagtatacggagatgttaggatcgtatttcttttttttgagcgcacgctcgaaatacagcgctggcccaccagaagattcatatgggagggggggaccaatacgtgtgtacgacgcctcctattctcgtccacataatgttcgatacatccccagagtcatcgggaccgaatcgccacccgccgccgccgctgttcgccggccgccggccgccgccagccggccgcatccctgttgcatgttcctttggcggaagcggtgctccatccagtctcaccgagcctccggccgaggacttccatcaggtatgctctaggaatcccctcttccccaacccccgctgcccccatcccccgtcccctcctccatatcaccctcgttgagtcatcgtcctggactccgacgagcttccatcgccgcacatggaggccctgttggctgcggcggctgcgtgaagcctcccgtatcaagagttgcctccgctcacagacaccggcgagctatcacgggccagcaaacaagttataccgccccattcgccattcttgagcttcttgaagtgcagtttttcatccatgccgtgagcggacgccggcgagccgagacaaagaaacagcacgtgcttcgtgagcggacaccggcgagacgacacgagctgagccgaggcaacaatacgttaaggtcagcaaaacaatcgatgttttcttctcccctgccgcacaagcacgcattctttcgtcgccgccgccacagaataactccagggctttcaattcttcttagcaaacggcgaacgattttgtccatggttgttttttttccctacatttttctggaggaaagaaagaaaccacaccaaatctttttttttcacattttgatctactgaaaatgatttttcaatttcttttgcatgttttatattctcattacatgttttgtggggagattggcaggtctttgagaagagtggtttacaccaacggatccatgcaactgtgctagcagaagctgagtagcccataggccatggcggcgacgaagactgttttttttttttgtcatggaaaaactcacaccccttttctattcttttttataaaaattaatgattataattaagaccaaaagagccaatttttgggatgaggaaaattggttcaaacttaaaggaggtcttgttttatctgagctctgggcttcgcggagtacatctgtacctgctttctctgctagcaaaggaggatagcaagatgaagttggtagaggagacttcaaaccaaatacctcttgcttctttttggatgtaacttcatctaagttttccgatatttttcctctctcgaatacttttaatagcaagaatgtatagaaaagctgaataagatacaaaaatttggggacactatggacacactgcagaaagttgcaaactttgtcatttgactagcttttgttcaggtaggaggaactaggatgtactgatgattgaacaagcagctgcaatagctactccaatggtatgggatgttaagctcgaccatttgaggtgtcagcctagcatgttttttttgtaaagtgtattggcacactatggctgttgtatagtatgcacttatctgaaaaagtgacatttttggagtacattagaacaacaatggggcagcgcacagatgtaagctgttcgaaattcacaatcttacgtttcatggattaatgtcaatgttccagtgccaatcttttttgtggcagtggatgttggaattttagtctttctttattacaagcgattgatgttgtctggggtaaacaatagtatgaagaaaaagtccaatgatccgatctttgctttgatcaattacacacggaagaagatggatccaataactgaccaataaatagtctgtttgctcatctagttaaagcaaacaaaaagaatccaaatacaaacagataatagaacacctctgttatctctcaaccgatcatgaacagaagatctctctccttctccctccctctctctgtcgtctctctctctcccccggtcccccctctcttaggcttttggcagatcatgaacagagaagaagcacttgcattggcaaagcgaatcagaaagaaatcatggaaattacatgtgctccacttctatgttggtcaaatctacattttatgaattgtacttcctccgtcctataatataagagattttaagtttttcttacaacgtttgatcactcgtcttattcaaaaaattttgaaattattaattattttatttgtgacttactttattatatacagtactttaagcacaacttttcgttttttatatttgcaaaaaaaaattgaataagacgagtggtgaaacgttataagtaaaaactgaaaatcccttatattatgggacggagggagtatacttctaaatcaccttgtattacctctaggccaagtgagaagagcaagtagcactgtgtagcagagcaacagcaaagaagcgactacactagcaacagcaaagaagcgactacatacgctcacagtaattaattagatatttagatgaaacacatcctaatatatttcgatccaaaaattaattattttgctttgagattaatgagcaatacactaaaacatgaagagaaatttaaaaaattgatgataaatacttgagctggaacatgcagaacaagatcagcaacaataacactagcaaaggttaatggaaatctctaacagctcggtatatagacgtcctctgcccgaaggtgtcgatggatttcctcgggacggcgccgcccggcgaatccacccgcctgttctccgacgacgagctctcggccgcgacgacgacgctgccccctgcagtggatgccaccgaccacgtgctcatcgatagcgccaggctctgcccatgcgagctcgccgtgcccccggcgccgccgccgccgccgttgcagctccccaccagcacgtcggagcacgcgtagctgctcgcgctcgcatcggtgctcatgtcctgatcagcgtgctgcggcggcgatggctgcggctgcgggtggttgctccagagccacgtcttaatcatggacagttctatggttccgccgccgcatccgccgttactgtaaccaccggcgccgttgacagtgcttccggagtagaggtatccgctggcggcttggccgtgcacgtcggagaataagttgccgtcgaggaagttctccagcttcggcgcctcgccaccgccgtcgcccaccgtcctcctcccgccgccgctcgagccgacgagcatcgagaggtcggaggagccaccgccgtagtccaaacccctcagcgcccaatctgcaaagcacgccagggagatcaccatgcacgactcccccaaaattcgctgcttgcggctgcaaaatccccatcaaatagctatacgggtattctcccctgccaacaattaataaaacagttttctctgctcaccaccaagaacggagattgcgaaacgaaagaaaatacaagaaccaccaaaaaagaaacacagctcgctggctaatacggagactcattcgaacagcacggggaagagaacacttacgagatttccaccatgggagatccggtggacgagccgcagctgaggatgagatctgtgtaggacatcgagctcgtaaggtggtgtgcagctgtgcgcgggcaagtggttggacacaccaatcacatccgccgccgtgtttccatcgcggatgggatcttggggaacagacggcttccagttagactgccgattgcacgccatggccgccgcgtcggcgagcggggcgggtggtgggtggggggagaaagtggccattgagctcgcacgatcttgttgcgcgagcatgttgttggtcaccacacccccatccaccgtcgtgcatacctcgccggtgggatgttggagaacagccggcgtgcaccccatcgccgcaggagcggcgaggcggcgtggttggggcgggggtgaaagggggaaacagccggcactgcgcgtcgtcgaacacaccggcgagatttgtgttcggcaataattgggaggggccaatagtactctctctccaacgtgacgcgctggcccacggagcgtaaaagtagtactttgtatacccaatacatacggtcagcgcaatatatagattgaaatacgtcccgaccactttacaaccggcaccaatcgcgggatgcatctgacggctcccagcctactcctctttcagtttcacctgctgctcctcctctttcaccggctcctccattttcatcttcatcttcctccattttcattttcatcttcatctcacattccaactccaacccctccacacatccactcccttgtagtcgtagtagatgtcataaatcttccattcactttgggattttttttttaaaagactcaagtatatatgaacctcggcaacacggtttatcctctccggcggcggccatggcctttgatcgatcgatcgcctcccctgcgcctcgccctcgaatccgattgatgtattgtcgatgcggcttgctggatcgaatgctattggatttggggattagggtttggaagccgcgctgcattctgcagttttgccaccacggctcaatctaaagacaatccaacgggtactatacattggacttccgaattccgatcggacgacggacgagataaacctattgacttagtcaaacgcgcatctcttgatctcttctcccgccttcccccgtctccgacgtggacatcgaagtacggaatacggatcagaaacgacttgaagcgcctcctcctcctcctcctcttttaagcaaaccggctagcgaccgagcgagctctgacctctgaaatcatcgcgtaatcaagtgcaactacttcctaataaaccctataacgatccgatcccctagcgggagcaagaacacgtgaaccctagggcgatccgatcccctagcgcgagcaagaagacgtgaggacgatgagcatagccgtagtgatgaacaaaacgagcacggtagccatggaggatcgccgctcttatgcgatccaccgcactccggcgttgccacgcattgtcagcaattcatcctctgtcgcgacggcagaggacgcccacagaggaggtaattacaagcagcggccgatatgccggggggacgagcggttgccgatgccgccgctacacagcaagcgccgccgcgacgaacaccaccgccgggactaccactacgacgacgacgactacgcctatcgtgcgagcaagaagaagaagcagcaggcggccgctgaacaggcggcgcgcatgccgaacaacaggacgaccagaccgacgacgcggcgcgcgtcgtcgtcgcgctcgcgcaccaaggaagagagccatgcccgcggtggcggcgccgcgccgcgacgcgagaacaaggatcgcaaggacggcgccggcgggcgccgctcgcagcggcgcgcaccgacgatcagcggaccgcgcgtcccgccaccggcgacgccgcctccggcggcgctaccggactcgttgacggcgcaagacgcgctgagcgcggccgcggcgagagcgagggagatctcgctgatgcgggaggaggcacggcgggagctggccaagatggtcaggaccgtcgagttcaacgatccgtacatctcacccatggacgcgctcaagccctgaccatggcgtacgtacgcctgacaatttgttttagctcttcttaggttgtgtttggtacgaggggtgcacgtaaaacagaactactcatcaccgatgattaattaagtattagctggaatatttaaaattagattaatattatttttataacattttttatatattttttaataaacgtaccatttagtaatttagaaaatgaatgggtagtgctgaattcagccttactgttggacacgcgtatatgttaattcagcatatcaatttgtttagccaatggcaaaatttagaagtcctatgttgaacagctgtactatttttgtgaactgaacgattggtctgatctatctttgaaaaataagtgccgatttatttttgtgaagcttaattaggttgatcgattggtcagaactcgggtgtaattcagcgtagagttgaagtaggtgatcatcagcatcactagttcagtacttaacaccacgcacatggcacatgctcctcgaataaaaacctgcatgaaaattaaagcacatcaatggtggggattaaaagtggattaaccgagcttccgatcgaacggacgagatcaaatcaaccaacggaaacttggcaaacgcgctacccccctcatccaattctcccgcgcgcgcgagacagcgagaccgactccgactcgaagcgccgcctcctcttaagtcttaacccaactggtttgagatctgcaccatccttcccttcgcttcccatccactgcccaactccctcttcctaaaccctggagagctcgcgatcctccactactccgatcccctagcgctagcaagaagcagccatgaagatgatgagcatggcgcagatcatgaggaagacgagcgtggtcgtcctgcaggaggaggaggatctcacctcctctgcgacccgccgtgctccagctccgccgcctcgcgaggtagtacgcgtccgcctccgcctcacccccgcccctgtcgccacggcggaggacgccgccaggggaggcaagatgccgccgccgccgccgctccccacctcgtgcgagcaagaagaagcatgtgttgagcaagaaggaagaggcggcccttgcccgttgctcctccgccgcggcgcgacgcccgatgatcaagaactgcagcggcggcggcgagcgctcgcaggagagcgcgccggcgccgtcaccgtcgccggcgaggctgggctcctcgacggcgcaagacacgctgagcgcggccatcgccgtggcccgttcggtcatggacaagcggagggaggtctcgctgtggagggaggaggcccacggcgggagctggccaagatggtcaggaccgtggaattcaacgacccgtacatctcacccatggacgtcctcaaaccctgatcgaacatggtggtgccaagaattttctttcttaagctcttgttggggttcgagatatgaaattattagccatgtgtttattgtagtgtttaatgtcgaaatcattggcaattttgttgtgagccagtggtttaacctagaattcttttgtacattgaaacagacaaatgctctgctgttagtagtaattatgaactgcatgtaatatcagatgtacttaacaaacattatctattctgaactgaagagtactactaagttttttttttcacgattgcaacaaaattctgtcgcgatgcggattaccactcattatgagctttgaattagttgggccaaaacacttagttcgtgggcctctcagcctacaaaggcaggcacaagctgcccagaaccagaaccagaaggcccagtggctagccacgcacaacccctaaacccggagggcctctcctctccgacggcggtagcgcggcgtgggcggcgcgcgcgctccggcggccaaggctacggcgccgggtgcagcggcgcgggaggatctggaagggtgcagcgcgggaggagcacagccgccgagcccttgctgcgggctgcggcgcggcggcggcgaggcggcgagccgcagggcaggccggcaggcggcaggcggcaggcagcggctgagcggcggccagcgtcggcgtgtgcggcggcgactcggcgtcgacgcggcttggcggctgcagcaggcgcgggcgcggcttggtcgcttggaggcttggccgccatctcgccatctccgtcgaccgtcggccacctcggcacctccttgaattgtaagatttcttcccaatttattattttctatcattttggtatttcatatgttggcactttgatatgtttaccaattagtatttctacatatttaccaattctatcaatgtgtgaacttatgatcaattttatgttatatacgctaaatattgtaattattagtgtgttatactccctccttctctaaatgtttgacgccgttgatttttttaaacatgtttgaccgttcgtcttattcaaaaacttttgtgaaatatgtaaaattatatgtatacattaaagtatatttaacaatgaatcaaatgataggaaaagaattaataattacttaaatttttttgaataagacgaatggtcaaacatgtttaaaaaagttaacggcatcaaatattttggaatggagggagtactatacaagctaatttttaggctattaggtgtatgaacaaattttttttacccccttgtcattttgaatacacaagttcaaaaagctaggcccacagctgaggaggagccggcaagccttcggtggtccagccgtccagcccgctagggcgcggcagcgtgggagaggggtgggggggggggcgccaggtatcaactcctagctgctagggcgcgggcgctgcggcgtggccacggctcggagcccaggacggacctacggccgaggaccatctgattgttgtgagagttctgaggtgagtggatgaaatccgtgaatcccccccattctccaattgaaaatttgaaaaaaatgtgtagtccctgaatgaatgttacggttgttcatcaatccatctatctcctgtgataattttcatgtcattgtggactgaaattttgatcggtggtgttgattgtcaaattgtgcaattttaggatgatgacatcatttctagattacaatgcatgacaaaacacaaagttaaacggtactctctccgtgaattcacaatgtaagactttctaacattttctacattcataaagatgttaatggatctagatgttcatatgtgtctagattcattaatatctatatgaatgtggataatgctagaaagtcttacattgtaaaacggagaaagtaggtttcttaattattttgtagtttgttaatattagttgagattccactgatacaaactgtttgtattttgatgtatgatactgtgaacttttcatattgaataataccttgttacttcgaatacccagccgtgcaattctacatccactactggctgttgagaaacttggtagcaatcacaagaaagagcatcaagaggcagttgctggcactgaaagtgaaaagtaagttctgaaaatcaattcggtttttcttactagtttgttttggaaaaatgtggaggacagaggacagagtttaaagttgaattgaatcacttgttaccatatcatactcacaattgagcctctcactctgcacgaacagtaggtagcacacgaagctgacaactgggccttgccttcaagttttctcaccggatgcttgccacccccacccactgcctgagctgacactccggttgcagaacctcgacctgctcttctgattgcagtcagctctcatcggagccacagcaactgctacataatgtctcttgctgcggttgcttctccacatttcccaccgtcatgggcctatcagatccgtatggctgcttcccagggccaatttctccacgccatctctctcttcctacaaatgcgtgcctctgttgcgccccgatcatctgttccggcctccctccctgctgcactcaagtcctgcgccggccttggcctctgcactcttgctgcatctctccatgctctcgccatccgctccggttccttcgctgaccgctttaccgccaatgccctcctcaacctctgcatcaagctcccaggttttcatcacccctttgggacaaatgggcctctggggaaggaggcctggaatcagctgcatatgagagcatgcggaaagtgtttgatgaaatgctcgagagggatgccgtgtcttggaacactttgatattgggatgtgcagagcacaagaggcaccaagaagctctgagcatggttagggagatgtggagggatggatttatgcctgacacgtttacactgtcaactgtgctgccaatctttgcggagtgcgctgatatcaagagaggcatggtggtccatgggtatgctatcaagaatggatttgacaatgatgtttttgttggaagtagcttgattgatatgtatgctaactgcactcaaatggattactctatgaaggtgttcgacagcttctcagactgtgatgcagttctgtggaactcaatgcttgcaggttatgcacaaaatgggtcagttgaggaggctcttggaatattccgtcggatgctgcaagctggagtgaggcccgtgcctgtgactttctcaagcctaatacctgcctttggcaatttgtcattgttgcgtcttgggaagcagctgcatgcctatttgatccgtgccagatttaatgataacatatttatatctagctcccttattgacatgtattgcaagtgtgggaatgttgacatagctcgtcgcgtttttaatgggatacaatcacctgacatcgtatcatggactgcgatgatcatgggttatgcattgcacggtccaacaacagaggcttttgtgctgtttgagagaatggagttgggaaatgtgaagcctaatcatataacttttctagcagttttgactgcatgtagtcatgctgggttggtggacaatggatggaagtattttaacagtatgtctaaccagtatggatttgttccatcccttgagcattgtgctgcacttgcagacacccttggtcgtgcaggagatttagatgaagcatataatttcatctctgaaatgaaaataaaaccaacttcaagcgtctggtccaccttgttaagggcttgcagggtccataaaaacactgttttagctgaggaagtggccaagaagatctttgagcttgaacctaaaagcatgggatctcatgtaattttgtcaaacatgtattcggcttctgggagatggaatgaagcagcacagctgcggaaatctatgagaatcaaaggtatgaagaaggaaccagcttgcagttggattgaagtgaagaacaaattgcatgtgttcatagctcatgataagtcccatccctggtacgataggattattgatgcactgaatgtttactcagagcagatgattcgtcaaggatatgtgcccaatatggaggatgttttacaggacattgaagaagagcagaagagagaggtgttatgtggccatagtgagaaacttgcaatagtatttggtattattagcacgccacctggaacaacaatacgtgtgatgaagaacctccgagtttgtgttgactgccatatagcaacaaaatttatttcaaagatagttgcaagggagattgttgtccgtgatgtaaacagattccaccgatttaaggatgggaattgttcatgcggagatttttggtgattcaggatgtcttcaaaagattgagtgcatgcttatggtcgatatcatgcttgagcacccctctccagggcattatggtcgatatcatggttgtgttgggtcttcttcagtcaccatctagtgctacatgtactactctgcagctcccatttgccataggcacatgtttgcaagtgatctgaatgccattgccataagcaggggcagccgccactcgacgcctctgccatctacaattcttctctccgccacttcgaaatcaggtaaatcttttctttatgcacgcaagatgatcagctaaattaccaactgacatgcacaggaatctaactgactctgattcttatttcccttgacctctcccagtgattccaagttccccttgcattctataagcctgtcttatgacaacttggcatggatgttggcgctggtggagatcagcgctgatctttggtcaatacgatcggcactccaagggacggaagagattggctgccttgtttatttcccttgtgtgatcaagctttttgttttggaggaatgagactgtgggggtgaagttggagatcagttcatgtacacttgtccatggcgctatcacctgtactgtctaaatttggtaagagtatttgcaatccactgcatcacctcctgtgtaatcttctaattttcttctgttagattgaaaattttgcgcgacacttgcatctgttgtacgcatagaattcatttagttgagcttatatagtagtataaatgttcttatatagtcaaatttgttgagtttgattcatttcaaatagatctcatgaaacaccggcagtggtttcagtgattgggtttattgtgccctttttcatatgaaatttctcttactgtttaacttgattcttcaaacacatggatgtacaaccaaacaaatttgaagcctacattccttctgtgtttctcccatttcaaattccaacaaatgccgattttattcatagtcttgacgaaaagatgccaagatgccgttgaatttatcagaacggtatttctcccgctttcccctgctcttctccgcctccccggcgaccggcgacgctgtcagccgtgtctccgcggcattccgtcccgtgcttaacgacaaccatgcacggcctggatgaggtaccagatacctcgtgtggcatatatgatcagaacaatttttttgatcatgaacaggaaaatgaaggaattcctatattttgatcaccatctgtaggcacgagcacatgatcatctgaatttttttttctttggtaagatactaattgcgttcagacaaaacaggacagaagtgaactaatgctcaagcttgtcagaacaaagcagactttagagttttcttttaaggggtgtgggggtaaagttttagcgtgtcacatggggtgttcagatactaataaaaaaactaattacagaatccgtcagtaaacaactagacgaatttattaaacctaattaatttgtcattagtaaatgtttactgtagcaccacattgtcaaatcatggagcaattagacttaaaagatctgtctcgcaaattagtcgtaatatgtacaattagttattttttagcctatatttaatacttcatgcatgtgttcaaacgttcgatgtgccagggcgtaaaatttaggatgggatctaaacagaccctaaatttcatatattcttcgtagctcattttctttgacgtgtatttttgtgtcttacatgtaaggtcgtagctcaattcacaatccatgttttcttctctcttcagaccggtggtttgttactcaaaaaatatgcagtgctaacttggcaacgcttccatagttccatccggaaatggaaagcggcaaagcgccgacttgaagcatcaaacgtctccttcccttgtatataggcaaaggcgcaggggtggcagccatctctacatccatcagttcgcgtgagcttcctaaaccctcgagaaaacccagagatcaagaagcgaggagcaaaaagccttggctaagagagacacgagcatggccgcgccggcgccgccggcgccgccacctcggccgccgttcaaggtgcgcatccgcatcaaacccgcccgcgccgcgagggcggaggaggacgccggcaaacaggaggagcggcttccgatggatcacccgctctccaccaccaccaccaccaagcgccgccccgagggcgaggagagctccggcgcggcgagccagccggcgccggagcgcgtgaatcccaccgggacaaccacgccggcggcgcgggcggcggcgtcgtgctgcgtgaatgaagaggccctggccagcagctcccacgccggcggccgcgacgacggcgcgagcgcgatcaagaaatgcaaggacggcgaggggaggcaagaggacgccaagaacgcgcaagaaagctcggggatgacaagcccggccgtgcattccgccagggccacctcaccggcgccgccgccgtcgcgcacgaagaaagagaccccggtccgcgcccatgccgccgtccgcgacgacgacgcgacgccgccacgcgcgatcaagagctgcaagaacggcgagcgggggcaagagaaggacgccgagagcgcgcaaggatgcgcgaggacgagaagcccgccggtgcgttccgccagggccaccacaccggcggcttcgccgtcgcgctcgaagaaagagaccccggtccgcgcccacgccgccgtccgcggcgacgacgcgacgccgccacgcgcgatcaagaagtgcaagagcgacgagcggaggcaagagaaggacggcgagagcgcgggacaatgcgcgacgacgagcagcccgcgcgtacagccctcaccgacgccgtcgccggcgccggcggcgcggccggatcccagtgcggcggagaactcgctgcgcgaggccattgagagggcccgcccacacatgcggagggacatcgcgcggcagagggaggcggcgcgacgggagatcgccagcatggtcaggaccgtcgagttcaacgacccgttcatctcaccggaggacgtgaacaagccatgatcatggcgtcctcctaacaaggtcttttgtagctcgttttagggttcgtgatctctagttgttaaccatgtgttagggttgacgccattggcaatcggctgtttttgttgtaaaccaatgcctcagttcatgattcttttgtcgaaccgagcaaattgctctgctgtacattgcctattctgtactgagtgacgtaatttcaaaagatgaatgtcactatttccgttgagattgattgttcaaatcagtagacatcgtgaacattaactgattaacaggagtgtttcgtccgaccagttaatacagtatctacaaacaaattttgcatgcgctgaattcggtgaagtatcatgaacatgtgggctagagtttagggcttcagaactgcctgaggggagcaatgggccaaaccaaactgcacatattcaggtccatagtcctctatgaatatatattgaacttattgtatgtttgatcaaagttgtcattacaatacgcagacaaaatcaattcatattcagaatacagatacattgcgtaacaaaatcacttgatcgaaaaatttctcagctttggtgaagcattatctaaaaaagtgttgttcagggaagagaggttgactgtcaacgcaaagcagaaaccaatcagctcaattatatcctcgccaatgctgcaggactgattggaatgatgccagaggatgagaccagagcatcaataggaacatctgttgagttgactgggatgatgccttcctccaaaatttgcaccgagtatgaaagcgcgacttcaaaatagaaaatcaggccattagtctatcatttagcaataatagtgctagatcggatttcatcatttaaatgtaactatgaactgcaacgcacaaaagtgtgcccactaggtatacgtatttcatgggcatgtagaagtaaatgaaatgcaattacaagctttggttcagttaaattataatgtaacttctagttgacttgttaattcactacgtgattaaggaactagtcaccacaatttagtttctggttggaccaagaatccctgatacccttcataaaagaatctgaaagcttgttgggatctgattatgaaatttggttcagtattgcgggccaaacaaaataatcattgtagtagaaaatacaaaatagcatgttacatcaaggaaccaacagaacatattaggctaccaacaggttggcccctctgttcatggtgttggtgctacttcaaaacagctcactttggtcctgtttttgacattaagggaccaatagtaaactttccgtaactataatcaactaaaatgacataacatgtcaacgatgtgtaataacaaacaaaaagagtctaaagtaaacaaaaacaactgaacttctggaaatctgcacatcatacctagaagaggctgatcccaccctttctctttagcaagttcttgatatctcatcaagaatgtgtcatagtaccttcgatgaacaaacatacaaatatataatttagatgaaggaaaaatttcaggctttggtctaaacaatactaagtcaaactggcataaatgaactattggtgacaggatggcattaaaaagatttgaagttcatgtgccccttgccattatatgcattttagatgcacttgacgaattgtggaccattaagcagattgtgttaaatcaaatgagatacagccaaagcacaaaactaatatgcagagacatcatatactttctccctaacagaggaaataaaatgcacatcatagagctgtggaggctataaaatctaaaaaagaaagcaaaggccgcacccacacgaatagcctgagttcttcaaactaacagcgaataaagcacagaaagtaagttatgaatctaattgtcaagatgccaacccagattccacgacttatgtttacacagtttagtttctaaatccacacgctacactgcaaccattcaactaccagctcttacatttcttagatgttctgcagatgttgtgacaggtatttgatttgtgctgctagaccaagaactttcatccatgtggatcaccctacaacaagtttctgcatctataaagtatgtttaatttccactgtggtaggtaacttttctctattacttgggctgctaatacactagagcatccttggacttcattttggaatgcttgcatgccaaatattcagagttagcaaaatcatgacatgaataagttgttgaataggacccaaagttagcaattgaaccactgcatagatattggatgaagatgacactaacagtatttggcaacttcaatacaggcagttattaaagtgaaagatagaataatgtgtagacctaccctccaccacgtcctaatcttcgtccagtcctatcaaaagcttgtcctacatgaataacaatcattattcaattgaatgttcagtgatggatgcagtgtattaagagattgaagggcttaccaggcaatagaaaaagatcaacaggggaagaggttgacaacactgtaagcattaaaagaggatcagtgtaatgcatataaatcatattagctacccagtgatgcactaacttaatcaaccgaggaaaagtttcattgtatcacctagataaacttcataccttcttcacgagcattcccactagcatcaagtggtgatggttctagaatgttcattgaatttttaactaaatcatccatggtagtgattttgagcatccgcatattgcgattcttatcttccactcgaggaacataaagatcctttgcatgtccatgttctgaaacaaatcaaattgttagaagcaggagaaatcaagggggcatatctgtatatagtactcaccagaatttggggataaaacttctgacagtacttttgatgtatcaacttcccgcaattgtgcacagcttatataagcacataaccgcttgctttctttgaaccaagaagagttcaaaattgcattttgaatagcctggtctggaaatataagaaaaaacacatccataaacttcgcaaatcaacacaaacaacacctgttgtgttccagcaacagaagcataagtagcactgacgtccgcattacacttcaggtctttgaagagaaaaattaacaaaacaaaaatctacttcgttgcagttacagaagatggggggggggggggtgtggaaacaacacaaccaaatatagttggtccagctacagaagcaaaggtagcaacccttttgtcttggtgtccttctgtgattttctcatgacaggcagttcgattcaattgttaaacgacgcctgccatcaggttggaatgtccctaatgtgatccttctaatgctagctactgatgagagattgaagtgtatcgccaagttaaattttgcttgcctaatgcttattcagacatgattttatcatccttttctgtgagcgccaatactaatagccagcacagtaaaagcagcagcccttgtcggcaaatcgacgagcagctggtggccaacggctcaatcgatttacatcagggacagcggaatcagatgcttgggccatatgagcgagaagggggatcaccttcgctggcgcgctgctcgggggtgagggccctgagcgccctccgcacctcggaccgcagcgcgcgcttctggtcggcgacctcctgcgccgccgcggcactcgacatggcggcggcggcggcgggcgccggcactcgtagccggagcgaggggaggagggcaaggtggtggcggcggcgggggtaggtgggggcggatgcggcgcggggcaggtggaggaggcgcaccatcagcgaggccgcgccatttttaatcattgccagtgtgtgtgcgcctctgccttgctgccgtgtgtgtctctcaccgcgcggtcatctctgccgccgcagcgggtggagtcggagtgggccgggccgaaggtaaggcccagctacgctcgacgaaacctgattagaatggaaaaagtacaccgaaggtccctcaacttgtcatcgagttacgaaatcgtccttgaactgcaaaaccatatacaacacatcccccaacttacaaaaccagtgcaaacaatatcccacggtagttttgactccggttttatcctatgtgatggctaaatcagcgtaggatctacgtggaccccacatgtcagggtggccatgtcatcatcttccctctttcctcccttctctctatgcctctctatgattttcgatgaatgaccctatggtaatgcttttatctctattctatggaccagtcaacttcactaatgaaaacggattacatctttcaaaatattatttagtactacctctatctaaaattctttatattattggataaatggagtataagattaggtgataaacatgaatagtattttatgtgtgactaatttttattttttttataaattttttaaataaaacggatggtcaaatgttggacacgatacccacgacgacacttattttgggacggaggtagtaatagtaggcttgttctattagggcaagtactataagcccctacatactgctcctaaatttgctacataagattagatgatgaggtggaggagagaagttaggagagagagaatgagccacgcctcatgtaaggagtaacctctacacaatctccaagaaaagtgcaagatgatgtgagagtagactaatattggagtttgtgtattatatgtgatatgttgtatgtgttacctcttaattaataagaatatgacatggtctaaattagatgtgacatccacctccactataaaacttgccctaagctcaacgatccccacaacggatcacactcctatgacataaagtcatagggacgtgggtcactgacgtgtgggcccaacccttatgggtcccacatgtcagtgacaatgtccctctgactttacatcagaggagactcatcccacaacaacatggactggggtgtggaaattccatttggattactttactactagggccttgtttagttctcaactttttttttcaaacttctaacttttctgtcacatcaaactttcctacatacacaaactttcaacttttccgtcacatcgttccactttctttaaactttcaattttagcgtgaaactaaaaacaggctgtgtttgcaaccccttgttcccaacccctctccctcgttttccgcgcacacactttttaaactgctaaacggtttgttttttaaaaataaattaatacttaattaatcatgcgttaagagcaagtttaatagtagtatagctaattactagctacaattcatctatagccaatctaataactcattcatacaatagttacatactacattattaatacctagtcccacctgtcatatacacactgtgtcttggaatccatgctacagctggctataaatctgtagctcgctacttttctttcttcttatttatctctttaaaatatattttgtagctagtttatagtctgctattgcactcgctctgatgaaccgctcagttttgttcgcaacgattcatggcgaacacacccacagcctagttcagaagttgattgcgaagcttccaggagaagcctgaggctaacctctgttctttttctaacagctggcacgaaaaagtaaggcgcggtgggggtggatggcatgcatacgtcaccggactccagactcgatggcccacatgcagtgaaacaggggtaggattgttgggtgtaaaggttctaaatcgaactgtgcgtggccgttttgatccgacggtcacaatcaactggaagctaatcggacggcccatacgatcgtgtggcacagcgctcgaggatacaaatcacgccttcaggtctcacggaccacgcctctcctcttctctcctcgcaaactcctctgcactactgctttaccctctcccagtctcccctcccccaactccggcgatggccatggcggcaccggcgcgcgacgacgaggagccccaggacggctactactccatcgtctacgagttgcatgctccgggggacgacgagtggctgctccggcacctgtggagggaggcgcacccgatggcgcaggcaggcggggaggccggggccccggttctcgggaggatgatggcggcgatgaggaggtggtggtggcgcgcggatccgcagctacatctcgggagggcccgtctgcttctccgcaggtggagggcgggctccgcctccgcgcgccgcctcgcgaggtggaggagggagggcggcgtcacgccgcgggtgctcctgcagtctgcagaggtggtggcggcgcgtccatccacaggtcgtgctcaggggcttgacggccttgggggtcgccaccatggtcttgacgttcctcatcctcaaggacatcgaaggctacttcgacttcctcagcatccgttacccatttggtaaatccatggcttcaagtgttcaactaggtcgtagctaagcactaatctctggctggatcgctaactaattagctacaatctgtgtgcagcgctgccatctttcttcctccgctacgagcgggtgatgcacgacttcgttgtggcgggcgggatcaccgtactcaccccgttcatctggggcgccctcgtcgccatcatggttggtctgggcgctgacatgggcccgcttctggagttagatgttcttggtattaccgatcgattttgctatatctcactcgaaagatttttccttatctctcactcgattttctcactcaaatttacagtgcattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattacggtgtttcttaattgctttttctttttattatatctatcggattttaatccaaagattaaaaatctgtgggatacgatcataaaaatctttcgaaagatgtataggtactcccattaccgatggtctgcagctagatggccgccctgtggtgccggagccggagcagcaagtccatcagccggatccggatgagcccgagcacgtgtaccgcgtcgtcctgcacggcgaggagttcacgttcctcaccaacattccgagagccaagttctatctcctgatagctgctgtttttgtcgtcgttttcttgttccaccccttcagcgctgagacctgagagcggtatgatcctaatttcttattactatacattgaattcgtgttactctgttgcatttcaatttcgtcgccgacttcaaagcatgtgcctgtgtattgttcgattgcttgtacagatttgttggttggcgatgagtgatagtgcttccaattttagatgctctgatgttcagttatgctgtgattgcatggttagcaagcagtccatatgtcatttgatcaactgttgctttctttcaggagtacagtaaccacaccaattttttgtgaaatttgatttcgttcctagacatgccatttcgattgtaaagctatgttaagaatgcaagtgttccttaccaatattgtgtgcaactgcactaatttgctgtgcatgcttgttcagtagtcaggttttaagccacctcttgcttttttttaagcccttgaagttacaatgcatttcttttgttatggttagctatatgaccattggtcactgctgcatgttaacttgttaaattgctagtgtccctaccaaatataccaactgcatcatcgagtgctgttgtgattctaatccctgtgcagctgtgcaatgatatgttggggcatgcttgtacaaccatataggttcctgtggcttataatttcatttcttgttgtgatgcttatctgtgcagttataacccatagcttagtgattcgatttctggatcaatatccactgcagttatagtacatttcttttgttatggttagctatatgaacattggtcactgctatactagttgcaactgtgcctaccagaatttcttttgtgttgtagtgattttaagtcctctgtgcaattatactgatctgttgggcatccttttgtgcaacaatataatacaagtccctgtggcttaatggttttgtttctagttcaatgcccatcagcccattaccattagtgtgcgtctttaattttgatctattttgtggcttctgtgattttaaacccatgcctaactgaacaattgatgtgattatcagtttgttcatgtctcaggggcgggcgcttctaacaaagttggggctctctcaaatcggcgtcatgtctttggtttcggtttcaatctttagagtacttctcctcggctacggttgtgttactttggctagctgttcgcatgttctgatacgctaacgttctggtcttttactcttttgcaacaacccttgatggaacattacataggaagtagctgctggagtagtattaagaggcacttagtaccatctgagatctgagaccaccttagttggaacactattaggaagtacctgtcgtagttattacactattactcctagtaccatctgataactgcgatatgtgactttacctgttttgatgcttgtcaaaactagtagtagtactctatcatatatgtgctgagatgaaccattgcaccatatatggtgcaagctaaacagaacattggagtgcagtctgctttttcttatgcatttttgtcaagctgaaatgatgcatgttctcccagttgtccacaccgctcaatgtacttgctgttgtcgcttgtgtaatcagatattaccatgttctcccttgaaattaaggaattagtcggccatatcatttatgttggttcaaatgttgagagggattgaagcggtaacactttgtttggttttgtcactatccacaaactaatcgggggctcggggcatgtttggtttgtactatatgttgtgttacaaaatctgttattctttaggggaaaattctattgaattgctctgtggtgtttagtacacgaactatgtttataccggtccaagctctaggtgggcctatgaaaaacctggtttgttttgggctaaaatccgtgtctgaagtaaccaggaataaaggtgtcgcgtacaaatgctgtactaaagtagagaaaactaaatcatttctttaaaaaaacacagtataaatcgttcccaaacgcccgtgtgtttatcctataaacatatactctatccctatgagcacctctagaatattggactgttatattttgagattgatgaagttgctgcaagcgtctcatttggactcatttggatatgtttgggcagatcctagtttatttttctctgttttagggtgggtattaagccttacataggatatgttgaaaagaaaagaagaataacaaacgaaaaatagttcagaaaacgggtcatcgttgcgatcgaactcatgaccccttttcgcatgtataaaggtacgatcatacgataaattcgtatgttatatatcacattaaaatattagtactgataaattctacaggtcttttaaatactcatgaaaaatctacagttagacttaaatcctattgccctacaaacgaagcaaaaggtaccacaaatatcgggtctccgctcggtaaaaagatattt

SEQ ID NO: 68842 - DNA, 10989 bp, Oryza sativa
agcagaacgaatgatgacgcaaacaagttgcagaatcgcatagaggacacgcgacaaacaccaagaatcgcaacaagagatgggagagaggatcggaggagctcacctcaggcacaatggagatcgggagctccggcctgcctggattcgggaggacgggaagcacctcccaccgcaacgccttctcgtcgtcgttgaggcggccatcgccgacggtgagtctggggcggtcaccgagaaccagggtacccagtttgccgcgcaggtagcggccggacttgtcgtgcaggcagaggacgtggtcggcccgcctgacggcacgccacatgatggcgtcgacctccggctggtcgaagtcgcgctggccgacgacgggggcgggccagcagcaggagagcggccagcggcgcacgacggcgtccggggcaccaaggtagcggccgtaggcgccgcggaggagcacgtactgcgtcgggggcgccccggcgaggaccatctgcaccgcccagattgcctcgtgcgccgggcggtggcggtctggggcgtagtggtagaccgacctcccgtcctcgtcggccgtgacgtacgtctcctcccaccagttccgcagccgcgcgaactgcacgccctggaaaacctccatcccgcgcgcgccgccgcggatgggacgacgtacgtacgccggagatgcgcgcgcggcggcgagtggcctgctactcctcggcttctcggcgtggcgtggcgtggcgcggcgtggcgtggcgtggcgtggcgtggcgaggaaggcgagagaggcgaggcggtggcgcatttgaaagcgtcgcgaggaagagggagacgcaggtcgctctctgacgtgtgggccctttggtcaatgaggtcaaaagaagtcaatgacgggtgggcccgagcacagtgaatgggcgtcgcgaggaggagaggatagaagagtcacgggttgccagttgcgcacagccagatagccaatgactggtggggtcaggcacagtcaatgactggtgggcccgaacacagcgggtgcaataggattagccatcgacgagccgtgctaacttgaacggaactacggaagatgtgtgaaatttgctcgaacgaggcgcacatttaggattgaatttgagtacactctgcaaatttcgtacagaacgagttctgaacttgttctggtcgctgcaaacaaaacgaacctgttcaaaggagtgaatttacagagttcggttattctctttttgcttaagggtgattaacatgagttactatgatatgtagaagacttcatcgggctcattaacatgaggattttcttggccgtgttgtttttgcaaaacaaataaaattcgaagtctgaactccaaagtcatacacaacattcaactgcaagtcattttgttgccatttcagtggtacatttgcttcaaggtgatataatatacagtagcaaacttggccacgaaaaaacttcaagcaatatacaagttaatggtgaactgtcttgtttgtgttatgtacggagtagtacttttgcatcaaacaatctgtttagagtaatcaccgcaataggtaaaaactaccaactactcggtacctaggtagtagaagcaattactcctgaaccattatctaaaaaaagcagcatctgaaaactggcaccatccaacatattgctaagtagaaatatattactgctgatgctaaacttggtagaaatatgcatgatgtgactgaattctgatgaatgattacagtaactgaatctcctgaaccattcaggatttcaggtagtatccctttctgtttgggaattttgaaggtactagtttgatatgtggaatgtagttaatttagtaattctttttacttattccagtgattgctctaaaccaattgctggagagttcttgaaaagtttaaacatgcagatttcttgacagtttgtcatggccaagcttgctacactactacaatgtattgtggtgctgctacaacggtgaagaatcactgaacttaaactgaaagtaacaaaatggcatgcagctgaaatgtaccagtacatgattctgaattccaactgaatcttctgagttctgacttctgaatcacagaaccgatcgatcgaacatccatggtttgccactcaaattctgtaaacagagtcgttttgtttgctgcagagatgagaacaagttcagaactctcttcttttgaagtatgaatcttgcagagtccactcaaacccaatcctgattaacctgcgccgcttcatttgagaaaatcctgtaccatgaaatctgccgcactccctgttctcgggcccacccgtcattgagtacggttgacgacagttgactgtgggacacacgtgtcagagagtgacctgcgtcttctcgcgacgccttcaaatgccactgccgcctcggcagaatccaggaggagaggaggattggagcatcgggagcagagatgggactcaaccacaaacccgtgcatcacctatagaaaacctagaaaaaggagaggatgtgaagagcagctcaacccagatcttggaggagggaggcttggcgctgcatctcgctggaggggaaggactggcggcggcggcgaccttcgttcgcgagaggggaatcgtcgctgcggcacgcgagcgacgcgacgagattttccacgtggatcgggccgggaatttcccagctgatgggcttccaaatggtccggaaaattggcccgtggaattttactgcccgggctggccggccagggaataggccgggatccagtattattcaggtggtgtttggatccaggacttaactttagtccctatatttagacactaatttagagtattaaatatagactacttacaaaactaattacataaatgaaagctaattcgcgagacaaattttttaagcctaattaatctataattagagaatgtttactatagcatcacataggctaatcatggattaattatgctcaaaagattcgtctcgcgaattagtccaagattatggttgggttttattaatagtctacgtttaatatttataattagcgtccaaacatccgatgtgatagggacttaaaagttcagtctcatctaaacagggcctcagtctctgactcggtgatggcctgaacagttcgatctcggactcggccgttttatccttttaaataggtcgatgtgcatgcgctagcgcgaccgaaccatccgagcaaatcgcaatcgcaatcgcaaagcagaggaagaaaaaaaccaattcatccgtttccagtagggctcccggccgcctccggcagatccgtcgccatggaggaagaaaccgccgttgcagactggtcggcgctgccggaggacatcatcatcaccgtaatggggtgtttgtccgtcctcggcgacctcgtccgctccggcgccgtctgctccacctggcgcgacgcgtacgccacgttccggcgactccacctgccgtccacgacggcgcagccgccgtggttgctctacgcctgtgacgcccacggccccgccgccgccgcgctctactgccctgccaccggcaagtccctccgtgtcccgctcccggccgccctgctcgatggccggcccgtgatcggcgcgtcgcaggggtggctggtcaccgtcgacgaggcgcccaacctccatctcgttctcgtcaaccccatcaccggcgccacggcggcgctcccgcccatcaccaccctccacaacgtcgagaggttcacgagcaaaaagggcaagacaagatacagggtgtacgacgacatgggatacagcgaggcgtcccttgagtactcgccggcgcaggcgagggaatgggtgtaccaccaggtggtcctctcgcgcagccccgccgaggggagcgcctgcgtcgcgctcctcctgcaccggccggacggctatgtctcgttcgcgcggctcggcgacgagcggtggacgccagtcgcgtacccgggacaggactgctccaccggctgtcgccacgccatctacgatgacgccgatggcctcttctacacgttgcggtacgacggctccgtctacgcgatcgacgtccctcgcgccgcggccgcgtcgtcgccgccggcgacgagagaggtcatgcggagtgtgacgaacgcggacaacggcagcaagtacctcgtcagggtgccatgttccggcgatctcctgcaggtctggaggttcgtcgactacgacgacggcgacgaagtcgaagaggatgaagacgctgaagatttaccactcggcaccaagcacctgcagatcttcaaggtcgacggcggcgagcagaagctcgtggaggcgtcggcggcgagcttggaggatcatgtcctcttcctcggtcacgggttctcggcgtgcttcccggccgagcacttcccggcgttgaagcccggctgcgcctacctcgccgatgaccacgaactcgtcagcgtgagtaagcattgccggcgagacattggcagatgggacatgaagagaggtcagatggaaaggctctccggcgaagatgacgtggcggcgccgtctcagccttggctcaactggccatctcctgtctggatcacgccaacattctactagcgcatctcgtgcctttagttagcacccacacattttatttattttgtcaatacgaattattgttctcttgtgaagcatcaagtagtttctcgtggaatgatggccaattcggtcttttgagttttctagtatctgtgcacatgcaacatacgttctaaatgtcatgtttaaatgtcagccaaacttagatagtactggccccgaatttaccgagcaactttcaccattgtaacacataaatgttgtagccaatgacaaacataacgagattacaattaagcaatagccccatgctgtgtttagttggtggtccaaaatttattttgaagtatacggacacatttgaagtattaaacgtagactaacaacaaaacaaattataaatttcacttgtaaactacgagacaaatatattaagcctaattaatccgtcattagcaaatatttactgtagcaccacattgtcaaatcatagcgtaattaggctcaagagatttgtctcgcaatttacatgcaaactgtgcaattgatttttttcgtccgcatttaatgctctatgcatgtgtccaaatatttgatgtgacggaaaagttaaaagtttaaagcaaaaagtttgaatataaacagggccctaatttggccgtgcccttgccaaacagagaggcacgtctacaagcaactaaaccaatgctacggaggcctaattttatttccacacatttcttcagaaaattcattagaaagataagcacaatctagttttaacctagggaaaatccctttgtacaccgctaaggccttgtttggtttggaggggatcgaagaggattggaggggatcgagtgggaataattccacaccacaataggtgtggaataaatcccctccaatccctccatcacaggaaatctgggattaaccgcacaagaatttaatccgggtcaggaatgacaagtatagtaagaaatttatgatagatacaacatgagaccaggatttatttcgggccgggaaccaatttactcatgatagggacaataagagatcaggaatcaattcactagttaagaggtataaaactttttgttgtacctagctaatataagtaaattggttcccgacccggaataaatcccgatctcttattgtacctattataaatctcttgttatacctatcattcctggcccggaacgaatccttgtgtaaccgaacaagaacatagcatgatccccaatgctgcgcatcttagcaaacttgtgcttatcattatcaactaaataaggagtataacacataatttcttctgtaaatcctcatcaggttcatccggttcataatcaccatcaggaattgttcataatcaccatcaggaatttcgtctatttcttccgagtctctcaacctccgtacctccaagagatcgggattagaccaacttaaaatccaatgtgcatatggagccatgagccatcaaagctcaacaagtagaacaggccatcgttcttgttatagttgttcctgtgatcaccttaaaccaattcttagatcagcaaggtacacgagatagttcttgaaaagttaatagcacatcaatttgtcttgagtgacttgtattctggtgttgcaagcctgcaaaaatagtggagaaccactgaaatcaacctgaaagtaacaagatggcaatgcagctgaatgcagtgacagtgagtgtgtcatgagggctagttcagacaccgaatttttcctggaatcactgggccaatcgatcgaggccgcactattctgacttatcagcatttgttcaatgaaaccagacatgcatttgtgattaaactcctgcaatatactatagtattactgttagaaatgtgcatgattctgaattctaatgagtgatgacagtaagtaactgaatctgctgagttctgaatcactggaccgatcaggcgatcaagcattagttatgaattctaatggtggctatgggatcgtcctaacaaattttgtccagaactctgttttttgtttgtaaaattcgacagtaatttaaactcactcactagaaagagctgggcagattcgttttgtttgttgcagagatgagaacaagttcagaccacgtttgtatgaatcttgcatagtccactcgttcaaatccaatcctgaatttatgcctcctttgagcaaattattttttgtttacaaatatatcatttcacttattccaacttaaagaacaaccggacgaaggactgatggatttccaccttggaatcctactaagttcctaaggatgtgtttagttcagtgcaaaatttggattttagttgaatttcgagatgatatgactgaaaagttatatgtgtatgacaggttaatgtgatggaaaagaactgaagtttagatttaaactttggatctaaacacagcctctgtaaatccaaatctttgaaaacaagcggatagactctgtaaatcttgaaccttccatcgatcacaggttcactgtgcacgggcccacccgacttcggttgaccagggagcccacctgtcagtgagcgacctgcgtctccgtccctctcctcgcgacgcctttaaatgccaccgcctccctcggcgtcgaaacgcaaccgtcgctaagaaactcttccacggctacttgcctctctcgtcttcctccccacgccactcgccaccgcgcgcgcgccactctctcgcgactcctcgccaccgccttcggaccacgagattccggcgactttatggatgatgaattcgtgggagtggtacagatcgacggcggcggcggggacgggggctggggccctgttggagcagcggcgggcgtcggcgaggtcggcgacggtgcccttcctcccgatgcggtcgcgggagccggcggagccgatggagtggacgagctgcgccaagcagaggcgagactccgaaaactatgcttggagtacaccggcacgggcagcatgccatgcgccggctgctatctccgactcgataaaggaattcctcataagaagtttaagcttctcctccttaaggggaatggagccaagcgtcatttcgagacagtgcataaactcgacaagaataagaaaaatcgctgcaaaaactgcggaagctacttccgcagtaaagaagaattgcgagaccataaagaccgaatccatcaataagctcaccgaggtgagctcctccgatccgctcctcttctcttcttgtgttcttgccacggtttggttctaattgtgacgacgatggaggttttccaggaggcgctgaggatctggaagagcggctcgtacctccacgccgacgaggacgggaggtccgtctacatcggcagcctcccccgcgccggcggcgactcgaggcacggaacgatgtgggccgtcgagccgccgatcgacgccgcggcgccgctgccgcagtacgcgcgcctccgcgccgcctacggccgctacctcgggacccccgactcctacggctccccgctccccttcctcccggtggacgccgcgcagcgcgaccgcgacagggtggagatggacgccatcatgtggcagcccgtcgcgtgctccggctccgacgtggtcggcggtcgcgatgcccgcggcgtcgtcctcctgcgcgacaggtacgggcgctacctccgcggcagcaacaatctcctggctccccgccgcagcgtccctgtcaagccctacgtcgtgaacgagcatatgtttcggtgggaggtggtgcgtgtccccctgagtgaagccaggccggagctcccgatcgccgctcaggtgagctcctcctctccgttctcttctcgtgtgtttgttgcgtctcttggagttgatttgggtggcagatcaatcttggttgttgcaagaactaaccgttttgctctgtgaattgatcgaattccttctgctgccgttgttgattttgtgcagtccggcttggtcgcggcgtgcttcccaccgctgctgcgcgtgatcgagttcgtgggcgaagacgacctcgacaacatcggcgagggagaaatctggactttggttgagaccagagggaggtcggtgaggctcctgaaagagaagatcgcgaagcttgtgggctacgacgacttcacgatgtgcgtcagcgccggccgccatgggcagttcacccctctgctcatcgacctgcgtcgcagccgggagaccctgaacatcgtcctcctcaggaccaacagcgaaggtaaacatcccagttcgagtatgaatgttgctgaattttctgaacaatgtctatgtggttctgaattttgctgttgttgacgagaaatcttgtgttatgtagttcagcactgtagatttcctagcattgcgtttctgcctgtctgttgaatttgtggaagatgcagttctgtgtaaaatcttgttcctgcttgttgagttaggaagtgaaattatgtctgaacttatctgataaattttgaagtgaaattatgtctgaacttatctgacaaattttcatgttaggaattaccagaaaatcgtatgcactaattctgtgtatcttggcaataggacttatctgaatatagcagacaagcagaaccagtagtagttaatactatgtgcctctagctaacgactactattgttgttaggcacaactaaaatgcatggtctaaaaccagttcaagcgtttattgtctgcttaacttgctctgaaaatgatcatatcagtagttcagtggtgaagttcaacttgtttcgagtaacattttacttgcagatttacttgcaccgtttttatttgcaagagttgtactgcttgtgtatcatactgtcaatgatttctaactgcgtgattcctttgctatggctgcagcggataatcagttgatattcccaaatgtcagtgaaattgctgtcaaatggatcaaggcgaaccaagattgatttagtgaatccttttgtgctgaagttttgacaggctcagggaactcgacagaagattagtgtgttggttagagacatattgagtgaaatttttagttcagccgattctggaatacagtttcatgtttgctcagctgtagagtggctgaaaaatctcaaattgtcagggtgttcaatgggtgtattaccacggtttacgtactttgtgaacagggttttctgacgaaaatattggtcatggtgacaattagtattcattcctagtatggattgatggcaagaatgtgcttaactactgaaatatatactgttcaagataagtgaactttgacgagtgttctgaaatctgatgcatggtgttctgaattctgatgtgtgttagaatatgcatggtgttctgaattctgattagtgatggcagtaactgaatctcctgaaggctgaagcattcagggcgtgtccctgtccatctatttgggaatcctgacggtgccaatttgcagatgctgcatgctgtattgctgtgctgaatccagttagttgcttgagtattagttccaaaacttaagaacaaccgggcgaaggactgatggatttccaccttggaatcctaccaagtcctaactctgtaaattcacatcttggaaaagaagtggacagactctaatttcaccctgcaaattgacttctgacaaaaatattgattgaggtgacaattagctatgtctagtatggattgatcacaagaatgtgcttaattcctgcaatacattactggtactgttcattgtaaactaggtagaaatatgtgtatgattgagctctgaagagtgatgccagtaactgaatctcctgaagtattcagggggcgtccctgtctttcaatttgggattttggacggtgctagtttggagatgctacatgctatacgtggaatttagttagttagcatcctatccctccatcacaggaaatctgggattaaccgcacaagaatttaatccgggtcaggaatgacaagtatagtaagaaatttatgatagatacaacatgagaccaggatttatttcgggccgggaaccaatttactcatgataggcacaataagagatcaggaatcaattcactagttaagaggtataaaactttttgttgtacctagataatataagtaaattggttcccgacccggaataaatcccgatctcttattgtacctattataaatctcttgttatacctatcattcctggcccggaacgaatccttgtgtaaccgaacaagaacatagcatgatccccaatgctgcgcatcttagcaaacttgtgcttatcattatcaactaaataaggagtataacacataatttcttctgtaaatcctcagggctgcaggaa

SEQ ID NO: 68843 - DNA, 15877 bp, Oryza sativa
  unsure (1)..(15877): unsure at all n locations
ttcctgcagcccttgactaaagttaaaacatcttataatctgaaacatcttataatctgaaacggatagagtagataacaaaccctgactatctttgtaattttctacatttaccttttataatttgctacatttatgctcattggcacgatgtatatatatgtcgagtaaacgatgtgtagcttggtctgatattggtatgatgagattcagtggtatacaaggatgaaaaagaattgcaatcttcggggtgttgctcttcgctagagtttaacgattgtggattcatggcaacatatgaactgccaaacacatgagaagattttacaaattagctctgagcttggctcgttgttctttttacttcatgtcatctagcagcacaaactttatatatatatactccctctatcccaaaatgtttgacgcttttgacttttttaaatatgtttgaccgttcatcttatttaaaaaatttaagtaattattaatttttttcctatcagttaatttattgttaaatatacttttatgtatatatatagttttacatatttcacaaaagtttttaataagacgaacggtcaaacatgtttaaaaacgtcaacggcgtcaaacgtttagggaaggaggtagtatatatatatacgggttacaaaagaggtgatcatgagcaagcaaacagcacaaacgcatctccgctgtttgctacttcttcatctagccgcccgctgccaccggccgcaccctccgcccgccactagccactccacccgcatcgcgccgcctgtctcgtgagagaggagaggtgagagagtggagaggaaatacgaggagagaaggtgagagagagatgagtaggtaaggatgaaaaatttgacagtgttgagagggaaatgagtaggtaactcagactttaggcggatccttaagaggcccaaagatgagtggataaggatgaaaattttttaagtgttgagagggaaatgagcaggtaactcagactttaggcggatccttaagaggcacatctatgaaaatatattttcgtgtgtagtcctctaaaaggtctgcctacaaaaataggcttattttgcgtgtggacccttaagaggcccatatgtgaatcgatttttgcgtgcggtcctcttaaggagctgtacacgaaaatagaggatgatttttgcatacgcgaccggttacggtctgtctgcaatctaaagaaggtctccgttgcaatctaaagagggtctccgtttaaaaaaaatatttatgtagtagtggttggtatgagctaactagaaagtttgcttagctgcaattagtagtagacgagtttaattcaggagatgttcagttgtactgctaacatttgggtgataaatctgaatcacgtaattattgagccgtatgtcatgaactgatgaacatgatgagcacgttggattaattttttttaataatggagcacgttggattaattctgaatatgttttgttttatctatggggttctctgaactacttgttccctgcttgattgagaaatgagaatggtaaagtctactcaacttagcttctctgaaatatcagtgttagtatggggccgttttaaattgggatttacttagattctagcagaaatttcagaatgtgtgctttacggaaataaaatatgagaagcagctctaaagcctgtttggattttattttcagattactgaatcaattcaaatatgcaacagtatgaattttgagctttcgaacttcttggctctacattttgaccttgtactagtatcaactgtggggtggggtctataggcctgtttagttcgcgaaaagaaaatttttgagtgtcacatcggatgtttgaccggatgtcagaaggagtcttcgtacacgaatgaaaaaactaattaatttcataactcgcttggaaaccgcgagacaaatcttttgagtctaattaatccgtcattagcacatgtgggttattgtagcacttatggctaatcatggactaattaggctcaaaagattcgtctcgcgatttcccccctaattgtgtatatttaattctccatatatgtgtttaaagatttgatgtgatgtttttgaaaaaaaatttagcgaactaaaccagcctaggtgtgcttggcactgtacatgtctgccgtagaagtttgctcagcttgcaattagtacatctaggccctgtttaggttctaatttttttcttcaaattttcaattttttcatcacatctaacttttctacgcatagaaactttcaactttttaattatatcgttctaatttttttaaacttctaatttcgacgtggaactaaacacgggaattccgtagctaaaggcacgagatgcgctagtttaatgttggcgtgatctagacaggaggtggccagttcggccaaggctgcgacggcgccgccacgtcatcttcgccggagaccctttccatctgacctctccatccgtaataagtatcaagttcatgcatatattgcatatatacatgatgacatcaatcatggagaccacatccacaaccgttatagtaacacttagctaaaaacacttacaagttgatcaaacaaccaaaacttaaattacaagctcttctgttctgtctatggggaggacaggtggccaggcaggggctcccaatgcttgcaagctagctcctaatttcatcttatgagttaattcctacgcttatgtgcgataaatccactggcatatactaagaacagaaaattagcaaggaaacgcatcctccattgtatcgtaaattcttcatcagtactgcaaagcacaaaaagagaaagagagagaaatgttatgagactgcaaaatttgtacttgagcaacataatgaacacacaatcaacatagaaaaaaacaagtagagcgcatgggctctagtatatgatttacttactttggctctggagtccttggatgccaagattgacgaaacgaatggctgtccttgatgatggaactggatgaaaaaggtatcttagccccattaagagaattcacaaatggtgtactcgtgtggttggttttagccaaggccatgccagttcttgctacctgcataataaagatgaaaaccacaagttaaataagcaaggaaaactggccagtcacatatgacatgtcgggacatgcattggtaatcaacatgatgttgaattgccacttgtaaaattcgggacatttaactttttaccacttttaagatgtaacaattaaggatttgccactcgaagacttaaagtctataacatgtgcatcattatgtgtctaaggtatgtgggttcagtggtaaatctttaattaccacacctgtactagtggtcaatagttaattattccgatgatcaaatattactagggtttaatctgtttgtcgtactgccatcataaagcctaagaaatttcatgaactactacagtatatactacttaccgatgatctgcacagcagcggcgtgaatttcttggacaggatgcggatgccggacgcggcggccatctcagcagtcgatccgatcaaaaaaaggattggattttgaagagtattgttcttgaacgaatcannnnnnnnnnnnnnnnnnnnatataaagaagggctcaattccgaatccgaacaatatttggaagcgaaaaaaaaaggaaaaaactactagtgtataattaattaggtttcaattattgtaaactcaaaaaataaatttatttatatatttaaatttaaagaaaattaaaagaacgagacgaaactcaagttttgttggagccttggaggcccaaacacgaagaccggcctcggcccaattcggactctcccccatctcggcggcggcggcgatggcgtccaccggcgtcaagctcatcggcgagtgctctactctctctctctctctctctctctcgctcgcggctctcatgctcctacctggactgacccggccttcttctactcctcctctcatcttcttctccatctccggcgccaccgcgacgagcagacatcgccgtcaacttcaccggtacccacctcctcctcctcctcccgactcttatctcgtttttcgcgtttcactgcctggctctcacgctttctactcgcgtcttggcgtcttgctcttgctgctgcgaacgaactgaagatggcatgttcaggggcatctaccacggcaagcagtgccacgccgccgacatccccgccgtgatcgcccgcgcgtgggcggccggcgtcgaccgcatcatcgtacgctgctttgctgccggccattccccctttcgcttctttcttgctttgtttctactttcttttggctcagctttggtgtgcttaatctcttgctttctttggtttggtccgggcggaaggtcaccggaggctcgctgaaggaatctagagaagtgctcgagatcgccgagactgacggtgagctcagctgcttggatgcgggttgttttgactatgttatgcttggtgccttcaaggtgtttgttgtaatgtgcccgagaagctgtgatgtgcttggacgatgcagggaggctgttctgcacggtgggcgtgcacccgacgagatgtggggtaggggtggattgtgtatcattcctgtttcattgctggcatctgagattggcacatgcctttcgcgattggtttatgtaattagtgctttgttgaatgctaggagtttgaggagagtggagatccggaagggcatttccaggcgctgctggctctggcgaaggaaggaatcgcgaaaggcaaggtgtgtgtatcacttgtcctgtaggtctattgtgtagtgaaatgtttcttttaatttcacccggggatcccctcctgagtcctgaatatataatatatttggcatgtcatttttgaatgaccatgcaaatagttagaggacatatagggcggcagaaagtacctgtttccatatagaaattacatgtcaaccattgggctttagtctcactgcccaaaggttgatatgttaaatgcattgtcgtagcagtcttgttcttgagggaggtaagctattgaagatcacccattgcggtgtttctagattctccagaagaatagtaagaagaaagtgctgaaatgctgccgtggtagtgcttgatctgcttgtagacttcccaagttgtgtcctatagtgaaatgttattgcaatcttgccatatattttgcttgaaaataattgggctcactgaattttgtttgatctgcttgtagacttcccaagttgtgtcctataatgaaatgttattgcaatcttgccatatattttgcttgaaaataattgggctcactaaattttgtctgtagttcttatcctatcttcctatatagttggtacccactaaggagcatttactcctataaagcaagacatgcaagaagccacatcatcaataattctaagccatcggatcacattagtacatagttatcagctgttggatcaagaagctactcatccatctaatttaatcattgattactcatccggtcatctccctttagatcataatcacacgtgacattgttatccattcttcacataatactatgttttctcctcccaagtcctccaagataatggaaacttatctcctttatttaatacaactcaaattattgtataacatgtgagttttgtttttgttataaacaattggataacatagaataattaggcatcattaacccaaacctattgttgaaacaagcttgagataaaagcaaagaggttcaaactaccctaattatgacgatatccagattgtgcaagaaaataacttccgtatatcataacaatacacaatgatgttttaaagaaaaataaaacatgaattgtttgcatattttcaagcctgagaaccatatttctctatctcagattccctggtggtgttacacactccttcactggaactgcagaggaccgtgataagcttctttcctttgaagatgtttataggtcatctccctccctccccttgatgttacatatttgcacgtggtgcaccttgataattatagaacttaagagtaccacaacacttctatttgtagtcaaagttcatttcaatttctgctgcaagttcgttcttttttggtgaagatctccatttgggcaattagatgtgaataaaaatattagtagcaattaaaacgttttcattccattataattcagttatgtcaggtaaactctaataaggttattgttcagtaagcatttgactggcctgcaatgcatgaacacctgaagttattatttgcttttcatgctccttttacttggttcttttcctgaggaaacacagtagaagtaatgctcatcattctgagaacattaaactattttgttattaccacatgcttgttgaaatgtcttacttgactaataaaatactgaccattggcagttcaatatgatgttttgcagatatttatttggttagcattttccatcgatgcagaatcatttgcccagattttaagctaaatcaatttaaattcttatcataatcaatcatgaatctttcgatggaacggaaattgatttcatcaaccttttcttttgtttatactttacacttgcacctaactttttccgccaagaaaattgataactgaagatacatcaatcccaggcaagttcttgaggttgtagctggatgcaaaggaatttctgacattgaaggcttaagtaaaactctgtaccacaacacgtgcaggtaagctgtccgtgcgtcatgccgaaactttttgctgtctggtccaagtactcatctaatgcagtcaatttctctaaatttcacgagtaattttgcccttgatgctacagctctgcacgtctccaatttccatcagatcatgttattgagctcaatctttcatttctctgccttgcaggttcttcttccctcaggacctggatgcttctgctgatgcacagcttgagagtggtgcggctattcaaaatagctgatgggacatgacagagcgtttgctacttaacagtttgctacctttttttgcttggttaaagattttgtactttgacaattgccaaattggcatgctatgagagtgtcgttcatgttctacaaatgttaataaggaagtgaatctccactatatctactataactgtcaaattggattactcaagtatagttatattctagaagtaatggttttctaaaagtagacaaattgaagaaaagtacagaaacgaagtatcaccccaatttattcaagtaataggtacgccttagtgaatccaatattttacttcatattacacagagaacatattaactgaataaatataggaagcaaaacagttgcactttagatttctgcacaatatattacagcaataactgaaactcggagcacctctatgtctaataatattctattgactatggctcatatcccattttagcatctcttgtgtcaaaattttcaattggacaagtacaatttagattggaatggcagaataagtaaatcagagcaccacagcttatagctgtctaatttgtaacaattaattagatactaataactggcagctgtctgcaagttgctctcttccgttgctctcattgtcattgtctaatttttcttcaatctctgtgaatttgacaaaaaaaaaattcatagattgttacatggttaaagattaatctccgacccaatcaatcatcatcaagacttcttcaactagaaccagaagaatcctcttgttgtataattgcataaaggacacaacacaaacacaagaattgcaggaagagaccctctgattgtgatgcttggcttttgggctcggatagcgctagttccaatcacaaccttagccgaggaggggatcaggagagatgaggggtaggaggatctcacctcagtggcgatcgggagctcaggcctgccttgactcggggtgacacgcaccacctcccacctcagcgtcgtttcgttgtcgacgtcgccgtcgacggagacgccagggcggcgagccaggaaggtctggttgccgcacaggtagcgcccggacttgtcgtgcagaaggacgacgcagccgccggcaatgtccgggccgcgcgccacatgatgacaccgacctgatccagcacgtcgcggtcgcgctgtgctgcctcgagcgagcagcagcggtcgcgctcgcggtcggggccttgggggagtcgggggacccgaggtagcggccgtaggcgccgcggaggagcacgtaccgcgtggggtgccccccggcgaccacctcctctacggcccacaccgcgttgtgcagcgaggcgccgcccccgccgcgcaggttgccgtggtagacggaccgcccgttctcgtcggcgtggaggtacgaattgcagccatcgacggccgccgcgcgcggatggagtagtacgaggactccatgatctggtcggagcgacgaacgcgcggtggcgagacgtcgcgtcgcgtcgcgcggggaggaagagatcgagcgatcgcgcgcgacggcgatggccgccgcacagggggtggcagcgtgcgcgcggtggcgaggcgtggcgtggcgtggggaggaagacgagagaggaaactagggagtagccgtggaggaatttggtggcggtggatttgaaggcgtcgcgaggagaaggacggagacgcgcgtcgcggtctgacaggtgggcctctggtcaatggtcaacctcttcaatgacgggtgggcccgtgggcaccgtggccacgtaaacttgggggcgacctgcaaaattcatgcaaacgagtttctgaacctgttcagatcgctgctgcaatcaagatgaatctctccagtttcaaaagagtctgaactctgaagtcacactgtgtctgcatgctgcaatgtttcaaaaaaaaaaataaaattgaccaccatcatacaaatcgctcaagataaaacgcaatatactctctttaataatgtcaagctatcggtctgcatgtcaatagtgaggattcggattcggattcggtgactttgcgtgcatctcggccgtccaaaacgaatccgaacggctgctttacttgggcaaaacaattgccgtttcagcctaacaggaggccacacggcctgagacgtgagtggggaggcaccagtgccgccgccgcgaccggagaggcgctaggccgccctgccctgccgccgcgaccgggggcgcgtggaggcggctggccggcaggactgatggcgcgctgatgcaggcgggcggggccccagcccgagcccggcgcgtggaggaggccgcggtgctcctgccggccgttgggaacacactccgcccgcgccgcacctccaatttcggcagcctcgactcgttgatggagttcagcgtccaagcccgcaccggtcgaccgcccacgtcgtcgccggcgaggggggacgccgtcgcacggcttcgtccagtggagaacgctgcaccgtttcctgcgcccgcgaggtgtttgtggaaatgcccccgaggctgtatggttctgtattgtgaaatgcccctgcccctgctctgtggttctgtattgtgtggttctgtgttgtggaaatgccccagtcctgccctgctgcctgggatgatgcagactcctaattggaagtgaattgttattgtttggcattgtgagtttttgcaaattgattctgtaatcttgatttttgtcataaaaaaaaggtgaaacatgattcagcagttctgatctgctgaacagggatatatgagaacctggttgcaaatgtctaatttggtatatgagtgagcatttcagtaactgcagaactgcagattgtatgacctcagaacactgcataataatgtggcaagtttttacttataataggagtatgtgagctcattaatttcagctgaaattgaaataagtataattggagtatgtggcaagttttatgtccattagcaaatatcttattcttcaatttttccactgaataagtgggaaatgaaagcagtttagttacttgaatcaatagaaaggaaatgaaaatggtggcagtgacatgtgcctattgaaattaactatagattgaaggaacattcatgttctgaatcttccaaatcagtgaaaggaatgtgggggcgccagtccatcgtagagcattgtaaattttgtgaaagaacaaatcagaagaattgtttctgaacctgttcagatcgctactgcaatcaagatgaatctctccagtttcaaaagagtctgaactctgaagtcacactgtgtctgcatgctgcaatgtttcaaaaaaaaaaaaaagaccaccatcatacaaatcgctcaagataaaatgcaatattgtcaagctatcggtctgcatgtcaatagtgaactatcctagactcgctgagtcatgtgttcttcaccttttgatctaacaattggtttagggtagataatcaccgtaacaagtaaaagcagctactacctaactagattccacatccgacattactaaacttcaagatattcagttactgtcgtgacagaattcagaacatctgacaatactaagtgtcactttatcaatattcctgtcagaagtgaatttacaaagtgaaattagaatccgtccagttcttttcaaagttcctagatattttcgttaagcacactggacaggggcatgccattactcatcagaattcagaacgatggtcatatttctacctagtttagcaagaactgtaatacatattgcaggagagttaagcacacattcttgtcatcaatccatactaggcatgaagactaattgtcaccaaaaccaatattttcgtcaaaaaaccctgtttcacttttaccgggttttcgaagtacgtaaaccatgtaaaaaacacccattgtacaccctgagaatttcagttgtttttctgtcattctacagctgagagcaacataaaactgcatttccggcatggactgaaagttttactctatgcctctaaaaccaacacactgatcttccctcgatttccctgagcctgtcagaaattcagcatgaaaggattcactgaatcaatccctcctccgatgcctatatctcctacgtcacgatgcatccggatctgggaatgtcaaccgatgatccgctgcagccatagcagagaaatatgcagttagacagtgcccaaacagtactactcttgcaagtaaaaaaacaatgcaagcaattctgcaaattaagatactactcggagttcccgactttcgcgctaagcactgggcgatcattttcataacaaattgaaactaccatccttcatatatgcagataataaagacctgcacaggtttcagaacatatgctgttgcaaggaaactctgcaaattaagatatactaggatgccgaatttcacactgaacactggtatgataataatcagaaaaaatagaaattagcacccattctatatgcagataataagaactcgaaatggtttcagacaatccattttaggtgacagacccaccacaacaatagtcctaggccagatcacacaatattaacataccatttagctactactactagttcttcttatctacatattcagataaaatcctattcccaagaaaacataatacaccaattgcatacaattttcttgtgatgcctgacttgcattccatcaacagaaagttcctcacatttgttagcaagtaaaaacaattcctactacaatgttctcttctgctgttctactacaatgttcttcagaaaactcctaactcagcaagtaaaaacatgactgcatttgtcccttccacaaacagtgcactgagaactggaaaaatcgacggtgctgagataaccaaaaggaccagaaaaggagatagtacatggcattcaggatccgcgaatgtaaactcattaaggacaatgatagcacaaactaattatcaatgatagtttgtaatttgtaatttttactacaaactaatcttctctgtaattaaaatgatagcacaacgatgacgcaaacaagttgtaaaaacaaatgtaattacaagttgtgaaatacctattgtattgtttgtgtgattagtgtcccgccgtacgtcgccggctgcggccagctaggtgcgcggccggaatatggcttctgctgcggtgatgactcccacgaagacggcaaacgcgtagagactccatatcggcgggggagacgcctccgtcggtgggcgtgtcggtgatgaaggacgagacgtcgtcgggggcgcgggcggcgtactgggaatgggagtcgccgccgtcgacggtggtggagtcctgaccgctgatgtggaagtcgtcggaggcgcaggcgtcatcgtgttcggtggcgcgggctggagggtgggtgtcgccgccgtgggtaggagagcctgtgccgtggatgggggcgatgtcgtcgccggcgtcgcggtcggtggcgcgggaggcagatacatccatcgatcagatgcatccatgtcgtagtactcgtcgcaactgaggaccgggccgaggcgtggctcgctccagtggttggcggacaccgccgtcaagcccgccgagcgctcccaaacaatgagacgagctccggtctgctcctccagaacgcgggaaaccacctccaacctctcctctcgaatccgccgaaactccggcgaggagtccacgtcaagatgatctagaacccgaagaatctgcgtcccctgattcttgatgttgacctccagtgcatcccaccaagtgaacgcggcgcgtcgggcagccatggacagggggtgagtagcgtggtggagcggagcggaatggaatcgagcgctaggctgtgggagctcgaggcgagccgcgagcgaatggagaagaagaagagaggcagcgctctcctcctgtgttctttttatattgactacggttgacctgngacccacctgtcagagagcaacctgcgtcttctcgcgacgccttcaaatgccaccgcctccctcggctaacaaactcttccacggctacttgcctctctcgtcttcctccccacgccacgccaccgaggagtagccactcgccgccgcgcgcgccacgcctcgcggcgctcgccatggcgtcgagacgtgggacgtcgcgcgggcatcgggtggggatggaggttttcgacgatgtggcgttcgcgcggctgcggagccatatgtacggctcgtacctccacgccgacgaggacgggaggtccgtctaccacggcagcctccgcggcggcgcctcgcagcacaacgcggtgtgggccgtggaggagttcctcgtcgagggggaggacgaggaggtcgaggaggaggcccccgtgcggtacctgctcctccgcagcgcctacggccggtacctcggcgccaccgacgcggcccccttcgaggccgcccgcaacgccgccgcccgcgacgccgccgccaactctgacgtccgccaaccacacgcccgcgagggttgctgcggctgctgctgctgctgccgactccccttcggcttggtggaggccacgcagcgcgaccgtgatgaggaggagccggcggtcgacgccatcatgtggctggcaaccaggtgcggcagcgaagacgtacaagaggatcgcgatgcccgcggcgtcgtccttctgcgcgacaggtccgggcgctacctgcgctgcaacaagagcatcctggcttgccgccgcagcatctcagtcgacgccaacttcgaggacgaagatacgttgctgtgggaggtggtgcgcgtccccccgagtggagacatgccggagctcccgatcgccactcaggtgagctcctccgatccttttcccctctcttcttgcgattccttttttttttttttgttttgtgtcttgatgctgatttcgtcggagattaatcttgatttcttgcaagaactaaccgtgtagtacaatatgtggattgatcgaatttcctactgctaccattgttgattttgtgcagcccgggttcttcgtcagggcgtgcttccccccgccgctgcgggagatccagttcgtggacgaagccgacctcgacaacatcagcgagggagaaaactgggctacggttgagatcagagggaggtcggtgaggctcctgagagagaagatcgcgaagcatgtgggctacgacgacttcacgatgtgcgtcagcgccggccgccatgggcagttcacccctctgctcatcgaccttcctcgccaccgggagaccctgcagatcgtccttgtcaggcccaacaccgaatgtaagcagcctatgttcaatatgaatgttgctgaattttctgaacaatgtttatgtggttctgaattttgctgtgaaagctagtaacggatggcatggagtgggcagtgtctctgtttttctgattctgttatgtcagttcagcactgtagattttccagttttcagtaatttgtgcctgttgtggaatttgatgaaaatgcatattgctggattttctatgatcaacttgtttcacaatgatcatatctgtagttttcagtcatgaaagttcaagcctgcattgtctattcaacttgtttcacaatgatcatatccagcaacatgcatattttccagttttcagtaatttgtgcctgtaggattcatctgaatgttgtagattttttagtgtgaaattcagcatccgagtagcattttaacatgtgaattactagcactgtttttacttgcaatagctgtaattcttgtgtattactctttctaactgcgtgatttgtttggtatggctgcagcatatgatcagttgatattcccgaatccgaatgcattgccgtcagcagaggccacagatgaagacgatcccacgattgagtgaatccttttgtgctgaagttctgacaggctcagggaactcgacagaagattagtgtgttggtatagggtggaattttcagttcagccgatgctgcaatgcagttttatgtttgctatcagctgtagaatggctgaaaactctgaaattttcagtgtgttcaatgggtgtttttcgacggtttcacatactttggaaacaggttaaacaggaccttctaaggaaagtattggttttggtgacaattagtattcatgcctagtatggattgacgccaaaaatgtgcttattcctgaagtatattagtgttcatgctaaacttggtagaaatatgcatgatgtgtctgaattctgatgaatgaacacagtaactgaatgtctgaatctcctgaggcattcaggcttgcccctgcctatctatttgagaattttgatgggttccagtttgctgatgctacatgctatctactatctagttagttagtagttctgtctatacttagctgggtggaccataaaccaattgttagatcaaaaagtaaagtacagaggagagttcttgaaaacataaaactactccaatgctattttctgaagccctaaaacattcaggggttgtccctgtccttctaagagtagtatttgggaattttttttgaaggttagtatttaggaattttgacggtgccggtttgcaaatgctacatcctacatgctaactcctaactctgtgagttcacctatttgacagaactggacagccatattcctgttgtttgcagcaggaactagaacaagttcagaactcgctttttgcatgaattttgtagagacacagtggaattttcagtttagccgatgctgtacaactttatgtttactgtcagctgtagaatggctgaaaaatcctgaa

SEQ ID NO: 68844 - DNA, 3845 bp, Oryza sativa
attgtattcatgtgaggttgcgtagaacctcttacccactctacataaaatgttcatagatagaccacctctcaaactacatcaatcatactaggctatatagaatttagtggagcttcatgtctgacccaatttatcctctaataaaccatgataatatatatgcatttagaaaaaaaaaccttacttttactttatgcttacttttactttcggtgacatattttctaaagaaaattagtctaccttcttttcaatgaagaagattataaataattgcttatagatattacttatgtaaataaaaagctaataggttagaaaattataaaagcaattaatgccaatgaaaaagacggagaaatcatggcatatgttctcctgttaatatttcgctcttataagtatctcaaacttagtgtacgatgcatgcccgcgcattcgcgcgggctaacttcctagttatgtaaatttttgaataaaacgaatgaacgtgtaaaaaagagccaacaacatcatctaggtaatagtactaattttcaagctccaatgtactcttgctaattcaatccgactgcattatccatcgtcttgccacgcaagacagttgtggttgttgcgttttggatgaagacacaatcgacgcttccggtaagtcaacgatcaattgatgagttgtttagtacagcacactactgccactgaaaaggatatgaggacacaaggatgaacaggcggattgcaagctgaaagaaaaataatgcatatttttcctcaaccttgccattctaagcaagaaacgtcaaacatcacgcttacgctgctcacattccgattgggcccaggaaaccaatggggataatcagtgcactgaagtaagccacaggttaatgtgaatatgtgatgttcacatctcacaagatgccaatgaatcaacaggcacttgtacaggatgaattgcatgtaggcacctgtaccgatctgcatctgtggatgggtaagacagtaggccgtgtgggatacttcagatggaggtaggagagaaatgtcgaccaattattgcgtgcaggaagaagataaggttttatatgacagtccaattgtatgttaatttgggaggacgtaatttaatccatagttacttatgcataggtatatacacgtccttaacagctgtaaatcttatcaagagtgttcacaatgaaactttccaagatgtcttgaaaatatattatagtaaatttaacaaaactacagatattttgataaaattagcatagaggtacatatttaagctatagtatcataagactatagatttagaaatgattttattacaagactacatatttaagccattgtgtctcaaaagtttagatttaatattgcattttcacaaaactatatatttttaagatatgctatccctacacgtctcatcatggtaaatttttaaaatgtatagttttgcaagaaaatcgatcatccatctgtagttttgtgaaaaaaaacatgacatcaaatttgtagttttgagatataatgatttaaatctataattttttgataaatatattcttaaatttgtagtttagtgataattttatcaaagtatatgtagttttgcaaaatttactcaatatattaattccttgttgatgcataagttactactcttaactttttgacagaagggattttaaccctacttagttttggtactaaaattgtactggtaatttttcaaacttctactctttttttatgttggtcttcgtgtccataaccaacaccaacagagaaactttcttggatgaccttctcttatttttgtatgaaattctcacggacattaaccaacaactgacttcaaaatagatgacgtgaatatttatatgagcgtcagtctttgcttttgtaccaaacttatgaaaaataaaattaaactaaataacttttctgaggaggaagggaggggccacataaacttatttacaaaaatatactactacacgtttatatctcattaccttcacagaaaaaaaaatactactacacgtttatatctcaaggagagatgtaaacagatactctgttttaagcaaatacgacgatcataagggattttacttaatagaacacaacgatgacaaatgacagtgaagagcggagaagcaataggcctgtaaaggagtagagtgctggcggttgatggaatatctaaaaactataaacaaaaccccaaatagaatcccaatgctgatcaagaggagtgacgacaggcatgccgttaagtaacatggtcacgacggttggcgggacttatggagagtaaaaataaactctaataataattatgttcgatttttaaaatttcaatgacaatatggaggtgaggcagcaggcgggctgtagaggagtatagtgtcaaagccactaacgatttggcgagacttatagaaagtaaaaaagaacacaaacaatagttatgtacttatgttcgatttctaaaatctcaatgataataaagagatgtggtagcggacatgccgtagagtagtaaattggagatgtttgatgatacttctaaaaattatgaaaacgaaacccaacaaaacaatgaactctaaaagctataagacctaatttttaaagttctagagaggatgaatagaaataatggtagatcgagtaagcaaataaaaagtaacaaaggagtaaggggtagcgactgacgtggcttttaaaaactataaaattattagaatcatgggaatgataattttaaataaaatcatgtgtaaaaaatagataattttaaattgatactagctgcgcaattgcgcgggccgcccactaggtgatatatctaaaccattgatatatctatctatctattatattattaaaatagccttgaaagaagacatcacgttcgtggaggctagaaattcccaccttaatcgaaaaaagaaaagagagtacataaaggaatacaatttagaaatatctaaaattcggaattaaaaataagcaatatcgaaagaagagtccagataagaaccaaatacgagattaattaaaattctgaataaaaataaaataaattctgaaattataaaaaaagaaaagaaaagttcaagtaaaaattcaatttaaaaataactgaaattcgaaattaaaataagcaatattgaaagtataagaacacaatacgatattaaaaaaattcggaataaaaaataaaataaaatccaaaactagaaatataaaaaagagagttcaaataagtatgcaattttgaaacaactgaaattagaaataaaaaataataaatattaaaagaataatcatataaaacacaatacgagattaattaaaattcaaaataaaaaataaaatgaattctgaaattataaaagaaaaataagagttcaacaaggaatacaatttataaatagcgaaaattcgtaatagaaaataaagactaataaaagaaacgaccatctagaacgcatgacgagattaaaaatagataattttatatgaatactagccgcgcaattactcgggccacccagctagttaacctgaaagtatacctacttaatagaattatagcatgatatgttaggaacagaaacagctggcttcaaaatatttatatgagcatcagtctttgttttccgtaccaaacttatgaaaaaataaaattgaactaaacaacttttctgaggaggaaggtaggggccacgtgaacttatttacaaaaatatactactccacgtttaagaggaaacttagattcaggcgcccgatggtttgggggaaaaatcgggcgctga

SEQ ID NO: 68845 - DNA, 8397 bp, Oryza sativa
  unsure (1)..(8397): unsure at all n locations
atgaatttagttcccaaatagactggtgcaagggtcttcaaatgcttatccatgatcctagaaaagatttagataggtgtccatgaattatcatcagggtcaattaattatcatcaggtcaattataaaacaacttatttttaaaagaacaaattatgtcctacttgcaacggtaaaattcacggtggtagaaatggcagatgaccttttcgctgccagtgacctctcctaggaagtccccttcagttatctccctatattcaccatgaccttgcctttttagcacttcacgcttctcgacctctttctgttatgcacaggaaaatgaataacttaaaatgaagattatccacacaggttcacaaccttcaagggcaatgtgcagatcagtaccttcagagcagcaattctctccgcatgcaacttctcaagctctggatcctatagttgtagttccacagcatgatagataaaaaggtaatcagtgcttcaaactgaaggaaaaaaaacaagagaaatatagaagatactatagttaaactcacatccaataattcatcaagatcaacctcatcatggcttgcatttgctgcttgggctttctctttagctacaatttcctaacatgttaactatgtcagtatacaggaaaaaaaacaaaaggggacagagagagtagtattagcctgttttgaaagcaagtttgtttttaaaaaatgcaagaggttcaaagcactggaacaagagtgtaaaaatacagtatttcacccccattataacaaggacataaatgaaaatgacccaaacaataagagaagatatagctcgccaatcatatcaaaaggagtgaagaatcaagtataaataatggaaacgagtgatgtgcgtggaggacagttatatccttttgtactatactttcgatgcaaacccccaacagtttgttgctgtcaatatacagaaaggccattttgatagaaaaatgaatacctacaaattttacataacatgaattcatgagagagcaaaaggcatcagaaggtaatccattttcaacatacataagttaagaacacccgaatggagaatgatccactgcaactttgattattgcaaacttgcaaaccatattccaatctaaccacatttataggctgcctaaatgggaggagcacccttgtttttgtgtaccctgaggtgccataaagcattatctcctatccagcatagaatatactggtctctagaccctgcaccatcactctatttgttgtcctggaatacatgactggagctaatccatcctccgaatgaactgtcccccaccccaatgttcccagccaaagattggatcatgctacagcaacaccaggacagagcagtctggaaggcaagacttttcacgtgagctaacaccactcccatagccaaatgcccaaatccaatgcacctgccctttctcaagacaaaaaatcacactgttgtgttaccaggatcatcctccacgttgatctatggttataccttccacaatccatgcctgtggcaaagctgagtggaggcaaatcagacacaagttctaaagataggtgtaccagactacaattcactcccaatcaaaaaccaagatttgatcacgcgctggttccgagatccaggagcacactggctccacggccaccaaccagccaatttcacgacccaacccgctggatcagttttttacccccattacaacaaggacataaaatgcagttgacacaaataagcagagaagattataacttgcaaatcacattgcaaggagtgaagaatcaagtgtgtgcatgaaggacagttataccttcctctacactttgatgcaaacaccacattttgttgctgtaaatctaggaagaatatcaaaaggattacctgcaaatgttacatgacatgcattcgtggcctaagaaggtaacccattttgaacatgtaaaagaacggccagatgtatcatgatccactccaactctttgttattctaaacttccaaaatattatactcaaattgatccatgtttattggctacacgtgagaagcgccattgtttttgtgtacactgaggtgtcataaagcagcatactcctattcagcatggaatacactggtcttcaaaccctgcaacatcaacacaggactggagctaacccatcccctttatgaactaaacctccccatgatcccaaccaaataccagatcaagctaataccacccaattgctaaatgcccaaatacatgtgcctgccctttcccaagacgagaaattcgcattgtcgtgttaccagatcatcttccccgttacctctaccttccacaatccatggctgcaggcctgcagcacagctgagccgagtgctccgcggccgaatcaaccgcccgtcaaccccactcccaatcaagaaccgagattcgattcccccccgctggtgccgagatccatccagcagcacgcccggctccgacaccaacctccacagccaattccgcgagtgagtgagagaagtcaccttctggtagtcgcgggcggcggcggccatgacgttgccgaaggccaggttggagagcgtcgacttcaccgcgtcgggatccatctctccctctcggcgctcgcctcgctgctactccctccgctacgctccgccgcgccttcttcttccccctccgcaaccgcggcgagcgccgccgcttctgctcggccgccgagatctcctcccctccggctccggttcaggtggcgccgcgagagaaagagcgaagtggtgcgtgttgcgttgcgggtgcaggtgaaatcaaagcccgatgggccaaattctttcaaactgttccagctttttttaaaaaaagtatttttctttcaaactacgtatatattgactaacctttcataaaactataaatataaatttaagatgatgtatcgtgatttattgttaaaactgtagttttgtgatatatcattttaaatttatagttttacgataatttaatcaaagtatattttaaatatttagttccgcgataatttaattagttttgtgaagttaattatctttttttcggttatcttttttttaagcaccacttaaaaagttgcggtattggtaccacactttgaagactactgactgagtagaaatttcctctattctggtttaaaaggcgcattcttggtttttctggtaccaattcaaattcaaatacagttttaccgtattgtcatctggtttaaaaggagaattatttgtctacgtttctactcaagctgtcaccaaccaaagtatcaaacacagagcatcaggtattcaggcatccctaccagacaaaactcattgcaaggtttcctaataccagaagcacatattttcccttgttcagatcaccaacctaacatgcacaagaaatgagctcatcgaaataaaactgtgaaaccattcatcgtataaaaatcaaatgctgttgtcatttttcagataggtattcccttgttacaatgtacaaaaaaagacaaacgatattgttgtgcatttggctgcttaaaaaccgaaacgcctgcttcaccgcttaatttgtatcatctcctgtacagctggatagtgccgcaagtcctaaattaaggtcatcattggtataatcatgggctacagattatagaagccccagagacttcagctgttggacatgctccgaagggagagggggcggacaccaatccgcgcgctcgccatcgacatcttccacaacatattcctgtaagaaccagatacagcttaagtgcagaaggaaataaactaaagtcaaagactgagaaataagcggcaaacagaactcaccttagttaacattcgttttgcaagaatatggtagtgtctctgccagatccgctgacccaccatggttgctaccaagacgctgtagaaaatgccgataactgtgaatagtccaagcacgattactcccatgataaagagcaatggtaaccctgcttctccagcaccacccaagcaaccaccacactctccagctgtcgttgcacagccctcaaagcatgtagtgcaatctgtccacatgcaaagcgtaccaggtagatggcaatctgcacacatcctgaaacagaaaagaacaatgagcagtgctgatgaaacaagcatgcagcattagtagcttgttaatacaattgctaaattagttgaagcataccctggttggcagcaacaaagacataactctcgacaaggctgtgccaggtcattccgtactcttcggtcataacaagttatgaagcatcctgataacccaagcaaagcaaaaaatagcaatgcccctgtaaccataagaacaatactcaaatttagtccagattaaactaatatgcgcaagagaaggtacggtgaatcttatagcgagtcttcccacagatttagtgagtatatatgaattttccacataatatctattatcacaattggcaaatcttagttcctcataatataagtaacagagcccaatgaattcacgcagtagggagaatacgacatgcatatcatatatccacttctttacatacttggctatgatacagatgaatatcctagcttgcccaattctccgttcgtttgtgatgaaaggggcagattatccctcggtttccgttagcacgcttttcaaacaactaaatggtgtgcttcgtgtgaaaactttctatatagaagttgctgtaaaatattcgataaaatccatttttcaagtttaaaataattaaaattcaattaatcatgtattaatggctttcttggtttgcgtgcccatacttaatcttcatctttatcacttgtgaacacctcattaacaaagaaagttcaacaactcaaccatgtaacgaacatgtgttcctgattaatccagccatgtgagctacactcaggtagtttggttgatataattggcatttatttattgagccgaacaaagttaatttattggcatttatttattgagccgaacaaagttaactagatgtctataaaactgttcattgcgatgtttcagcaagagctcagaattaatcaaactgaaggcattaatgtaaaaatgggtgaaatgagcagctcatgtcaggagtttcttgttagttatagggttatagcaaattagaagcagaggtgcttggtttcgaaggacacatgcctcgaataagtcacaagcaaactataacatattcaagtgacaacaattaccatgcattaaacagggaaaagtagcttgctctttcctattcgatacatatatcattcactctcatatcacatttctacacttaaattcctttttacaagcccatctcacccatcatacatgaaacaagattgagccattgaggttcatcgtgtacgcactgcacatttaaccttgtaaaacctacagcgcccatgtgattgagttatatggatgcatggtgaactatcatgataattatttcaatcagggtacaatttcatcaaacaatcatgcaaaactaagtgcaagaaataacaagtttgatatgataaagtaatttaccacatatgtaataaaaactaacttcattgtcaaatgcccaggctgtcctcaaccagtaattctgtaatccatcaataaaatgcaccaaatacgctaatgcagatatgacctgaacaaataaataacaaaaaacaaactcttttatcattcattagaataaagacaatcgagaactaacaaagagtatctagagggacttacaaactgcactagagcaaagatgaataatatatctctagtaacgaagaaacgaaatttcaatgttcgccatttcctatcagtgtgaacatgaaccctcaaatagtaaggagctttacaagtggtgcaatgcgaaaaggcaaatccttcctgtacatgagacaaagaaaatgccaagcaaagttagttttcttacgaaacaaagcttagcaaaataacattgacctgccaatttttgtgcaattaaaatatgtatcttgaaagcgtaaatgttgacaaaggcaactctggatactctacgttatgaagaatcatagcttaaattgtagcaaatcgcacctaaactacattttaggcacagcattcatataacgctaaaattagttatcacaacaaatgaggtttaaacatggtatcttatctaccaagaatgccacaaccccccaacttctctcagcgcacagcaaacagcagctcccccaatttattaacagctaacgtgcaaccaatgaaatgggcgggagatcagcggggaggcccgagggatcaaaagcttcataccttcacggctctccagtggtcgaggcagtcgcggtggacgtacttggacgtccccttgcacttgcacggcgcgatgaaatccctccctgcacacacccacacacacacgcaccgagccaacaaagcactcagatccccctcgcacgataaggtcgcgcctcgcgggcggaagggggggtggatctgcgcgtaccgtcggtctcgaggcagatccggcactggaactggtccccggccccggcctcgatgtcgatctccgacggcggtgggatcagcggcgacgactccgacgccgacgacgccgccccccgcgccggctgctcccccatcgacgatccaccgcagcctgcccccgcgcttttacaaccttcctcctcctcccatccgaaaccctagctcctcctcctcctcgcctcgatcgatcgaatcgaagccgacgacgacgagtcgagggagaggttggcggttgttaggtgcggtggtggactagcgaggagcgagcgaggtatagattggtcgagaacttttgccacgcgacggtggcgtacgcgcggtatgatgacgcgtgggggnncggtggttatnttggtttggagtaactncgntnngnntgnntgnntnggtagtcgtacgtgcgggtgagagttgaccagagaggcttcgttgtgattgcgcgtgcggttaatgtttttgctcttttgcgaacggggacttcagtgactgcgtatcaacctctcgcgacacctagttcgcgcggattcgcgagtagaatatgtagcgcgcacttttttggttattatacggtacaccagtggagcagcctcattccgactcctgggcattcagcccaccaacgcgcgcccctgctacagtgctacgacattcgtgccgcaaattacgacaattagcgttaattaccatcattagcattagtctttaaaaagcatatatagttaatttagtcgaaaacttttcaaaaatagtggaaagttttaaatttgaagtggaaaggtttcgaaatttgatttaaaagttttaaattttaagttgaaagttttgaatttcaaataagaagttttcaattttgagatgaaaattatgaattttgagttgaaagttattgaaatttgagctgaaagatttcaaaatttgagttgaaagttttaaattttgagttgaaagtttttgaatttttagatgaaagtttcaaattttgagttgaaagttttcaaatcttgacttcaaagtttttaatatgatttaaaaatttttaaatataagttgaaagtttttaaattagtgttgaaagtttcaaattttgggtcgattttttaaaaatcattgaaatccttgaattatgtaaaatcattgaatgcagattacggcctaattattctggaaaaaatcagcactaatctcgctaatctgaaaaaaaaaaccacgcatcacctttttttcttctggtttccggcttttacttataataacggtagcgctgcgctgtgtgagcgacacgtgtacgtgcgtgccgctaactcatctggcgcgtacgcgctaattagttttcctgtcaaaagtttgcgatgtttttttgtttgagggggtgtttagatataagggtgtaaaatttttactgtcacttcggatattatatagggtgttctatgagatattcgggcactaataaaaaaaccaattacagaatccgtcagtaaaacgtgagataaatttattaagcataattaatccgtcattagcaaatgtttactacagcactacattgtcaaattatggaacaattaggcttaaaagattcatctcgcaaattagtcgcaatctgtgcaattaggtttttaagtctatattcaatacttcatgcatgtgtttaaacattcgatgtgatagggtgaaaaattttggggtgaaatataaacagggcctaaaatgcgaatcaacatgaatctcgtgaaaaaaagtgaatgatcatacttgaaactctactgtgttagatcaataagacataggctctgtttggatcctc

SEQ ID NO: 68846 - DNA, 13242 bp, Oryza sativa
cattttcaaaaatatgtgggtgatttgttacaaaagaatgtttcaattcactacaacattagatctataaatagtgaaacattatgaatacactaggtgaaatattttttgtggaacaaaaaatgaaacgaattcccttaatagagggtttctaaaatatatgggtgatttgttgcaaaagaatgtttcaattcactacaaacattagatctatacatagtgaaacatttttttgtgaagacacgtggcaggtgggggcagagaccatggtggggcccaggcgtcacgtgtcacgcgcgtgggggggggagcgctcgattttttctccccccaccggtccaccgatcgctggcattctcccttttaaaacctctcatcgcaaggaacggaacggaacgggctcgcaccgcacgcacgcacgctcgctcgatcgtcgatgggaaacgagtgatgcgtgaggaaggggcgtcgcaccaacggaaacggaaaagaagggggcctaaatttactggaggcagaggcaatagaagaaggatggtagcggatatgagtggttaaaattaggatcccagaggattgtgggaggcaacttagaatcggtcgcccgatggggagggggaaaaatcgagcgctgatattagcatgacgcatgcgtgcaaaaacacttttaactatttttttctcttaaattatttatccaaatcatgatccgattacaccattaaattcattgcaattaaatcttcaaaacaagactacacatggatatattccgacgaattttttagcttattattgaattatttttaaatgttgcacgatgttccaccaagtatatcggaattgtttcactaagtagatcgaaaatgtttcaatcgtttaaatcgggcgttgtttcaccttatataaaaacaatgtttcagcaaatagagaaataatgtttcagttcactgcaacattagatctctctacatagtgaaacattgtaagtgcactaggtgaaatatttttggtggaaaaaaatgaaatgtattcccttagtatagggtttctaaaatatgtgggtgatttgttgcaaaagaatattttggttcactgtaacattagatctatacatagtgaaacattatgagtgcactagatgaaacattttttatagaataaaaaataaaacgaattcccttaatatagagtttccaaaatatgtgggtgatttgttgcaacggcgtatatgctaaggtgaggcggcgtgtgagctggaggcgacggcatgcgagtgaggcgcgggcgcccgaggcggccgattttttctactggtgtcgggcgcccatatattcttaaatttgtagtttcgtgataatttttatcaaagtatgtgtagatttgcaaaatttactcaatatattaattccttgttgatgcataagttagtactcttttaactttttgagagaagagatttcaaccctacttgttcttggtagttttggtacttaaattgtactggtaatttttcaagcatttactcttttttttatgttggtcttcgtgtccgtaaccaacagagaaactttcttggatgtaactttgtcatatttttatataaaattctcacggacattaacctgaaagtacacctacttaatagaattataacacgataatgttaggaacagaaacagccggcttcaaaatagatgacttcaaaatatttatatgagcgtcaatattttgctttctgtactaaacttatgcaaaaataaaattgaactaaacaacttttctaaggaggaaggtagggaccacataaacttatttacaaaaatatactactccacgtttatatctcattaacttcacagaaatgagataaaaggaaagatgtaagcagatactctgttttaagcaaatacgacgataaaagggatttttcagttttttgcaatacgacgatcaaattagaacggtgggagtagatttgaatacgtcatacaatgttaattaagctctttgcttaaaagcaccacaaatcctgaagcaataatccaagcggagcgatgcttttggaattcatttaacttttgaattaataggatgagtccaaaaagaatttgcaaaagaaaccaggaaaaatagctgatctgaactgcattttacagcacggaaaaaactgcgttttcaccttcatcgctcgttcttcctctgcaatgttcagtcactatttgacaatggatacatgcatcacggaaagaacaaacattacactaacttggttgcacccacgtgaattcatcaattcaaacaaaacgaactcaaaaactgttcagagcgaaacgaacatttccctcaaaattttcagcactactcacgcatcaccatcttcctcgccctccccttcggcacgacgagcatcatcatcgccttctctctcttggccctccggtgatcaacgatgacatgcggcggcacgaagacatgactgccaacgaagaagcttccgccaccggcgccggcgagggtctggccgaatttgctgaatcccgccggtgctctcgcgcctttcgcaccggcagagctgaccttccgggcggggatgtcgataggggaagaagctttctgccggttgccatgctgcttcacggagcggtgctcgtcgtcgtcctcgtcggcgtcgacgagagagtagtacatctggggaaaatccaggtcttgtgctgcatctggccataggatatctgcctcttggaattcctctttgtccagctgctgctgctcaatgcgtagcatcttcttgcttggggtgtaactagaattaggagaggataagcacgtattaagtagtactagtaatatgtacacacagctcgagtgagtgagcgaccagtcatatattttgcgtgtcgtgatttaataatagttggggagggctagaagttattactgcccaagtgcccatagatatcttggctgtctgaatgcgtcattcctgaactacatcatgcgagtcacagttactgaatcagcagcaagtcagcaacgtgtacacgtacgcgggtacaaattaccccgtaattaaccacaacttgcattatattttttgacaatcattcgttagtctcatcgatacgtttgcagccatcaacagacatatatatattcacctcacatttcgaaccaattttacaaaatgtcatcgaggaaaatgtctcgcagatatgacataataaaccaactaattaatctggtcgcgtgaccatttcggccaggccaagtctcgcgcgcgcgcgcatggccgcccgccgcccgcgcggcgcgctagctctcgatgaagccggtcatgcggaggacggagtcgcgcacgcggcggaggtcccggcccttgagcgtccgcccctgccccgagcacatcgagaacgccgccctgcgccgcgccagcagcacgtgcggcggcaccacctcgccgccgcagccgctgccgctgccgccgtagtcaccctccccgtactccgtgtcctcccgcctcgccgtcgccgcgcccgagggcgccgggatctcgatcgggtccgtgaacggacgccgctcctccgcccaagacgcggcggcgcatttcgccgacacggccacgctccgctgcgacgccgccatatcgctcgccgatcgatcactccgcggttacaagcagctagtatcagcgctatgagcaggagcggaaacagatgcgacaaactatcgcacgcgcgcctgtcgaaatctctagccaacctttcgccgcagctggtgcggcgaggcgagagatttataggagacggcgcgagagcgagctggcgcggcgagcggggcaaccaagctatcctgcccataggcgccctaggtaggcaggtgccgtgtggagctgcaccgctttgtgtgacagagaagtatgcggctttgagctttgacggggaagggaaggaataattccattgatcaggctggagagattaacccctaactcagcttagatcaaatgcctttgcgctaattcatcgccaactaatgcgaatcattttgctttctgaaccaaaaactattgcaaaaagtagccgattggcattggctttcggtacggttcaggttcagacgctcttagttttttatcgcttcgtcgcctctattgtttggttgcataacggcgcaagtttactgaaccgcgcgtgctaccaaggtgcttaattaattgaaagataaatcaataatctcgtgtgccttgttgagatcccatgtgtttgtcgtaacgcaaagaaagccagtacactcctgctcccgcgatgttagctgatgattggtttagtgatctgatccgaagtgtttgatttcgtgattacaccgtattcccacgtgtatatatatgcatctgcgctgcatatgcacgttatgatgatgcacactgatgcagacgcctcgagagaaggatttgcacgcgcggcactgcgtggtgcgtgcacaactacacactcccatattggcccccccaaagaaaatgtcatgtgttgcactcaaccgccaaaactgtgacctaactggtattctttagatgcgcggattggttagaggaagctaggtatcccttgtttggaaaattgcacatggctataagcctattcgatgtctggcacgagtgtactgtgcacggttttcatgccaaagttcacttcaccgaccgaaatgagagcttttgctagcgtggtgctttcagtctttcagctatggcctagggtcgatcgatatgtatagcttataactgacaaagggaccggtattgaaagggaaaaaaaatctacagctgaaatcgtctcatctccattattaatgtgttaaactctccttagaataagggaggcaaaattgtttatttactatttatatgcaacctaataaaatgatttcagtggcgtgtcatacggacgtacaacgacagttaattatgagtaaccaagcaacaggcgccagctgcaggtcagataggttgcataacacagctagatctataactgctacttgtagcatgccaaacacgcaactttctaatgagcagtttgattatgacaagaaccatcaaccatacagttcacactcgcctgcccataacgaacttaacgtacataaacgggtttaagttagggatgggagctaaacacgtcgatgtctcagactgaaaagcaaaagcaaaagtgttgtgtcacgttgcttgactcgatgggccggtgtcgagatttttaagcttctgcacgtacgttaataggcttatccgtcagggcatacgtgcatccatagatcgacacacggaagtgcatgcttctgctgaaaatgcttttgtttgattatcctctcttgcatgacacgcccctccatttcgtggttacattgtataaccctgttcatgaattcagattgtgtcagatcatttgatcagtactgatccctagtgatcatctggtcttgtgggaacgactgaaattaaaagatctgataatggggcatatgcagggagcatactaattaagtctggcgatcaatgttcagcaaaccactgatcaagggaactgtaggttctggataaacatgtcaaacaaatcctctgtcattaacgcaaacgcgaaacgtgcatgcatcacgcgtgccgtcgttttcgagtactttatgtagacaagaaccaagttacaccaaagcagccgatgaattttcagcgtcttattactcgcgaacggacaaacctagctacccgacggtccgtacagatgaactcatcgatcgaatatcctgcgatcctgttctgtaagtagctacgtgtcccgcgtcgacgggattctaccgtggcagcgattcaacgcgcacggtgtcgtgatggcctacgctaccgccgtggatcatacacctgtaacgcttgttgcagcttggacgaggggacagggcaaatggcggattggcgcgctcagcctgtggtaatctgcacgccacaggcaccgagcgaggaatgagacggtattactgcgttttggataaggatatgggtaaggattgacgttgaatgattgttagacaacaatgttatgtcaaatttggagcggattagttttacaaggattttgtgggacatggaattttgctctgaacacttaagtttgcactttgcagacaacgacacaacgtatactacggatcctatcaaagagggaagaatatatataagtcgtgttcgctttcttttcgctgaatttatctgccacaacatggttccagccttccaggctttcggctagatttcacttctttcaagcaatgcatcctaagcagtaaagagtaatcaatctaacctaagaatgaatcacgcgacaagaacgacaagagggctcgtcacaacatggacaccgtcgctccacgtatacgatcccgccacgaactgcccgtttacacgccaaccgcctctccctttggtggcctcgatctttatcctgaacgacttcttctcgccggtgcgcgcgaagctgaggctcctcggagacaccttcaccgagacccccatcggctcgaccacggcgacgctgtagcgggcgctgccctggccgacgttggtcaccgtccgctgcacggtgacggatccgttgaggccgtggatggccagggacgggtggttgagctggtacggcggcggcggggtcgccgggcaggggagggagtggtcgagctgcgcgccgccgctggcgcacgcgaagaggaggtagtcctggtacgacgcgtcgtagacgaggcccgggtccagcgcgtgcttgggcctgatgtggcccgagccgtagtcaatgggccccgcgaccgtcccgtccgcatccatcattgggccgccctccgcgttgctcgttgtggctgcgaatcgaatcgatacatatgtacgtgcaaatgggttataacgccggtgagcgatgaacggggaaagttgaattgtactagtcaggacgagacgtcaccggtggtcatgatggccgatcggatcgcggcggagctccagcccgggtgggcggacttgaggaggacggcggtggcggagacgtgcgggcacgacatggatgtccccgacatgatgttgtacttgacgacgcggttgtcgccgtcgagcttcgtcggcgacgatgcctcgctccacgccgccaggatgttcagccccggggccgtaacgtcaggctgcgtaatacacaggctagcatcagctcatagtcaatgtttgccgtaatccgacacgggcattgaaacgatcgagatgcaccttgagaatgttgggctcattcacgttggggccgcgcgacgagaactgcgccatcaccggcgacggcttgacgtccacgacggtcctcgagggatccagcaccgctgtcgggctcgagctggagttgatgtagcggatgatggcgttaacgtcgaccgaggagactgcggtgcccgggagcacatgcgcgtcgacggggacctcgcctccgaacgccggcgggttgccgaggataatggccgcgccgcccgccagcttcacctccaggcccttctccaccctcaagccagtacccctcaagcacacgacgatcttgccccgcaccttctccggcgccagcgatttcggcaggcattggctgcaaccatatcgtagaaaacagtaagatcacattggatttcagaaaatgtgttactaattcagttggttgtgagttgctgtacttggaaacgttagcgggagtgccggggacaacggcgtctgctgcataaaccaacggatacggcttgttgcctggtagctggtacggcgtcacagtttgaccctgacacgcacgtacaacaaaaagaacaagtcaggacagatgaacaagacaaatatttgttggtggacgtgccacgaatagtacggtcgatgttgcgtttagcaggtaaggaaatttgtagcgtggtgtttattaccatgatcaccatgccgttgccgagcttgatcggcgagatgaacgcgcggtcgatgctgctcgcggcgaccgtgagcatccacggggcgaggttcgacacggtggccggcttggggccggagttcccgccgctgcacacgagcaccacgccgcgcatcgcggcgtgcagcgcgcccaccgcgatgccgtcctccgcgaacggcagcggcttccccgtggacccgatggagacgctcatcacgtcgacgccgtcgccgaccgcgtcgtcgatggcggcgagcatgtcggcctcaaagcaggtgttctcgatgttggggttgggccccgggatgggccagcacaccttgtagacggccacgcgggccagcggcgccccgcccgaggccgtgcccggcgcgaacccgccgagcgccgccacgccgggcaccgtgcgccccgcgacggtggacgcggtgtgcgtgccgtggccgtcgtggtcgcgcggcgagcggtacgcgttcgtggtgttcaccgcgccgtacctggcctcgtacgccttgacgtagtacctcgcaccgatgatcttcctgcgtacacacgcatgtacagtacgtacgttggcgccaatcagaatcaggtcgttttaccacatctacattgtctaacctacggattagtattaggcgaagtttagttccaattctttaaactttcaacttttctatcacatcaaaatttttctacacacctaaacttccaatttttctatcacatcgttttaattttatctgaacttctaattttgatgtgaactaaacatacccttagtttgattaaacaaatgtgaactgcgcatgaatcttaggtcgatctgcagagctcgctgatgccgagggaggaacatttgacagggatctcgtttggggcacggtgctaggaaggtgtcacggggtcaccacctaccatgttctgattcgtgcagttgcttcagaggaaaacctactctgctgcagaggtttgtacgtatgctaaggtcacgtctcggtgccgtcccgttgtttgtctcgttgcatgcatgggtaggggtcaatgacaatctgcagtgactcgagaagatgccaagctggagacttgctcctgcgtggcccacacagccttgggttttcgtttggaagtgtatgctggtcctggatggctggatcacagcatgatttatcttgtttttccaaacattttgaaataggaatcagtggtcgaagttgtattcgatcgtatcgatataaagataacatgtttagggatcggattggattatgtttaatctttttttttgtattttaaagacggaatcgatgaaaacaataatactactatgttttagctagctgacctgttgcaggaagagggagagaaggaatcccctccttggcacacccctttccaccgagccggcactggtcctaaaccttcgtcgccgaagctcctcgactccggccaaatccctgtaaaaaaaaaatcacttttcatgcacatccatatcaatgttacccaatgatagcctccttttcttatgcatgtccccccatgttaatagaaaagcaatgcaagatgtagtaagagcacccgtaatgataaagtaaggtgttctctataaaatatgtacatctcagcaatagactagattaatagtaaatcacctcaatagtatgtctatatgggtatctatagctttctaatctattgtctcgtttttctatatagactatctccaggttaatagatagatttgctctctctcttcatttaatctcttccaagtaggaaaatatgctgacatgaatctcttgtagagagcctataaataaccattgcggatgccctaacacacagcaaacaatttttttatatttttttagagaatggtatttttacccggtctctatatctaaccggatatatgctttatcatattagtcaaatcgacgaaatatgtatgatttaattgatagatagacatacatcggactactcaccggagtccaacacgcccacgatgacatcctcgccgccggctttgtcgccgggcggcagccggccggtgtcgtccggacctcgcaccccttcctccaaccccacaaactcccaagacctcgtggtgtgcgggctccatctcccgttactcggaaaggcagacaccacctctgtcctcgctgcacacacagcactaatcaagcatgagtacgagcacaaagatacaatctatcacttgcaggccacatgtaattgattgttttagccactcctgaataaaacacaaagcattcatttcatcatttgtactattactgtattacatacatgtacagtcagcattcgaattgttctcatcatctctgcgtgtcactgtgcgtgtgacatgtacgtacctgacagcgctgtggcctcttcctcggagagaagggccgcgaagccattcaggctgtgcttgtagctgtacaacagcgacgcccgtgcctcctcctcactgttcgatggacagagagcgtgttgcatgattagtttagttactgacttttaatcgaagcaagtataatccgtcaatctcacatcagacagctgatggagctacaggaaagcgcataattagatgtcaatgatggtttttgtataattgatttattgcattattgtttacctgcccttgacggagagcaggaggccatggtgaccggcgaggatttcttcctctaccttcgctccggcatgctcgcccaggtacaccacgtacacctattggcaatggcgagatgaaagaggagttcgtctattcagttcatggaaagtaggaggccggagactggagactacggcgccatcatagccggaccggagaaatgaactgacgatcgattacctggcgtggcttggtgaaggcagctgaggctgtggagaaggaagaggaacaaggaggaacagaaggctcgacgtggccattgaccctcccatcgtcttcttctgaagatgcccgtatcctgctctgtaatttggctgataggccgcttggttaggacttaggagtaggacttcaggtgtttatatagtacacaaagcaagtgctgccgattacagtaggtgtttatatagtagtacattgcaagtgctgccgattaggtgatagataatatatcgaaaagatatgttacatagtatgtatagacggggaagcagagaaatcagaaatggacagtggaatctgaatgactgatcctccggggctgacatgatacgagagtatctttcattttctaaaccttttttttacccgcgtttctagtgctccctatctcgttcattgcttgcaacttggagtagtggtgaacctatacttgggaaaatctctaaggctggattggaccaagcatacactactacagttttctgacactgcaacgcacacatgtattcaccatccactagtttgatgcctgcgtgacagcgtgagtgttctcatcagaaggactgaaagagcgaagagaatcatcatcaggcatgcagtgccttgttcgaaggggaactgagtaccgattgatgctgtgacgattggttgcatcggccgtattggaatacgaatacgatggctcgacgccgagcacgtacgtctcggcgtctcctattgcacatacttctctttgggcgtccacatcgccctttttgtccagcgtcaggcacgccgcacgctcgcaaagctacgatcggagacggtttggtttggctgatcggtgtttggatagatggaaaccgaccggttcgtcgtctccttctatatgtgccatactggcatgcgtgtctatgtatagttgacccgatacgaaggctctctatctattatccgggctgatcaccgggcattgttcagtggatatagacatgcaggagtcactcagagtgatatggccgctggtccctcgtcacttagcagtgcctatcacctatctttgacaagaaggttgtcaaacgtagatggagttgtgcagataaatctaggaggtgtcaggccaatatatggtaagcacgccttgctcgaagtcacttgcatacgctccgtgcaatccttttcaaaacagacaatacacatcgtgaaactactcgctttgtagttgagagtccgagatcaaaacgaccttggtttcatagggaatttcttactaggtcgtaactatggacatgtgccacatccaacctataaatagtccagtttaacagagcagcagagtttgacaacaaatcaaagcatatgcttggcaaacagtagtgttatcttttttttttaaggaaaccgaagtgtttgtatgtatacagaaacacatattttgtacgggttaacacttaatgaatgggatatataggtcagaagtcctaaaatgcttagcattcttgtgaggaataagttcactttgactcccataattagcgaccgaatctgatttgtatccttaaccataataccggatatctcgatcctccaactattaaaatcattgcaatttgacttccttagcggttttggaggatggttttgctgacgtgacgtctacgtggcactgttgatctagtctgcaatatgtgggacctatttgtcattcacacaaaaagagccctactgacatgtggggcccacatttccatcccctatctcattcctcctccctctctctcccttctctctctttatgtttctcggtcatctccagggggatccagagcggcggtggcgggcgggcgagagccggagcagcggtgtcggcgtgagcatgggagctggagcgcggcggtagcaacggcctcatggctcgtcaagtcatgcatcccagccgaccccactggccatatcgccatccccattctttgcccccaccccgcaaccactgcgtcgtccctcgtcactagctacgttacctggatacggcttctaggccgcgtatccgtttcagatacgtgacggatacgggatacgtatcggatacgtccggatacgtatcccgtacatatcagtgattcgatgcagagccgccgtctcgttgtctcccatcccgatgcagtgattcgatgtcgccaccacacgttgggtagcaactgcgtcgtcgccgcacccggcagcacagcacctgctctgcaacacatgcacagccgcacagcatctccgccacgagtttgaggccgggtggcagccggccagggccgtcaccgcccaaggcaagacagcaccagctgcatcgaagcacccatg

SEQ ID NO: 68847 - DNA, 16201 bp, Oryza sativa
cttaactaattttagaccaatataccttgttagtcagtttcttcagagcttcaggtccattttcttcaataaatttatcaagtgctgtgaggaagtcatcggatttaccgaaaaggccctttttctgagggacataccaaatgttaaccatttggtgcttcacaaacataggtctcacataattttggtacacaaaggctgcaccattgaagtatggcaagacaagccagcaaataaagatcaatttcatagatggccaaaaaggaagcctgtagaaacagaagatggaaagacaatggaacagcaagtcagtgtaccatgatgactaactgtaaatttgtccaagccaatggaaaagactcagagaaggactagagcaagtacgaattaataggtctctcttccttaacattatgttgtaatcaccatccaaataaagtatgcaattaaaaaaataacatgggtgtattattccaaaccctacaaacctttcatcacactgcaatggcagggataaaacaacagaactgtggaacatttgtaattatcctctttttaaaaaaacttttatgaagagggactcttacaagtgaaagtagatcagtagtcagttctatgtagaatggtattggatatagtttctactgctataatttgtttccaagaatgattaatcatttatgtttgaaaccctgatttaaggaacactgtgtctttacctgcccagaaatgaaatgctctgtacttgtgtcctgttaactaaacaaagcacacaagtaatcaggaccgtggaactatattgcgttccttcgaggatgttgttcccatcctgggaacacatggacaatcttgcccctgcgctgttaaaaccttttgaaagaaacgtcccacgctccttgatcccattcctcaacccatggacccaggaactttggtgacatatgcacacgtgtcttgctctaacgattgtcagaatgttgatactacatagtgtgaaaatggcaatgcaggtatgcacatcccactagttcaaagatcagggatttgtcaccaatagttcagactaaaacaataaataactctaaaactactagtacaaagtttttttacattaaaaagaccacaaatatcacaagagtacttaccactgaataattgatgcaaatgtgagctcaaacagtgttattaatgagtacatcacccagtatgtgagccattgttgatcatccacaggggatttggtttctattgccttaactgaagcgtacctgtaatagcatcgagttacatttgtgtttaccattacaaattaactttaaaaaaacatgaatatgttgaaacaggataaaagcaacaaacaacttacaacggataagctagtgcaaccaaaggcctgcatgagagattaaaaaaaaagtgttaagctgaaggtaaagtcaaagcattaacaacatattcatagtagcatccaagctagccaggaaattaaaggtggaacggttctaaattcaggataaaacaggtagtattagatggtctctaacatagtagaaaagcaccccttgacaagtcagcaagtcagtataaaattaaccacatcatttcttatattacttttacaaattacgcagcagctaaagggatgtccatattttctaatccaacatagcatactaaaacatgacatcgattagaggaaggtagtgtgcatttctacagcatgcatcggtccacacttggaattaaagaaatcacagtgcccaaaactggcacttgtttctttatgcaccatgatcgctacgagacatgaatgacaatctaccaaataataaagaaacagcagcagattattcaatcacacccattctcctgcatgtgacctcttacatactgcatagaaaggaatgagaaacagctaatggaaaagataattggacaaagaaaacaaacaaactagtattgaaagtggaaatgccgaaaggtcgaactaccctacaattgctccactaccactagcaaaactacaaatcggaaagcaatactagctttttctaaaagactgtgaagaggtcaggatgcagtagaaagatacaccgcactagcagattgaagtgacaaaaactccacatctgatctacatgttcagattgcagacttggtgatctacagcagagcagcccacagcacgtgcatcacaggcaaattttagatttttgatgtcgcataagcattcgggaaaggtgcgggttgcaatgtcagcatcaacggatatgttcttgtgtcaagattgggataagaaattgacgtttcgaagtccaaaacagtaaacgcacccaacaacaacataaaaatctacaaaagcgaggatttggtgacagataaacgaaaaatcaaacgcctttcctccagcagaataaacaagaagaaatcctcgatgttagactgcaatagaagatcgattctttcaggaagaacaagccttcgcaggttaataaaaaggaaaaaaatgtactcctactaatctactaggaaggaagtgtttatttctatttctttcaaatgaaatcgccagttacatcaagaaaagcaagaacatttccgatcctgaaatatccactgaaaaatttaagcattgtactactcttcgaaaccaacattactcgattccaagccgcaaccagcgggggggaaaaaagaacaccctcagcacctcacggaccacaagaatcaagaacagctaccgcaatgctacattgaaccggacgagcaaacacatcactaagaatccacccattgctgctaaaatcatcgccattccgaaaggaaagaacaaaacggtaaagagatgaaccaaaaaacaaagaaccgaaaattaatttgggggggggggggggagagcgaaggcagggcggtgcgactgactgacccagcaagaacatcgaagttcttggcaagaaccttgagcaaagatccggaccccatctctcccccgctcttcccaatcctcccagcagaagatccactctgattgagcaaagaacctcctcgagcgcttcgaatcgggtgggagttcttggaaggggattcctgggagactgaaacctcgcctgctttgctttgctttgcttcctctttcggtggtgctgctgcttttggtggtggtctcgaggggagcaaaatctggagtggagggggaggaggaaagcgtagcgtggtggtggtggatggtggagcagacgaggcgaggcgaaggcgagacgacgggttggaaatggcgaaacggaacggagcgcacgcgtacagaggaggggatttatgcgggtaagcccctcaggatgtgaggatttggttgctggtccactggtggagtggtggtgggctgtcagcttttcagttgttcactcgctcgctatagcaggtctcgctggatgtgaaagtgtgaagctgccgtttttttgttgcggtgtattgaatgttcaccgctaggaagtttgaagtgctgcatgtcggtgtgtttagttcacgttaaaattgaaaatttgattgaaattaaaatctatgatatttagatacggtaaaaaaccacgtatccatatcggatacgtaataggatacggatacgtatcggatccgtacgtatcagccaatttcgcgattttccgaaaaagaaaaaaagcaggatacgtccctgatacggtctgataactcccagatgcgatcaaagaactacacaatcgattcattgtttcatcctggtaatcatctgcgctgcgtattgcctccgtggttctcggctggggctcgattcgcggctcccagcgtcagcgctgcgaacatcgaacgtagcgctgccgtcgtcgccctgtagcgccgccgtcgccatacgcctggacgccggctgtagcgccacctctgcaaggcgttccaccatctctactggacacaacgcggacaccatcacagggcacaacgccaccgtcgctagacaccagcttccttcgttcctcggtgaggaaagttcgttggcccatttctacctctccatgattggttctgggattaactttttccattttcttttcctttttttctgaacgaagctactacctccatcctaaaatgtttgacgccgttagcttttttaaaaatgtttgtccgttcgtcttattcaaaaaatttaagtaatttaataaattttttattaaattaccacaagtaattttatatattttttatgtattatttttaccacaagtactctatttagatctaataaattttgttattggaagtactaatgcagctagcacctccgatttgtctaatcattactcttttagttgtaaaaacatgcatgttttggtttgctctcagttattggcaagttagcagtctgcctgttcattatttgggcttcatagcttcaccaacttgagatcatttgggctttatttccttgctagaatctatacatttttgtattttctgttttatatatacatatatagatgtattcatgtatccgtgttttatgaaaaatgacgtatccatgtatccccgtatcgtgtatccgtatccccgtatcagggtaacatagattggaacaatgtgacggaaaagttggaagtttgcgtgtgtaggaaaattgtgatgtgatgaaaaagttggaaatttgaagaaaaaattgggaactaaaccaggcctattatagcccgaataatgagaaaattcgataccgagatccctgatgtactccctccgtcttaaaatatagcactcttgtacttgatgggacacatactagttcaacaaatctggacaggggtatatctagattcgttttactacaatattactatattttggaacggagggagtatattttattttgatttttgttaacacgtttttcaaattactaaacaatatgtttattacaaatttcttttatacggaaattgattttttttacgtagtattaactaaatctattcttcaagtttacaatagttaaaactgaattaatcatgtactaatggctttctcgttttacatgtgttaactttaactttaactttatcccatagaccgcctcatagagtcccatttgggagagatcaaattgatggatcgatggacaatctgattttgtgatagttattcgagagtataaacaggtgaaaactattacaaagttgaaaaggttattttagaaaagtagtctacaaaattttcttaggaaaattgtgctgtgaaatgtagcgtttatgagtttgggaaacgtgcaaataaacaaccagtatcaataaatgaacaaagtcttaaattggataaattaaatattatatatatatattattaataaaataaaatgtctgtcaaaaactgatatgtgcaatattttttttgaggaattgtactttaaaattggcatgaataatcatacctaatttatcggcgttagtaaaaaagaatggggccatcttatagtttaaaaaactagaagaattatgttgtttgaatggagatgaaatcttgattatgtacgatgtcacatactttcatgtgtgatttttctacggaattcattcattttaaatatgtagcacctaagaataaaaagtttgtgaaatttcttcttatcatgttttaaaaatataatgtgtttttctttagtagtgaaatggcgcgtgaccatttgtcagatggaataatttcagtttctatgttggctccagtgacgctcgcgtattaataccagagtataacaaaaagctgtctacaacatagtatatcatttaataatattaggatgagctgtcatgggacacattaaaaagctcataactttgtggattttttttcagaaaatgttgatggtaggaactgggccttgttcccagaaaattttaccaaaaaacgtcacatcgaatctttggacacatgcatacaacattaaatataaataaaaatactaattgcacggtatgcatgaaaatcgcgagacaaattttttaagcctaattagtccataattaatcataagtgctacagtaatctacatgtgctaatgattaattaggcttaataaattcgtctcgcggttttcatgcgagttattagattagttttttttttgtccaaaaaccccttccgatatccggtcaaatgtccgatgtgacgttcaaaaattttcttttcgtgaaaccctaagaacacaatatctacagaaagggaaatgaccacaagagaatgtagagtctaaactttttagctgcattcgtgtttgtgaaatgtaagtagttagatgcatatgaaatttcatgatatcctagggatagcatcataaaagtaagacacgtacaacatcaaaggcaagcgatgactgcacggatcgatgcagaacagcagattacacacaactcatcaaagaggatgatgatccgcctgtttattctgatcctgatagatagccttgttaattgtgcaaagttgtacagtactactatagggataaggtttaggcagtacttgccaatccaagccatccatcaagaaatgagcgttcaggattgcctggctcgatctcctcgttccttttagctactattccgtcaaaaaatcgaagtcctagctacgaacatcgattggtctctctttttacgtaggggtactccttagtccttgctccttacctgttgattgtgcaaatgtgcacgggagacacttagtgcgagaatactgaagcattcaattaactttaaaatctatgataaattttatatggaaacaactaagggatccaagctcactcttaaaaaccttgtttctgtaggattagacacaagcaactaaacctaccagagaggctaaatggtagattacgtcagtgaaagtgaaataatcgaatcctgatagatcaaaacacaccgcaatctcaaaaaccaatgaaacacacgttcggcggtctatccaacctaatagggtcggtctgtccgaggcatggccggtctgacaataggtgactcggcggtctgaccgtcaatctaaaaaacaacacaataacgcttctataaaaactcaatttctcttaaaccaaccatttggaacaagttgtaaacttgacagaataaactagacaagctaagaaacaactccaccggagggatttgtaaaataataaacaatttaagagaaaacatcctcaaaagtcagctgtctcagaatttcagcaaatctgaataaaacctaaaacttaagtaaattcgaaactagcaagatccaatcaacaaagctttccagatctgatcattgaagtattagagaggttttggatggattaaattgaacagaatcgcagcaaaacaagcaatcacaagttaatgtcaatacccgctcgactccgcgatgccggcgaacgccttcttcgccttggccacccggaactttggtcccccgaccatcatcggcttcaccgccttgttcaggaagtccgcagcggcttcgacggcgtactccaagttcgccttgttgctcaatctgatggaacaaagataacataattaagaaactaattaatggataaaaaaagattttaacacaaagacgcatgcgttttaggtcagtattaccttggcgagatgaacaagggcactggctcgcggctaaacgtcgggtgagagaggcccgccaggttgcagcccacgctaatatacacgggcttgctctcacttagtgccgtcgcgatggcagtgtcgatctgctcgtgcgcgttgtcgaggttgttaatgagcctacatacgtgcgggaggagatggagttcgatcgcggcggcggtggtactgaggacggggatgtggccggcacaggaccccgcggtggcgccgaccaccacaccaccggtctcctccaacaagacgcctgcgcccgccgccgcgccaaccacccccgccaccccggcccccaccacaccgcgcccgccaccgcacgtaccaccaccgcaaccaccgccgcgacaaccacccccgccaacccggctccaaccatcgcggcgcctcctctcccccagtcaagggtctcgtcgccggcgcaattgtacaccatcttagggatccccgtcgcggcgcatgccgagccgccaccgccggaggtcggacagcccgcctcgcttgcctgctccgccgcccacccgcccatccgctccgatgctccccgggagaagagtgagaggggagagggaagaagataagagtgaggatgaggaagaagagagagaagggagagggttgaagggaggagtgaggctaacacgcggggctcacatgggcctcgccatttttaaattattttttgtgtgactgataggtaggtccacagtttttattatttttccgtgatataattgctacgtaagcgccacgtcaatgccatgtgggacgaagaccgagtcaaattagtcacgtagacgccacgtcagccaaaatcgccatcaatactgtcaagggacctcatctggaccggttttgatagttgagagaactgttgtatctaattttctgatggaagaacgaaaatcgaattcgttaacaagttaagggatctcggatctcagatgaacttattcctattattactgggaaatgggctggccatcgatcagacttggtccaagtcgtagcccaattccaacacccacctggtgaatttttttcttttttaatttttttaatatttacataaatattatatcggtggaaagatttacaaaaatagacaatgccgccctctatttggacggcaagctgacgtggcatacggcgtcgtgacggtgccatgtgctcattttgcgcttagacctttgccgaggctaaatgcaatttttgccctgccaaacaagcaattggctagttctttttgcatctgggccccttgccgcccttgcaaattttgcacggaggccccttgccgcccagacagaagacggcaaggggaccacgtgcaaaattcatagcccccaaaaacgtccgtcctgcgcccatgtgccacgtcagcttgccgcccaaataaagggcggcagggtctacttttgtaaatctttccaccgatataatattttttgtaaaaattaaaaaaaaatttaaaatgaaaaaaaaattccccacctggttgcctctccccaagttcaaacttgacaactgacaaagttctgagacacttcgggctacccaaaaacttttcccaaaaacatcacatcgaatctttgacatatatatagagcattaaatatagataaaaagaaaaattaattgcacagtttgcatgtaaatcatgagacgaatcttttaagcctaactaggccatgattagctataagtgctacagtaacccacatgcgctaatgacggattaattaggctcaaaagattcgtctcgcagtttccaggcgagttataaaattagttttttcattcctatccgaaaaaccctttcgatatcctgtcaaacatccgatgtgacacctaaaaattttcttttcgcgaactaagcaagcccgaaatttcatgatatcctagggatagcatcataaaagtaagacacgtacaacatcaaaggcaagcgatgattgcacggatcgatgcaattgaactaatcatccgatctacgatctgattacaccgttgtgttcgtaagaattgaatctttataacaagatctcacatgattatatttgataaaaaattagaaattacttttataatatatctaaattacttaagatttcactaaattacttcttagacccataaaagtaaatttaataaagcctaaaagtaatttacatatattatagaattaacttagaaaaaaaagtaactttatcacgacattaaaagtaaatccgttatggaggtaaaaacatgagtctatatagaaattaaatttaataagtataaattacatcattgactaaaaatgtgtataaaataaacaactcacaacatgaatgtatagatttcttttaataccgtaacaagttacttcacttttgttttaagttacttctacaatatagggtaaattactttcaggcttaattaaattacttttatgactaagaagtaatttaatgaaatctaaaagttatttagatatattataaaagtaatttctatttttaataaaagtatagtcatgtaagatcttgttataaagatttaattattatgatcacaatgatgtaatcagatcgtaaatcggatgggtaatctaagagaaaattccataagaagaaaaaatacatgcacgcacttttgagtatactagtagcaactaaatatgaaattgaggtagctggttatgaccatatcgtagacacttgtagacacgtccatatgttatggcttctacagcacatatttagggagtgtttagttcatgccaaaattagaagtttgattgaaattggaacgatgtgacggaaaaattagaagtttgtgtatagaaaagtttcgatgtgatggaaaaattggaagtttgaagaaaaagttgaaaactaaaccaggcctaagtttctggcaagacggtcaatctgggaagaggaaaagaactgcagcttacctacaaaacatgcatttctctgaagaatcatatcggcctgaactttctctgaaagcaattgctcttatcatttcatcgctctttgcaaattgctcagtgcaggaggaattaccatgaccagggcatctaaagaaatcaaatcaatcctgcaatggttcagctgctgcatacaactgattcacctgatgaagagatagatatcaggtatgctttgctgcaaaacaaacaatatactactagtatacgctatcatgtgacctgctggtttactgaggcagatatcagctaacagcataatcaccatatgcaacaggtctctgtatcatttcaacctcagcagatgactggagctactaccatgattattacaggatgcattatgtagccattaatattacagaaaaacatacggcgagtgcacgactggcatgcgaagcccaggaaaatcttgcgatgcaaccatatgcatggcattctacagttggtaaagttctcttaaacaggagaaacaactacactacaagaacatagtaacacggttccaaccttctcggaattcagatgctacgctaaatactagttattccaataaagtttggtacaatgccaatgctttctgcaataaataccctcttttgcattctcatccagacgaaggccaaccttattacatggcatcttgaaacactgaatgcaccctgctgcttcatagttctacaacaatcgcctacttctgtaggtaaggacagttcaatttgtcagaatggagatggaatacattgccaatatctgttaatcgacatggatctacaggcaaaatgtgccaaaaaggagatatttagcttttattgtgttgacagtgatgtaaactttaaaaaaattaaagaaaatatgctcagtaataagaatatgacgtaaggagggccaggcttttagaaaggtactgaagatacttcatggtataaatacatttacataacattatgttgcttctggtcatattatttgtgttcaacgctagaaagttcaaaatggatagggtactcatgaacaaatattttgtgattcaactatatgtatgcacaaaactaatgtgtatatgtttttcaaataatttccatttaccaagttttccatgttggccgcttataacagtatataaatctatagtagtacaggaaacacaggctaaatcacagttcgcgagtaaaatttcgtagcgaatgtgaaggagcagccttcaactcacagaagttgtgagttctgacttcacttaaatgaataagaaccagctataacaacttcattttgctggaaggcactaaattacttaactccatttttatttggaaattccaatccatcaaccagttcaaaaggtggaacactatgcaccctccaaagtaccaagtatctagccatgaactccataacatagtaaagaaagtataattgtcacaaataagaacatgcaattttcaagaaaaaatagtactgtcggtgacgaaatgagaaaacatccaatgactcaccttgcaatggcagattatgctttaatgtttttgttgcagggttcgcattttagccaaaggaacctctgcacttgcgagaccaacataagcagtttttggacttccgacatccagaattgattcccagttgaacattaccctggctctgaccataatcatatgtaagctctgtcatcggaggaatatgcttgattgcaaagaatgcgatatgtggatatccctcgtcaccatgatcatacaaaactggttgccaaaaaacatttggtgagcagctgtggttcataaagcgagctatgtttccagttcgttttgcactgataattattggcagttgcttaggtgtctcacttgagtcagaaagactgggttcacccagtaattctggtgcatagttccatcttaaattctgctcagaagacggtgtctcaaagatgtaatcatcttctccaatgatactgtttctgtcaataacttctcctgcatattcacaaataaatgtgcctgcccgaattggatcccaactacgaagtccccaacctcgatctcctgtcttaaacacctcaaagtggatctgagaacctttctgtacaactcggttccggcaattatgtgagcatgtacaggaatcgttacactcatacagcataggcatccggctaacaagtatgcctgaagcactgtatggaagatcaccggcatttcgatgagtgcaagagcagttgttatcaccaggaaggcacacacttgcgcaattgcagccttgcatctttctcattgagctgagagaattcctgtagttcagtttagttgtgtagttgaagtggctaggacctttctcatcatccacttcattcacaaggcaaacaggcttgctttctgcaccatatgatatgtcacgcaatataacatggtctcgagaggaaggattctccctccatttttcagtcttcttccacactgctatgccatcaggttgaccaggttctctgagcagcttgtgtttaaacacattaaagccagtttttcctttctccacccatgcttctcttattttataaaggccatcataaatgtatatcttaccagtaggacaagtcaaatctcttacactacgaacaactctgatttgattacctctatgcaaactcctttcaagtgcaagattacctctttcaagcttttggtcatcctttccagacatgccctgtccagtgtaaaccagcacatctgggtcatcttcggtattctcatacacaccagctgacacgatactgatagccacaggatcctcctcattaccaaacttagcagacatgtaatcaatcccagacatgctctgactattcagtccaaccagacacatctctattctgaagtagaacatatcaccaacctcgacacctggaacctctccaatcctcttgttcttatttgcacgaagttcagcactcatcatgatactcccggcctttaagttatgttgctgctttgctccttgcttcacctcatccaactgcatgagcctccgccgcagtgcatcaaacatcatgagtacattatcaacagattccctaggatcatctgaaaacaaagatggcagattcagaagattgacatcaattttcctaggccgtccacgtttccctgttattatttcaccactgtcatcatctatcgaaacacctgagtgacttaaaggaatcagtgcaccatcaggcacacgctttggccgccctctcttcctcttaccatcttctggtaaggtgacagcagaaggtgtctgcaaaacaggctcattatattttgattgaattggaggagctgaagtatctgcaccatcctgtacacgcctgggtcgtccccttttcctcgtaacagattcatttacagcagaagcggtgtctgaaaaactgtactatctacctgaggagctgaaggagttgacaggacagtacatcttgtacccgcttgggccgtcccctcttcttcttaccagattcatctgtggttgctgaaggaggcgtctggacagcagtgatgttacctcctggagctgaaggaaccaaatgagctgaaggaacagaagaatcttgcacgcgcttgggtctgcccctcttcctcttagcagattccactgtacctgccacagctatttgcaaatcagggatgacccctgtgttgtttgctgtaccgttagcaggagcagctccattcaagtgaacagcatatggctgcctctggttggggtctgcaggggcagccggtgatgcaaacattggtggaatactagcaggcattgcctgttcagtgcccccagcatatggtccaaacggggtaatacagacaatcgaagatgagttttctttagcagtgaaagtgtgcagaccaagtgccgcagggaacatgggagtcaatgtgcgcaagggttttgcatcaacaactgctgcattatccatcggaactgaagttgtctgccgagttccagccatggtaagccactgttaatcttttgcaaaacaaaagtttatgccgttatttcctttgtatcttctctaggtttgtttaccagtcatagtttaggttaagctggataggggtaaaaaggagacctatcagtatacaattgagcaagaaattaaagctatgtttatttaatgcagcattttttaagtcatctgttttactgaccaaggagaataaacagaagatctaaaaggaagcttggtcgttcatcacagatcttgagctaaccaactgcaacacaagagatatgtgtaaacatcgatatgagaagactaagaattactaaagcatgataaaaatcaacatgcaaagactaaatcaatagaacatcccattagaagattatcaactagcggaagagattgaatagatattttacatgaagctaagattagaaacagattcctattttgtcgcaacaagttaaaaatagaaataataataacgacacttgttgataattagatgggtggagaccattttgcacgtaaaacaaagaataatgatgcttgttaataattagatcatttaagataaccaaaagtttcctgagaataacaccttgtgactgctatagattagagtcatttgataaaaaaatcactttctagaagggaaaaggaacaagatagccatgcatttacaggatggcaaagatagcgaatcagcacaaggagggtcactaggcatgcacttcggtagtgtataagcacaatagcgggaagggggttgcaccttcccgtgacaactaatgtaggtgtcttttacccacactctattttgtcgactatgagatgagcgcaacagaacacatttaaatatttgtctcatagcagcatactagatagaatcacagccaatggcccctattggacacatgatgcaataaaagccatgaagagtgaaaccgtccccacgcatcactggagtcgaaccgccataccagtgtgtgctaccgcgctgacatatcatcacagctataactgatggtagtgtttcgctattgggcaccatacccactttattagctaattccgtttgtctctatccattcttgtcatccgatccaaggattccaattatgttattccaactcttaaagggggctaagcaagaaacattgcctgcctccccccataaataaatacatatggcgcgagaacagcccacggaggggcatgtcgtcgccttatcccctaagcacattaatggccaaaaccaatctcctacattaacacacataaatataaaaacctacaaacaaagcaccgaaagagtcgcaacgattgcccttacattagctcaatcgcaaaacccctccccgttccatgcatacgaaaccctcggcaagctacctacccatccatgatccccatccagcgacgggcgtgcggccatggaaggatgtggtgaggctcagttcaatcaatccaaaccaccttcatctattggcccataggtaatcccttctctccttggaacccttttccttttcttttttctagactcgataaccacagccatcattg

SEQ ID NO: 68848 - DNA, 5736 bp, Oryza sativa
gaatgtcttaccatctgcaatgaagtaataaatttgttcataacacttgacagagaaagaaaccactgtagatagtatagttgttcataagaaccaaacaataacatagaaagaagccctacagtcccaaattccttatatcctgaccccaaaaatatacaaagcaagaaagcaactgcacacacaacccagaaagacaatgcaacaatacaaataaagaaaactacagtagttgttgagattacgcccaataatagtatgggtattcaacacacaaatctacatatctcgaaattaaatccgcaccacgcaactttcaaccacagaatgcgcggtcagttcaaatcagcacgaactaatcggcatagatacggacccaacgcagtggagacgagaatatgaacaaagctacgggaacagaccgcgtcgaggcaaatcttgatccagatcatctcgccaaccgaaccagccatcgcctcatcacctaaccgccactcgctaatcaaccaagacacataagcaagaaaagagggaaaaataaaaggagaacattctctcgctgcgtcagatcgcactagcaccaaccaagacgacgacgaagaacacaacagctaaggccggccgttcttggacgagagagagagggagaggaggaggaggaggagctacgtacagttgcggtagaagctgacgtgaaccatcgtcgccggaccgcctctcccgcgtcgccgccgccgccgattgctggagcttgggtttctcgaggggaggaggagcgcggcggcgaggagtgaagaggagagagcttttatatggcagcggcgagaggaaaccctagctttagggctaggttaaatgggccgagatttcccggcccattaacgcacgggtgggaattaggcccacacatcgagatcataaatgggccttcggtgcaggggtcatatttacaccgctcgttaaatggcctttttctcgttcttttttccttatttttataaacaacaaaatccgggcattcatcaacaggaggaaacgattccagataatcaaccagagaggattacgatgcaatgctgattgatatggtctcaattctaccaactagacaaggtttacagcttcagggggaaaaaagcatcatcatttcatcaccaactaaacatggcagatttctacattactcatctactggtgtatattgcagaaatatgttacatgatgacatgtcagaacaattgacataggataaacttaggacaaggaggcgagttccattatccttgctttcttgatgaaatggctcctggagactgctacctaatcaaagaggctctctacaccgtgctgattttttttggcccgtaaaataaatgcaatgatcaagttagttgacatgatcaagactgcaacgaaaaatatatttgttgagttcagggcttacatgtctagagacctctagctgcagtaactattcatcctcaaagatcatgaggcagcaaagaggccccatgagttgtgtttcggatatgtgctctgataagcagaggttggatggcagtcacacttcaattccttctccggctcaaatgccacactcttgttgctcttttgtttaagttcatctgaatcctttagtgaaccctgctcttctgagtctttcttgcgcttttcagtatcttcgagtctttcttgcgcttttcagtatcttcgagtctttcagtaccttcttttgttcttttgaatccttcggtgccttcatatcttctttcgagttcgatgacttttgactctatcaaaacttttggtggtttcagttgtttcgaatctttttgatagttttgatagtttcatctgacaaaggaaaggtgcatgtttttatactgtatctaaggaatgcatgaaaagaagtaaataatgcttgcagttgcggggtgaccaaaaagtgaactcataatttccctgcattacaataggcaacatgtattcccccaaaaaatggcaaaatgattcaaagcctatttgttaaatttttgcaattgttttttttcatgtaggcaaacattgtatggtcatagctactacttctgtaattctgtttctatgctaatgatatgcatctagcgtacctggatttcacttggccgtgtagccctttagtaccgagagtgccaatgtggtgcctgtattcagatctaaaaaaggtctattcacagctcacaaagaaaatccctctctctccagtcagatccggttgcgttctagttattcgtcatatcaataagccaaaagaaatgttcacaaagagtgccaactgaggatttgaaattgcaactggatcaaaactagtatctccgcagtacatagaaatgctagcttcattgtctgaatttcagcttgtatacaagcaagctagatagaacactgaagccaagtatcacaccccagaggttgaactctacactttcctttttgctaatcagttcttccctattggcttcatctctgcttgcttcagaccgctgttcacggcactgttgcggtatccatctagtgattgttctctcgtgaacaacaagctgttctaagcaatctggggagctcagttcgcaactgccgctgctgatggtcagaacaagcaatgtcttggctacactgccagaagcccggagagcacatagtagatcagaccacacctccatacgaccacacctattgccaaacgctgcgccttctggaaccacaaccaccgcaaattctgagtgaacgagtgctggatggtgacggtaagacacaaaatctgcaccatactgcaaccctgatctcaccacccagttcttaaatctcagatgcgagtaagccttgtacatctctggaaaggactccgacatggacctgaagtgattccacagttgcttatcactcatctgcttcttgtcgtgtgactcaaccctgatgcagttcagaacatggcagaggtagaagacctcctcagggctaagttggaaccagtgcttctgtgccgcagcaatttcgacggcgtggccaaaggcagcacggtttaggatcacggcttgctctggctcaactccaagaatggcaccgccacctggacctgacaaaactgccacaggctttgagcttatgaatgaggccttgagctcagcaacaatgactgacatgggattagctgctgctagtgctgagaagtccttgccatcgttgcccttcttccatcttggacctggcaaatccatatgctgaacccactcgcagaggatggactaaaattgatgcgtggtcaaatgctgtagtgaatagcaacgacaataaagcaacaagtaaacaaagttgtccaaacaaatacctcaagaaaggaagattcactacatgcatcactaatttatcgaacatgttaatttgtaaagcatagatacataaataatctgccaaacaactatgcattaagttatggcctcacgggttgaaagagaaagggaaatggaccgaaggcccgacaacaacttgcagacttgtccactgcgctaagggttaggaattgaggattgctcttctggcgaaaagaaaaggaaaggacagtaaaggctgaatgacttctaaaatgaaacaaaacaatagactcgtcacgagcttttgaaattcacaaacggaaaaagtttctaaaatctggtcatttccaaataattgagaacaatcacgagatagataccacagcagtgccatgaacaatggtccaaaccttacatgggaagaactgaccagcaaaaagaaaaggcgtactagttattattcaaccactggggtgtgtgtaatactaggcttcagtgttctatgcagctgcttgtattcaagctgaaattcaggcaatgaagctgaacatttcggtgtaacctacctatacaaccaaacgctatagaagaagatggcatgaaccctaaccatgaacagaggaggggacatgatcacccctacctctactagtgcaaacatttcaagctccataggatcaaatgccaaaagagcaacctgccttcattcctcgatacaaaaagaacatatattagcaatctatattatcacccaaaccgtcctaaataagcctctacacatctccgaacttgaaacgcactacaccacacaaagtttcaactagagaatgatgagaaatcagggttcgtatgacctcagactcggttgtgcagaacccgtacgtatttcgacagtaagatgcgtatgccgtatgcatcgacaaacacaccgaagcaactacggggagattgggaaaaggaaaaaaaaaatctaaatctatcgctgcgccaaatcgaagcaccaatcaagacggcgacgacgaagaagctaactaaaccgccgttctccgacgagagggagatgggggagaaggtacctaaaattgcagtagaagctgacgtggaccaccgccgccgccgccgccgccgccgccaccgcggattgatttgctcaaccgaggggaggagcgcggcggcgagaggaaaccctatcgatgggccgaacatagatgggccggaatttaggcccacaaaatgatatcttcatgggccttctggcctagaaactagcgggccggcttacgttgctgcatcgcatctacacaataatttctcatttttattacattttttattataacaaaattagaaatttatcagtgtaagagaaaacgagacccacataatcaagagaggattaggatgcactgagaactgatataatctgaattctaccagcatcaccattttcatcaccaacccacattgcagatttctacattactcatcatctactggtgtaaattagagaaatatgttacatggtgacccaagtcagaacaatcgatagaggacagctagaacaagagagtttaaatggcctcctagctacttctaactaactgaagactcttcaccgggctgctttttttttttggcctgcacaagaaatgcaactgatcaacacatcaagtctagttgacatgatcaatattgaaaaatggatgaggtgagttcagggcttacaggtctagagatctctagttccagtaactgttctcatcctcaaagatcatgaagctgctgctccatgagttgtgctccgggtacacgctgtgatactcggaggtcggatgccagtcgctgttggaggccttgagttccttctcgggctccacctcggcgaacgtcacgcgcttgttgctctttggtttaagttcatctgaatccttctgcgacccctgttctttcgagtccttcaacgccttttttagttctttcgagtccttcagtgccttcttctgttctttcgaatctttcgcagccgccttcttatcttctttcactgccttcttgtcttctttcgagtccttcaatggctttgactctttcgaaacttttggtggcttcagttgctttgaatctttcgatggttttggttctttggattcctttgatgacttcgaatcttttgactcctttgatgactttgaatctttccatgatttgccagactgtttagatgatttgccagcctgaaagacaacaccacagataataatgaatttgtcacttattctcaaaatgacatgggttgtgaaacttttaaaagcaatagcaacatgttcacggtaacaactcaaaattgaggtggaaaaaaagcattgcttaatcagtaactgatgaa

SEQ ID NO: 68849 - DNA, 1510 bp, Oryza sativa
ttctgaataatgccatcagtaacaggtttttgatggaattcgatggattttgatgacacttcttcaaaatttgtcgatcacataggagtgaattatctagcgaacgccatttgtaggaaaatgcgctgtatgattggatttggatctttttggtctgaacatgtaaatattacctgacacgctactaaattaatcttaacaactccataatccatgttgcaacttccaatccataaaaacactaaaaacagcatcggtacgagtatcactagttcaagcacactggtacgagtgagaattaccatgaaacgaatccataaaacagcattaaccacaagtctatgccgaatgcaaaaacatctccagatatatctttaattcgagctatctaacataatgccaaaaagtgctaacataaaccaacatattaaggacacaacctgcttgaattctgaaacccagataggcaagctacagaatttgggcccagttactcagcacagaaagttttatgatcgttacggaaacaactagctgcaaacttcttctcattcctcatcttcttcctcaccgtcaccaccaccgccgcttgccttcttctggttcttccgcttcaccctaccaggggggcctccaccgaatgggcttgtcagtgagaagtcaatgtgcttctcagactcacgccctcaccatgaatgatgggatgttgacatttgcctgccgaccctgcccagtgattttgaaactttaatgaatgatcttcagaaaggctatcaacttggaaaaaaatattagcaatagcaacatcacgttcaacttatggtcgacaagtcctctaaaatagtaactttagagtgcattaaagaatgttgtggcagtagcctttttcaggacaatcatgtgaagttgccaaatgttctcatcatcgctgtacatagttcaacctaacaaactaatctagatttataacactgcagcaggcaagtaacgaactacagcaacagcaagtggtgcgtgccaaattgcttgttcaaagttaaacatcacaggtaatatgtacatatgaaaagagtaacactagtaaaggaacattgatgtaaaggaacatcatgtaaagtaacgaactacagcaacagcacgtggtgcgtgccaaattgcttgttcaaagttaaacatcgcaggtaatatgtacacatgaaaagagtaacactctcaaatgcgacattgacaagcccaacaagagtatcaaatgcacgaaaaagactaacttgaaagcatctgcacactcaaatgatgggaagttaacaggagtacaggaccaatactaatatattatgaccttcagctttcagctcatagagcatgtgttgtgcctaaaatgacattttagctctgcctacacaatgctagatcaacagaaatgatgaatatacagtgaacgattactatgagagaatgatacagcttccatgctgctgtagaagaatcatatagaagcatacttgggaat

SEQ ID NO: 68850 - DNA, 20824 bp, Oryza sativa
gctcactgccaccccactctgtcccgctagcttagcgtggcgctggtggccacagtgaacaaaaccagcgccacatagaacaaaaccgtgtgaaatactgccctgtgactgcttgtgaccggttttagtaaagttaagggaccctcgatatctggttttttggttcgaggatgttttttatctcggtgacaagttgagggaccttcggtgtactttttcctaataatgacataacttagctataaatgggcctagtataaagggcccatgtctgggccggcccaatcaatttggatcccatacatagaccgactcggtgacgtcagcgtccatcgcgactcaaactccaagtccctatctcccggcgatctctgacttttcgccgctggtaaggcagtctcgtcgcccacgatcgaaccatcactacatcgccgaacaccatgtcggctgaggaagaagagggtccaacgacgacgacgacgatggatccaaacgacgccgccgttcccacgctggcggctgccgccgtcgccgccggcgacgagaagaagcctcccgccggcaaggtgccgatgcccgacgactacatcgccaccatcctgtcgctgaagagggagccgccgccaaaacctgagtacctgagcctcctctcgccggaggagcgcgagaagcagctggagttcgacgccgtctgcgcgaaggaggacgacgcgctggaggagctgcaggccaagatcctcgccggactcaggaaggacggctactacctcgtcgacgagagtttcctcgagaagtcggcggcgatgcgggcttacgtgagtgaagaatgggccaagatggactgggcaggcagcggcatcatcttcggctactgggactacgacgatccgcaatgcgttcagtacctgtgatttgatttcagttttgatcttaattaggctggcgtttgccatatatttgtaagctagaatcttttgtttcatgttggcaaagacaaacagcgaagtataattattacttttttgttttaggctaatatagtttcgaattcaccacaatgaaaaaaaatactcctccggactaataatacttgtccttttagataagggtgagcttaaagtttagaatatttgattatgaatcatttttaaaatatttatcttttgactatatatacatatatatatatatattagttttaaaaagtactttaataaaatcatatagtatttgttaacacttttatacatcttataatggaaaataatgataaagttgttttttttaaaaccgtactgttatctaaaacgataagtattatcaatccgtagggagtatgatctaatggttaaaaagagaaagactgatcggtagataaagggaaataaattaaaattttgaaaccctacttttcatatcaaaattaaaaagaaatcacacataatcataggtgctatggtcgacgtgtttttataaagctgccaccttattcaagccttaattaatttcagcatacctgaaaccatgtttttcaagtagtaaagcgaagatttaaaccaacaacatggactaaaagtttcacactatatttttaaaatttaagtaaatatgtgctcaacatgtatagggataggattttgtaaaactctagaaccataattcctaaggttatgcatcgttatctgagggtatatacaactttgatcataaaaatacagggtttcctatttttcttttaaaaaaatcagccctttgacaacaaacagatcaccaagaaatttccacatcgattactgaaaacatgcaaaggaagtaataaaatttgcttagacaagtttctcaaatctttatctctactattataaaaatcaaagatgtttttgccggtaatttggtaagttatcttatataagtcggtttttaagttcgatcacttttagaaatacaaatccgtatttgagtcggtttttaagttcgttcgcttttgaaaataaagaaagagtcatataagaattctttttaaaaaaaactcgcatgctaagacgatcatacttctaattacagttcatgattttctaaaaaaattatatccaacaaaattcccacagtgaatttcaccttaactagaccgtataataacaataaaattaaaatagccttcacctattgcaacgcacgggcattttttctagtcttaacctattataaaaaaatatattgtttttactgttcgttcatcgttgcttccgcatccgttttggtttgtccattttccgacgcacacaaccagatcacccatggctcactacaggccctatacggccaaatcagcagattggcaacggcagcggcgccaccaaatccattaaccatcccagctcaattgttacatgcactttgaatcaaatcaaaacaaggcgcaaaggccagaggttgagtttgatgtgattcgatttatttgtcacaaacacgatagcggttcatgttcctcaatcactttctttgctcgatccacggccacgcgccgccggatcgcccgttctctaaagagggaatcgccacaaaaatgatccacattagcacgttacctccgttgtgtgaaaatgacataggcggtgacagcacgagaccacgtggtaatgcagaacgaaacagtgagaccgaacgtcacgtccaactgcacagcttaattagtgattaattaccctaattagcaattaattactaattattattagtgattaattatcctgattagagagtaattaaattaatcaattagaatcggccaggcttcctggaaatgcaataccattcagtctcgcagcctcgccacgcgaaatcgagcggtctcgcagcctcgtcgcataacaccgcacggtctcgcaccgtcaccgtgtgagaccgcccgtgttgttatgcccacgttattttcgtgcaacggttgtgcgaaatcgatggtatatttgtgtcaaacaaattatatctcaaatatttctgagaaaaaaaatgaacaggatattttcaaatttaattcaggtaaactatatggatgttttgatattgatagtaaaagtagaaatatttgaattagaacaaagctagaataacaaaaagagagagttgttttattgtattctgaatgaagttttaaatgcaaattaccagttgccacttttccttgaacctggacgtgtccgaatcgaagcccccaaacatcctgaatcctttcggactcagaatccgaatccgactccttcacaccgaaccatgcatgctatcaatcaaagagacaatctgaagcgagagagcatcaagttcatcatcagcagcagcgtacgtgagatcgatcgatcgatcgagcagatcacaagcaaccgagttcgtcgacatacgcactccaagtgaatactgatccatcatccatggacgcctctgcggtggcatcagccgacgaggcaaagaagacgacggcggcggcggccgccaccgccgccggcgagccgcagaagccagccgccgttgcgccattattggcgcaggggtacgtcgactccatcctggcgttcgagagggtgcaatggccggtcttctccgacgacgacctgaagcacctctcgccggagcagcgccgggagatcgacaagatggccgccctgcacaaggctttggacgacgacctcgccgtgttccaggccgaggtcagccgccaggtcgaggacaacggctgctacgtcgtcggcgagagctacctcgccgatcaggccaagctcgaggctctgatcaacgaagaatgggccaagatcgactggagcgccttcgaattcgagtagccatgagatattgagatgtgtgtggacatgcagatactgatcgatcttgtgatgaacagatgattcaactagtcattagttagtaatccaaaaaaaaacctggtcataagttcattatctagcatgatacggagtatgatatatagtatcagctatatctactgacctgtttgaagaactatgatgctggtaatatagggagatcatgtagcctatattatgaatgaattaaatgtggtataagtatttgcaatcctatcagggtttacaattttgttttgcatatttacgccaaggaggcaccaaaatttctgagatctcggaaatttcggaacaatgtcttttgaaaaaacattagacaatttttgactgaatttgactatacttttaaaaaaatataattaagactgactacacatttttaagctctacatcatgaaataaatttgtaaatgtcccgaagacccgaactaattaatgtagagcacccatttgaagctccgcgtgaaaaaaaatattttctccgtttaagattataagacgttttgactttgatcaaattcaaactactctaagtttgactaattttatagaaaaaagtagtaatatttttaacccaagacaaatatattatgaaaatttatttaattataaacttaatgaaactatgttggtgatgtaaatattactactttttttctatagagttagtcaaactgagagtagtttgactttttaccaaagtcaaagcgtcctataacgtaaaacagagtaattcgaaggtaggaatatatattagttaggcatgaagtttcaacacaaaattatgaactttccattcaaataattgttaatattttactagaattttttagataagaaaaagtaagagagaagtccatcaccagtccctaaacttgtatcactgtgccatcccggtccctaaactcgcaaatcgaccgtttaggtcctcaaacttgttcgattgtgtcatcccggtccctaaacttgcagatcactcgtttaggtcctccaacttgttcaattgtgtcaccccggtccctaaacagaacggtctaaaaactttatattaaaaataattcataactttttcatgtgaactctaatgaagacaaactttatatcaaaattgtagccctagacgtgacctacaactttgtagttgaaaagtttttgaattaaaactgtttagggtcccaaaatattgtttcatgtttatagattttgaaattttaattttaaaattacattttgggacaaaaatgacttaaaataaaaaaatatcaactacaaagttgtagatcgcatcgagggctacaagtttgatataaagtttgtcttcattagagttcacatgaaaaagttatgaattgtttttaaatataaagtctttagaccgttctatttgacccagatgatattcaaatccaagtttagggatcggggtgacacaactgaataagttggaggacctaaacgagtgatctgcaagtttagggaccgggatgacacagtcgaacaagtttgaggacctgaacggtcgatttgcgagtttagggaccgggatgacacagcggtacaagtttagggaccggtgatggactttactcaaaaagtaattataggttgcaacttgaaacgctttccttagaaagtctcgagtaagaaccctataaagtgtagttctagcttcacggaaaattgttttaaactgtcgagtggatgtatgtctgtgtttgctcatcatgttatttccacgctatcaatttctgttattcttcatcttgctcctgggcacctctctaaacaactccttcgctgtagtgacacgtgccgttgagatactaacatgtgggcccatatgaatttaggagtttgcaattttgattcagacaaatttcgtaaatttaggtgctaccgaaatttctgaaatttcagcactttttggaccaaattatttaaaattttaataaattctgattgaatttttataaactttgatcaaatttaaaaaaaaaagagaaaatctgatatttttgaacgagtcattgtcagggattcgaaattttcggaaatttcgaacagaaattgcaatcactagttaggacccacgtatcagtgacgtaatggctgttcctataggcccacgcgtcagtgtctcaccgcgaagacggactatatacgctcatcgccgcgagttgagaacacacagcgcgcgacactatatatatcaagaaggcggagacgatcgaccgacgacgcaacgcacgtttgcccgatcagcagctagcgcgcgcggtcgcttgataggcaagaagcaggggcttatggacgcttctgccacggcggcggctgcgccaacttccgacgaggccgagacgacggcgacggcggccgcagcaggagctgtcatcaccaccaccggggagtcagagaccaccacggtcgccgaggcggcggcagctgaaactaccaccggtgggaagtgttctggcgaggcctgcggcggcggcgacgagcagaagcagccgtcagcgaagaagatgatgcagttgccgcaggcggagatcgacttcatcctggcatggaggagggagccatccccctacccggacgacgaccactgggcgctcctctcgccggagcaactccagctgcgggaggagatggccgccatcggcaaggagttcgaggacagcttcgaggagtttcaggcggaggtccggcgcgaggtcgaggagaaggggttctacgagttcgacgagagctactacgccgatcaggccgagatgcaggctcagctcaaggaaggatgggccaagatcgactggagtgacgtcgtctgcgccgactgggatgacttcaacgaccccaattgctgtcgatcgctgtattaaaattttataacaggatcacatgtctatcatgtcgtgtgattgttgctgatggacttggacagggtgaatctctcagtatctctcacctctataaattaattttttaccataattttttttaacacaaacttggctagattgataaaatcaccacagactaccggtacattattttaggaacatagactagcttgacatatattgagattgacgaaagctatcaacatgacatatattgatattaatgaaatcatcatatatgactcgctatcaacaggtacgtcgtctatcatcgaaagagtaattaaccgtaattccataaatgcaagcactcatgtcaagtctgaaacttgaaccctgataagttggttccaccacacggaacctaaccggttaattgagttacgctcactttgcatcttttaatcttacttactgttgtacaaggatctttcatgttactagtacagttctaatggacgaatttatatattaggatagtgaagaaaaagttttgagaaaattgataaatagattatattagcaagggcatgtctggctggagggccgctgaatgtggatgtcgctctcgcggccaaggtcatcgctgccgtcaccaagccatatatggttcttccgccgcgtcgtaccatacatcgtcccaactcccaagtctagacattgattgtaattttggttcgaaatttcgaaccccaccagcaaatcaatataccgaccaaaattttcaggttttcttaaattttatttgaagttgatcatattttattcaaactgagtcaaaatctgttaaagttttagaaaattttggtccgaaaagtgccgaaaatcctaaaaattccaaaatttcggtcctaccgaaaaatttcgtcgaaatcaaaagtggtgtaaaccctgacggcccgtttggttggagggagtttttaggagggattaggagtttagagggatgatgctattaattgttttgtttggttgggagacatgagaattttggtgggatggggatggggaattgagaaaggaactccctccttttcaatagggcaggtaattgggagggaatttctcctttactttaatcaagcaaatctcagccatccgtttttattaatgacctaatctccaactaaactccctatcaattccatcacctctaccaaacaagatattgagattaaaaatcaaattcccatcttaatctcatcatcaattgtaaactctcaatccctttccatcgagttaccaaacaagccgtgagtcaaagtggtgtaaaccctgagtcgggggtagagtcggattcgaagccgactccgtctcctagctcgtttccgaacacaacggcgctatgtcatcaaggtggctcacaagtcagaagcaacgcagcaaaattgaggaacaggcggaggagagacgcgacaacgacgttgaatcgatctcagtagcagctagcgttccacgtacgaaaatatatggaatcttcggtggcggcggcggtggcagcggcagccgcctccgacgaggcagcagcagcagcagcaacggtggcggcagcggcagctgaagccgccaccggagtggactgtgcatgccgacgatgcggcggcggcggcgaccaccgtggacggagacggcggtgacgagaattcgaagcagcagcagcagccgtctgtgaacaagctgcacatgccgcaggagtacgtcgactacatcctggcatggaagaagagccccttccctctccccgacgacggggagatcctctcgccggagcatcgcgagatgcgtgagcggatggccgccacctgcaacgagttgggcgacggcttcgaggagttccaggcggaggtccggcgcgaggtcgaggagaaggggttctacgaggtcgacgagagctacttcgccaatcaggccgagatacaggctcagctcaaggatgggccaagatcgactggggcgacatcgtcttcgccgactgggatgacttcgacgaccccaattgctgtcgatcgctgtaataattgagtgttattgacatggtaattaacctgtgatcgatgatcatatatgtgttgtgtgctcgatgttttgctgagggagcggatagactatataaatgtatttgcagttatgcagttatgtgagcttaatggtaattgctaacttgcaatgtgtaattacatatttattttcacctatacgcataaaagattgtatgcaaatatattagaagaaagcatttttgaggttacaccgtacaacggccgcatgccattgctaggtgggcgggaggcaagagacgacacaggataaaaagaaaaaaaattgagagaatggaatactaaaaactacacctagaaacaggtgtgacagcggcggagcaccactatcctcccaacagaaccccaaaagccgcggcgccaatagttaaccacaaatgaccttcttaaaagatggaggctagtaccattgaaaccgacgagacagagaggaatccaataccttgaagtttctctccttccacagctaccaagaaaccaagagaactagggagtcgaaacatttacaaagatgttccggttggcaggtcctagaagtcggtcatcaaatctaaagcgtgcaaccgcaagaacaaagggtgaggtcagaggggagagagaattaatgagaggcatgcaacaataatagtttactgccctcgactagtttaaattgccagttcacaatcaatagcaatagtgtcattgtattttttttcaaaccggctatgatattattttcagtgaaagtttaaactgaaccggtaatgataagatcatgatgattgtgtggtagtataacaaacgccatcaattaaaccaggtagatataacaaataactagtacactaattagctgtcagtggttgatgaggagcaatatctttattgggcaagtttaccacaatatctttgttgatttcaacataatgtgaaaaaatatatattttaatttagtcctccaaactttttttttgccacaacaattgacttgctattgaatatgattcacctggacttcgttttacttcctaacggtattttctctatataagttgtattttgtaatgaaatttggtgaggttcatagatgcattataagttacctcctaacactttttagaatttgtttttatcatatccctatttacatatattggaagcaccgagactgatttagacatagaggcttcaaatttctagcaaattatcctaaaataaataaaaaatagtgtggatcattgatatgggtgttatcaatggttgtacaaagttttagcttaaaatattatccaccaacaaagaaggggctaaatactgcagtcgcattcactactgcctcctcaccggagaactccaccatgataggaaccatggcgatcgaggcgccgtggcgattaccgactcggagtcgcaactgaccggagtgtatcgtacacgccgatctccattccagaccgagtccgagttctactagggtttgcgtccccccaataaattcaacgccgccgccaccgcttcctcttgcttcttctagctacagccacaatccccaaccatccgtacgagcttagtagacatctccagagtactccaggcaaggcgaggcaaggcgaattgcagcggccaatcgagcggatcaagcgcatggaggccgagaagggtacgacgatcgtgaagtcggtcaccggtgctgcagccgaggagatcttcaccgagcaggaggatgagctgcaggctctggtcagcgaagaattcgccaagatcgacctgaagagcatcaagttcggcgactgggactacgacgacccgacttgctgtcacatgccgtgatatatcatgtgattttgtgtttctgatggatggacgatcgactgagtcagactgaattagttaatgtctcttactgtaaatcttggaactaatctgagcttaattattactactattagtatgctagtgcgagtagttgctgatcagttcattactttatttttttgcaagtgatttatgcagttgttttatattataagttgcttgaactttttccccaagtgactaagggcccatctggtatcactccagttcttaaatttaacctcagcttcaggaggggtggagttgaagtgaagctgtgctaaacagatcataagtttgtagaaaaatttagcaacactacaacaacaaattagttttattaaatgtaatattgaatattccctctgtccctaaatataagcatttttggacttcgacacggtctctgagatgctactttaatcaataatatctacaaaagtaaaatgttttaaataaaaagagttgtagttcgtttaatgataaatatagtaacatcaaatttacatgattaatctttcttaatttatcgctattaataatagtcaaaatttaaaaagtttgacttgacactattctaaaaatgcttatattttgggacggatggagtatattttgataatatgtttgtgttgaaacttaaaaatattgttatatttttctacaaacttagtcaaactaaaaaaattaactatgaaaaaaaaacaaaatgagttataataaaagacgtgaatattaggaaaggacccaatatcaaataattagaaggggtgaggcttcgaacctcgtctcgcctaccaccttgtggagttagccgaaagatccttgggcgtttctcaaaatgagttataatatgaaaagaagagactacttgctaagagtcattttacggcccttcatgagaaacgggaatgtaccacatttttaagtgtaaaatttgatcctctctattctctcatgctagaagatagcaaatttacactacaatctttgatatctctgtttatatatgtttgtagctacgtttttagctgagtttggcccatttgttttcgtggcacgcttttcaaaccgttaaacggtgcgtttcgtgcaaaaactttctatatgaaagttattctaaaatagtatattaatctatttttcaagtttgtaataattaaaacttaactaaacacacgttattaccacctcattttacatgaaacacttaatcttcatcttcatcttcaggagatttaaacaccacctttatgtaacgctccgcttctcgtgagacgttaaaaactaattcggcaaaatcctaattgcgaaaatttcattctttgtgtgcgagtctaagtcgtgccgtggatctcagtttaaatccatcattgttccctcccgtcgccatcaaaatcctctacctctaaaatgtcaattccgattcaacttcctagatcaattctgaaattcaatcgcctcctttgaatcctcgccaaatacttgtcccgattccacaaatatccgagtccatcttgaatccattccttgacttctccttgagtttcccttgatacatccctaaaccctcgagttcgaatatcagatttgaattcgaatccaaaccctaaatctctccagttctatccaaatcagttttctctgtgaaagtctagttgcctcccccaagttctatgggccgaacgcccctccccagcccattccctccctctgtcgtcctcctccctcctctcgcacgtgcgatgcatgcgcgtgagccgagccaagagagagttctctcgctctctcgtcctcttcctctctctcgctgtttctctctctctcgttcgatctctctctcccacgccagcgctgccgccatcgccgatttcccgctgccgccattcgattttcggctatgccgctcgttcccgcgcgtgtgctcgctcgaggccagccgctcggtcgccgccgcgtcagccctgacgccgcccgtgaccgcgcgtcgcccagccccgactgtgtgcatgcgtccaagggatggaggcagagccctcggcctcgctccctctcccttttctttttcccgaatcagcaaggaaccgtgctcctttttcctccccttttccacttttgcccgacaccaccatccctctgccaccgcctggccgcttgcacctatgaccgccagccgagctagcgtgaccgcagctcctcctccttgaccgccaatgtcggttcttcctccctaaaccgacattgccatctattaaacctagccgccccatctccctctcgttcattccctcgccaccaccgtgcccttgccgccttgctaccgctgtcctcgcctcccccctccatcgcgcgcgctggtgaagccggcgtgcgcgcgaggagctgacgcgggactccaggcgccgtctccttccccttccccggcccgaggccagagagctcgctcccgcgtcatcggccgctcgtcacagcgcccgtctcggctcggtagtgcatctcccgttctccctcctcgctccctctcctctccttagctctgggcagtagtgcgagtagccttccagtagcaagctggcgccgccccgaccgccgccgctgctcgtcgtaggctcgccaccgtcgctgcccaaactcggtagtagccgctcgtcgccggccttcctcggtgtagctccacccaatccgactctagaaatgaactctggaggtcgcgtagatgctcaagtacctaggaatcgagctctcgtcgcatcgtcgtcgtttccctcttttgccgccgccggcaagcaccaccgcgattcgtcgtcgccggcctccttccggtgaatccgagccagtggatcaaccccctttcttctatctcgtcgttccggtgtactccctccctcttgaatcgtcgggtcgtgctcccggtgaagccgccgccgtccgccatccgtctcggccggcctccttcttcctcctctcgccggcccgcgtggctgccacgaaggcgccacgtcggcgccacatcggccgcgaccgggtcaagcacctagtcagccgcccccaccgccctttcttctgtgcgcgcggtccacggagagcccttaggctgcgcatgggccctccacctcttggtccacccgcgtgccgcgccgtgagccgcgtccgcaaaaccctagcgccccgcgccgcatgaacccttccaccgtgcgccgagtcgctgactcgtgggcccgtcccgggacccggcatgatggatccggtccacccggacccatccccctctctcctcccgcgcgccccgcccgcttgggccgcgccttgcccggccatgggccgcctcctcgtgcccgcacccggcccattggctcggccgcgccgcgcttatcccttgggccgtacccgagccgcccaaggaagtctaaatccgatccatccttccttttcttttccaaggaaattaataattccttttcctttagacagaaaatcaaataatctttagaaaatccatatcttctcaaccgctcacccgattgcctccattcaacttccaataattccgtaaaattgagatctatataatggcactactaattagtctaaataggatctttcttttggtcttttgtttaggctttcgattgtttgcatatagttgcggttaccggattttcgtcaatcgcgggatttcttgaagattcgtgaagcacagtgaagaccttgagcaaggcaagtcaccctttgaccaattgctcctataattggaaaatcattattattttgtttgcaacttgcattagtagaatcacacacttaacttgcttggcctcggtttgcgtgccaaaccgacggacctacccagtagtcgcactaattcctgtaggttgttctaccctgattccttgtcgttccacctttgtggtacttcggtatccgtgttctctgagcgcgtataccaactattccacatacaccgttgtttgtcgataatttgggaaatgggtttgagaagccttgaaaacccgacatgtagcgtcggtgtgtttgaaaacaaaatggattgtgaaaacttgcgatgctggggttgtgcctatgtggtactgtcctgtattcacatataaggaccgattcctgtgggaaattcatccgagcatataataagtgcgaccacacgggtgcaatgggacgcccctggctgagtaattagctaatcgggggagccatgatgccaagagacatgtggattcaacggggtggtgtcggggagaaccctcgggcttcctggcacagtatggtctgggacctaacctggtgttggtctgggacccctctcgttggcatatggtaaacctgtgtcggctttcgaaatgccttgtcatgaaagccttaaggtctcccgacgtggctgatctcacgggctgggtgatccgggttagtaatgtcgtgtgggtaaagtgtaccccctctgcagaggttaactaactattcgaacagccgtgcccgcggtcatgggcgtatgtgaggtgtttcctgtagcgtagatttgtttgcctgtgctttgtgaaaagttgttatggtgtgggaatcgttaccagaatcagcctatgtggtagatggatgacctgagtggtcaagaaatgaatctgtgtgattcgggatgtctaccggcatcatagactaggcttcccgagtggaagcggattgttgtgctgctgggcagctggactctaggagttcgagaaaatgaaaaaggctctgggagccgattaatcaagtggaatggctctgggagccgagaagtaatgatctgacccaggaggtcggtacattaccaaatgagctgttaaaaaacatctcttaaggtcgaatcgagacgcaagtctcttttcgagccaaacttagaaagaaataaatcacttagtgatttcaaaatgatttcaaaacaaaagatttgcaaaaacaaccttgcctctcttccaagcttacattaaacacctaaattcctgtgacttgctgagtacaaaagtactcacccttgctctatataaatatatatagttcctccgcccggaagttgaagatgaagtaaagtgaagattagggtttcgtcctggttcccagccatcgcctgtggtgttgggtgttagtccgttggttccgctgctgccgctgttgttggtgtttcctcgtccgcgtcatcggttgcaatctcgggctgttctgagctgcaacctaagttaagataaataagtcctctatttattttaaggattgtaatgattcatatttgtcaccgtgggtaccagcgctatgtcctgggactggtattgagatcgcggtttcgtaggaagcggttctcgccgtttttctcacgacacgctcctgtcaggtgccgttgtacggcggtgccagattagggtgtgacactttatatatgtttgtaggacatatctcgaagattaaattatgtttccatggtacaacgttagtactgtgtattccctctgtttaattttaaaagtgtgatgttgattttggacacaaagtattaccctttttgttatgtttctcacagtagttaagcggttggttggcgagcctatatagatcggtttcttcgacctgttcaagatcgagtccatttaggtagtgttttttttctataacaagtacttcctccgttttacaatgcaagtcattttagtatttttcatatttatattcatgttaatgaatttagacacatatatatctatctagattcattaacatcaatataaatgtggaaaatgctaaaataacttacattatgaaacggagggtgtaataccaagttatttctaagataatgactagtgatactaactgaatacacatagacattttgcaaacactaacagagatagcataagggccaagctgaatcgatcctctcctaattaactaggtctgtcagttttgtccacaatgacagtttagcatgtggtgtgtggcatctgatcgatcagtcctcgaacaggatgccgctctaagttcaccttggcccataattcatcggagagagcctgggcttcttccagctcggcgaagtaggtgtcatcgaccatgttgtcctgcctagctaggacctccacgccgcggcgtcggagtcagggttcatctatcagttgaggcgtttagacgtttgtattagggggtcactgaaattctgaaatttcagtccaaaatttagagtaaattttagttgaatttagtaaaaataatatcgtattgaaaaattaaaaaatttcggtccgaaatttccaacctggtcagagtcggattcgatgtcgttgtgtgtccgagtcggagacagcaggtagcctagctttgacgttggccggaaaataatgtgtcacgcttcagtggttttgcctcaacgaccaatctcgccgcacttaattacgaacctcatgagtttctgtagttgataggcacggaacaaacaaatggtgcctataacgcgtgcgcacttattcggatgaacacttattttgaaatgaaggatagaaaaaaaagataaataagaaaaatacccaagatttagaaagaaatataactgcataacacataaaaaatgctaaaaggaaaaaaaacatctgaatagaccgttggaaaaatataggaagcaaatgggaggagaaactttagaaaaacaatctaagagattagagcttttcctagaaattttccacaaatgatttaaaatcctctaagaatcctatgttttttctaccaatcaaaggtagcctaacaaaagtacttgtaaaaatctaccaatatggttttttttcaagctaaatatttgagaattattagtgatcaaggtttcaaaattttgcatgcataatatttaataatgcaatatatttaaggaattttgctatgtatcactagtgtattttttttggtacgcactcgaaattgtgataatgatagaggtgatgacaacaatgaaatctaacataatgataaaggtttcctttgaaaccttgattgatagtcatttcttactaaatgataggatcacagttcacaagttaacaacactggataaatcactcgcaactcaccagcttgtgacactgaatttaaatatactagccaagaggccatgctttgcaacaaaaaacaaattgagtttatagcttattaactcaatcaagcacgtatttagtgcaagcagtacttttactatttttcttgttaaacaagtaggcgattttaagattttagagagatctagcaatgaaacaggagagaactcattggaggatggtgtaataatatagattgtgggatctaaatatcagtggtagggatggtgtggtaaaatggataccactacttagtaagactataacgcgtgcgcacttattcggatgaacacttattttgaaatgaaggatagaaaaaaaagataaataagaaaaatacacaagatttagaaagaaatataactgcataacacataaaaaatgctaaaaggaaaaaaaacatctgaatagaccgttggaaaaatataggaagcaaatgggaggagaaactttagaaaaacaatctaagagattagagcttttcctagaaattttccacaaatgatttaaaatcctctaagaatcctatgttttttctaccaatcaaaggtagcctaacaaaagtacttgtaaaaatctaccaatatggttttttttcaagctaaatatttgagaattattagtgatcaaggtttcaaaattttgcatgcataatatttaataatgcaatatatttaaggaattttgctatgtatcactagtgtattttttttggtacgcactcgaaattgtgataatgatagaggtgatgacaacaatgaaatctaacataatgataaaagtttcctttgaaaccctgaatgatagtcatttcttactaaatgataggatcacagttcacaagttaacaacactggataaatcactcgcaactcaccagcttgtgacactgaatttaaatatactagccaagaggccatgctttgcaacaaaaaacaaattgagtttatagcttattaactcaatcaagcacgtatttagtgcaagcagtacttttactatttttcttgttaaacaagtaggcgattttaagattttagagagatctagcaatgaaacaggagagaactcattggaggatggtgtaataatatagattgtgggatctaaatatcagtggtagggatggtgtggtaaaatggataccactacttagtaagactaatgaaaagaattaatctcatgtctaattaatggcagcaactaatctactcctaactgcaatgacagatttcttcagttcgtgaagaataaaaaaaatgaaaaaccacaagtttgatcaagatttgaactaatccactcctaattgctgtaaagaaaatgaaaattttcatcaaggtttgaactaattaatcttgatgaacatttgttcaatttgttgaaaaatgaaaacaattgcaatggattgaaacattttaaaaatgaaaaattaaaaaaattaaaaattatgtctgagcccaggttcgaactggggacctttagtgtgtgagactaacgtgataaccaactacaccacccagacaattcgttctagatatttcaacacaaataattaatagtaacttgatctgcctgttttaaaatgggccagtatttgtctaattggaacaattccacaacaactctttacaaattatccagaacatatttttaattgtttttatatagaccagaatacccatctcctacaactcaactgtactgatcagaccaaatcatatagcacaaaattgaaattactactgcaaaataattagagataaaaaaaagggaaatagcgatggagctcaccgccatgacctcaggcaccacaacgatgagcttgccgccgctaccggacatgccatctccgtggccttgccaccgccacgacgagctcaacaccgatgttgaatttgctcgcgctgtgtcttctgacccgccatctctaagacctcgccctcaatgatcgatgtgaccgccgctcctctattgtttactccaccgctcatgctgctgctctcaccattatcgatgctgcttgtacgccgcggacgtgaccaccatcgccgcccatggttgctcgctccaccaccgtccccaccgctacttgctttaccacagtcaacgcccatttcccaactggatgcagttgacgcgaccgtcgctactctttccatcccaacccctgttgctgctccgtctaccgctgccacccctaccacgctctccgccgctgacacgccgatatccatcttacgctgacgccctacgagtagacaaggatattttggttcatatatgtttcaggtgtatagcatagcatgtttcgattttaacatatttacagtggcatcgttccaattaaacgaattgcagtgacattttctaaagttataatcgcatgatccaattaacccaataattaatcttgttttactagtaaattatagtcgctgttcgcaactgcttagccattccattccgccgccaccacgagacggcgaatccccaatcccccggtcgccgccgccgtcgccgccgccatggagaaaaagaaagagaaacccaaccgcaaacgccgcaaacctcggcaagacccctccccggactccggccccggccccgactccgactgctcgccgccgtcctccccgacctccctgcgccgcctcctcgacccctactccaagccccgcctcctcgcgctcctctcggacgccgccgccaccgccggagcgggagccgacgacgaccccacgctgctggcccgcatccgcgccgccgccgacgcgtccccctcccaccgcaggctgttcgtccacggcctgccaccgcacgccgacgcccccgcgctcgccgcggcgttctcccgcttcggccccctcgccgagtgcgacgtcgtcgcgcggcgcgccacgggggcgtgcaaggggttcggcttcgtcacgttccagtcccgcgccgccgcccgccgcgcgctccgcgaggtgggccgcggcggcgtctccatcaccagccgcgccgtctccgcccagtacgccaccgccggcgcc

SEQ ID NO: 68851 - DNA, 911 bp, Oryza sativa
gtcgtcgccggcggcggcggcgacgagttgtacgccgccgtcctcgccgtctcctggacgagcaccttgatgatgttggtgatgatcgccacgctgtcggcgttgccggggtcccacccgggcagcatcggctgcgtgatgttctccgtgttcatgagcaccatggcatcgtccgcgttcgtcgtcgtcgtcgtagagttgctgctgcggttgaggatgtcatggccggagaaccggagctggcagccggcgtcgtcggcgacgaccacgtcttcggcgagcgggcacgcccgccgcgccacccgggacgcgccggcgacgcagtcgccgcaggccgaggcgttgggtaagtcgccgcggcagagcgccacgccgtacacggtgtccggggcggcgccggcggcgcccttgccgaacagcgacggcgtcgacgcgttcttggccagcccagcaatcaatcgctcgaggttggactcgtaggcgctcctcgccgtgtagttggtggcgccgcagttgaaccacacgtccggatcggcggcgacgatcgggtgatcgtggccgacgacgaggacgacggcggcgacgacgacgatgtcgatcatgtcgacgccgccggtgaacacgaaccaacaagaaattaagcggcagagttgtgggaattcgtcttctaccttgaggaacaacgacgatgacgtcactcatgtcggcatctttggtgagacaagcgtatgccgcttcacatgttgattttgttcgttcgttcttctcgccggtaacgagccaaaatagaatgaaatcagatacttccaacaatgtgtgtacgtttattttgatcttggaaattttattgaccagtattatgtcttcctcagtagttaattacacgagagtaccttcacggtctctattct

SEQ ID NO: 68852 - DNA, 2936 bp, Oryza sativa
gtttgtgctagtttttgtggacgacattttgatctatagcaagaccttggctgaacatgtctgccatctgaaatcagtactgacagtgcttcaacaacatcagctctacatcaaaagaagtaaatgctctttttcacaaccttctctggaatatttgggacatataattggtgctattggggttgccactgatcctcagaaggttcaagctataagggactggccagtacctaaaaatcttaagcaattgagagggtttttgggcctggcagggtattatagaaagttcatcagaaattatggggtcatcactaagcctttgatagagttacttaaaaagggtaccttctttttctggtctacactggaacatactgcctttcaagaagtgaagcagtgtcttcagcaagcaccagttttggccatgcctgacttcaaccaacaatttgttattgagactgatgctagtgacaagggtattggggcagttctcatgcaggctggccatcctattgcttttctgagtaaggctttgggacctaaagcacaagggttttctacatatgagaaggaatgtttggctattctcatggctgtggataaatggcatcaatatttgcaatatgctgagtttgctatcctaactgaccacagaagcttgactcatctgtgtgatcagaaattgtcaacacctatgcagcaaaaggccttcctgaaattgttagggttgcagtatgtcatttagtataagaaaggggtggagaataaagcagctgatgctctatcaagacagggtgagtatgatgaacttggtgccctttctgttggtcaacctagatggatggaagttgtggtcgatggttatcaccatgatcctgctacaaaacagttattggttgaattaagtttacatcctgatggggtcaacaatttcacattggttaatggcattatcaaattcaagggtagaatctggctagggaaacacgtggaagcccagcaagctgtcttactctccctgcacaatagtggcgttggaggccactttggtatagctgccacttaccaacgaatcaagagcatgtttgcctggcctggactaaaaagggatgtcaaggcttatgttcagtcttgtgcaatctgtcaacaagcaaaagtagaacattgtaagagcccaggattgttgcaaccccttccagttccactttaggcttggactgtcattagtcttgacttcattgaagggcttcctaagtctgggggctttgatacaattatggtggtggttgataagttcaccaaataagctacgttcattcccttatctcatccctttactaccttaaaagtggctcagttgttcatccagcacatctatgatgtttttggcatgccgcaggccatcatctctgacagggacaggatctttacaagtgctttatggcaggaactctttcgactctcggatgtcaagttgaatatgagctcgtcttaccaccctcagacggatggccaaacggagcgtttgaatcaatgtttggaagcttatttgcattgtgctgtttattcttcccccggtaagtggtcttcttggcttgcttaggcccagcactggtacaatacttgtcagcatagcgctcttggtatgtctccctatgaagctctgtttgcccgtaagccaactagcttcggtgtgattgatatgggtcaaagtactatcccggatgtgcaacagttgcttgtcaatcgggcgaaattgaacgagttgcttcaccatcatctggttcgagctcaacagcgcatgaaagcacaagctgacaagcatcgttcaaaacgccagtttgcccctggtgatatgggttacttgcgacttcaaccatatgttcagctaaccatggccaaacgttcttgtcacaaattgagtttcaggtactttggaccttataaagtcctggaacggattggagcagtggcttatcgattggcattgccggctgggagcttgattcacctagtggttcacatctcttgacttaagaaggcagtgcaacctgatacaccagtcagttcagatctacccctgacttgttctactgatgaagttgaagtctatcctaaagccattgtacgtcgtcagttgatcaagcgtggtggttcttccattaccttgctggttctggtacgatggtcagggctctcctgatactcttgccacctgggaaaatttgcccgactctatggcgtcgttttccatctgcgctggcttgggggcaagccagtccttaagggggagggaatgtcatgatcaatgggccttgtaagggacattgtttgtgttgggccaactattgggccgtcttgtaagaaccgagccaccaacacgggtgtgttataaaccctgcgtggttggtgaagtggggtatcgaagaagagatatgataacaaactactaccaacctctctgctcctgaattctccttcttcctcctctgttcttccatgtttcctgtgacgattccccaaatctagagccacgaaccctaggatcgtcacatatgtcttgtgccaactttatctgagtgaaattatcccaatcctttcttttcacactgcagagtactgccaagtacaagtgattcaatgcccttgttgagcacaaagagtgatttagtacttgcaggtgctcatttgctagattaactcttttttgtcagagatgatagatgcaataaaagacacataatagttatatttttttagataatggattttcattaatccggcctctatatccacgaaggaatacatagccaaacataatagttatatgaacatgtatgtgcatctcattatattgtctcactatttctcgtctttcattctatctttctcttcgccaagctcagaaagaaagaacactgtttcgttttaggctg

SEQ ID NO: 68853 - DNA, 2038 bp, Oryza sativa
aaaaaactgaaaaaaatggcttaattggatctatgccactgcaaatataccaattcgaaaaaataccattactattcacgacatcggctacatgtcactagaatttgggaaaattggaatcatgccactcccgtccaattttctatcaacctctgtcatctctctccctcttcctttcttcgcttctccgccatggacgccggtgagccctacacctcggactcgttggtccttgccactgcagctagccaatggtcccctctccatctctcgctgctcctccaccaacagcagccgcgacccgtccgttccttgtcatccccaccgggggacacggcacccttgtggcctcgccaccgtcatcaagggaatcagcagccagggagcttctccgccatcagaatggtaggttctcagtaaggtcaatgtatctagctttaattaacaatggttatgttgagaggaacaagtatatttggaaacttaagatgtcgcttaagattaagatctttatgtggtacttactaaagggggttgtgttaaccaaagataatttggcgagaaggaattggaatggtagcttaaggtgttgcttttgtatgaaaaatgagtctattcaacatctcttcatggattgtcattatgcaaagttcatatggagagcagttcagttttcttttggttttaaccttccaactagtatatctcatatttttgatgggtggcttttgggggttgacaagaaaaagagtaaactgatacttgttggagcttttgccatttgttgggctctatggttgagtagaaatgatttggtttttgacaaaacaccatctattacatatatgaaggtaattttcagggtaacgcactggctacggttttgggcacagctacaaaggtgtgaggatgatggggaattcctaaaagttgcatgccgcaggttggcgtcgatggttatgcaactatttgccaattatgggtggaggttcacaaatagacttcaataaatgtgttctccttattttggcttggttacctttgtttttgtttggtgtgttcttttatctgaactacactcttttctggagtgcaactttataataattggctgtagctctttttgagcaaaggctgggatgttatattccattatcttaaaaaaatggacgccggcgagcccaagagggcgacaactgaggggaatcggcaaccggggagccgagggcgaagctcagcgggacgagcggcacgggggaaggagatcggtggcggcggcggcgagggttggggacgacgacgcggtggtgggcagggtggcgatcagcatgggggcggtggccgggacctcgccgggggagcggacgacgacgacacaggcacagctcagcccgctggctccgagacgaggggatcgacaacgacgatgcaggcgcagcccggcccgccggctctgagacgaggtgctcaacaacgacgacgatgcagcgtagcccggcctgccggctccgagacgaggggctcgacgacgatgacacaggcacagcccggcccaccggttttgagatgaggcgcttgacgacgacgatgacgcagcagcctggcccgccggctccgagacgaggggctcgacgatgatgacgcaggcgcagcccggcccgccggttctgagacaaggcgctcgacgacgacgcagcgcagcccggtcggctggctccgagacgaggcgctcgacgatgataacgatgcaggtgcagcccggcccgacctccatctctgagatgacgacgacgataacacctcctgccgtgtctatggtggtggagagagaagaagggggaagagaagagaggggaggaaggtagggcccacgtgcagctgggggctaacggagatttttgacggaagatgtgatggagtggcacggttccaatgaagagaactcgaacctccatgctctttagcacgatattttgatttctccaattttcagtggcacgtagccgatatgttgaatagtagtggcattttttcgaat

SEQ ID NO: 68854 - DNA, 4909 bp, Oryza sativa
aaacgaaacggagggagtatttcataatgaatctattgttattcttttctataaattcagtcaaacttagtttcacttgtgacaaacagagaattccctgtattttcggatggaaggagtcaaagagtacatggcattatcatccaaccgaaacttaattaacgccttgttagttaccccttgttatttaccgatagacgaaacaaccacctgctttgaacttaaataacgccttgttattttaccgatagatgatccagccacctgcttcgcttacgacgagaaggacctcgagtcagaggaagccgtttgggcgctgtaccagcggtggtgcagcttccatgacatagagcgcgatcgtgatgacatggttcggcgcttcgtgtatttcaaggacagagcgcacaaaatcattgagttcaacaagtctggcaagtcttatacctggggtctcaatatatttggtgatatgacgccacaggagcaatctgaattggagcgtccaccgctccatcgaaggatttgaagctcagaaccaccctttctaatttaccaacaaagcactttcgagaacggtgataattcaatcctatactatttgatcatccgctagctgctttgtccagcctgagtaatgtatgtgtatggatgaaatgtgtagaatgctttgtatgcacaaacataatatttttttaaaaaaaaactagtttatctatacaattctcctttgaattgtaccctccacataatatatcacatgtgtttggtaattggttcgtgggagttaataaaaatatcaaggatcttatttttgttggagcttccgctatatgttgtgctctatggcttaatagaaatgaaatggatttggatagatcaccttaaaaatcatatttgcaggttcttttcagggtaacatattggctccgggaattatctcaattacaaaggcatgatcatatcaagcaaataagagaggcgtgtcctaaacttgcgtcttctttgccaactttgggtggagattcaccaatagaattcactagttctgggatgtttaccttgtttggttttattagttttatttgcttttggttttgttactctggtttgcttttgtgtgagccttataataattggctgtaactcgttgagcaaaccctactacaaaaacactcatagggatcggccttataggtgccggttcctttaaaaccgcacctataggccttttcctacctccacacgctcaaaaaaataagaaccagtacctttaagaaactataggtgtcggttcattagtaaaaaccggtaccaatactaaggtattcgttttttaaagaaccgacacctataataacgacccgaaccgatgagccgagcgccacgcctccttatctactcccacccacgtcttgtccttatctactcccacgctctctcgctctcgcgtctctctccctcccctctgtcgcctcgcgtctctccctcccctctctctagtggtagctgcccggcggtggcggcgggctcgcgaggctggcggttgccgcgccctccctcctccagattcggcgggagggcggcgtcggtctcccgcggccagtggctgcccgacgaaggcggcagcgaccgcgccctcccctcacgtgcaagtcgtccacaaccgccatcctagcgacgctcaaggggaagaaggaggcaacccaagggccccgtcaccgccgcatcatcctcaatgccgctgtggttcgagtgtgttctttttatcccgttcttgttctctttgtttaatttctctcaagttctcttattcatatgtgtaccgagaacatggggatttggatcagatgagcattataattaaatggatgtagaaattgttgttgttattgatgtgttctttggattttgattttggatgtagggatattgttctggatctaaggatgtggaggggatcacggtttgattctgaatgtggggatattgttctggatgtggaggccttcggcttgatttgagccagagttttttttttctcgtgcagacaaaaaggtaccggttctattttaccattagttgccggtaccagcaataggtgccggacgggaaaacggcacctattgccatttcccaaccgacaccaatagggctttctgtactagtgaaaggctgtaatatttcattccattattgaaaaaaatttggataagatcgactactcttcaaaatttcccaatctatgatatcagcagcttttatagacgttatagaagtacacgctgcgctgaaacaaaggtttagcagtatggttaaaagtaagttagctatttcgtttctcttcggtttgatttaaaagagaaccctataagcataccaaaagaatttgaaaatatattgttgaagttttttttcttaaaaaatatacgagattcgaacagatttacacgaatagaccgtcatcgcggtttggcagtgcgaaatcaatagaccgttatcgccgtttggcagtgcgaaatcgcaatgaaatcacgagatcagagtgcgatagcaatgacggcaagttggtaattaacaatcttaaattcttaataagtgattaattaattgctaataatgctaattaaataaataatagttaattaattaattcttgatgatgctgattgatccattaatctcgcgactcatgcggtctcgcatacttaccgtgcaaggtcacacggtctctcatacccttgtcgtgcgagaccgcggtatcgtgtacccatcgcacgacaccgcacgatctcgcgcttttgttaattaaaaaaacacacactgatataagagatttgctttattctagtgcaggtccaaagcttgccttcagggttcagggcatgttagttggtttgatcctacaaccaacgagaaataaagatagagagttaaatccataaacgatagccgatcggtcgtagagccgatgacatatcgtctgtgacctagccaatgcaatgttagtcggattggccgtaaggtatatgataaagaaagtaaataaagatagaaagttaaatccataaacgatagcctatcggtcgtagagccgatgacatatcgtctgtgacctaggcgatgcaatgttagtcggattggctataagggatatgataaagaaagtaactaaacttactctatcggttggagaaatcagcactatataatctatgaatcaatataactttaaacgaaatgattgggatagattggacagccgccgagacagtataaatcatttatatctaaagttatatcaagctataaattatacaagctcatgtcatagccgataggcaaatttagaagtatatcggctatagctccgatataactctatactaggatatcactttgaagtaaatatgttaaataagtatcaatttgacgttagattaacctaactagatcgatgacaaacttaatatatttaaatctattgagagcctaatataaagggcagatataacttgttaagtaaaacaaaatagatatatcatgtaagatcagctgcaactccgatactatatctattagcaatcatgaagcaagctaaatattaggtttctagatacgacttagttgatcaaacttaactgatgcagcactaagtataaagagaaacttatgatttaggtaaacaagccaatgaaagcctctccaagatggtagatacattgcataatctaagccgacgaactattctagtcaatgtcgatagaaccctaaacagagatcggccgataaggactggattaaaatatcaactttgattagtcaatatatattataactcgacgaattacataaacaagattatagtgtcataaagatgtaaccactgatcccgagaacgcaagcccccataacaagctttacctcttgtcggagatcgaagtcgatgcagcccaactcgaaagcaagaactcattgaaataaaataatagaaaggtttggcgatgtgccgaaagtgtattgaaatggtgttaattatttagagggtgtcgggtacatatttatacccaaaatagataatatgtctgttgacggtcgttatcgatcagtttcgcccatcaatattaccaaaatagaggagaactagtgatgcttacaatgcatatatatgttagaataataatattccactagtattaggtttactaaccttttgtagagaataagcataaaatggaggagaatcgacatcaactcagacgttaaatcaatcggacgatgtcgagaatcagacttatgcatgaatgggataaaaactcagaattaacacgatgaattgggccaaaattcacaagtctactataacaccctaaaaattagaccgacaaaaatctaaactccaaaaatataggccttcaaaaactttttaaataaattgcatcatgccgattttgtttcactattttattttattttgacttcggagttcataaatcacgaataatgaataattaattaggaataaaccctaaaagtaaattgacaaagtaaataattaaagttcaatttaaaataagatttggtgaggatagaaataagtaaaatattattacgaccatatttgtaacaattaaatttaaatgtgatggaataagaattaaccctaattaaattcaagaaaattatataaaaataaaatatgggtaaaattagtcaaggatggatccattggttggaataacacaaataccgagtgaacttcatttatacaaaatttaggtttatagaatcaaatttaaataaataaataggcttaaatcgggttaaatagaaaatggcactattcattgcgctctaagtgctcgatcgcgttctctagccctaaccctccccctgccccgcgcgcacgccg

SEQ ID NO: 68855 - DNA, 18765 bp, Oryza sativa
  unsure (1)..(18765): unsure at all n locations
ccgcccgggtgggcaagggagccgagagagagagggagaaaggagccgggagggagagaagagggagagaaaagaaaggaaaaagaaaaaagagaagagaaaagaaaggaaaaagaaaaaagaggagagaaaagaaaggaaaaggaaaaaacgaagagaaaagaaagaaaggaaaaaggggggaaaataaataggaaaaattagggggagatttaggaatatttaaaatattagaatttaattatggggttaactaaaatctagtatttgcaaagtaatactataatcatagatgtatttaagaactaaacaattagatgaattcctatagattattatagattattttaataatctctataaatgatcaattcgcggtagtaatttagatggaattgagaactaaataattagatgaagtcttaagacgtaatttcgaatcacaaaatatcttaggaggaagaataatcccacttcgcgaataatatagttgatataggattcgcctctcgcgctcgtttttcaattcgatttttattggattttatttgaattctaatggaattcaaatcgattctttgcacgcacttgtagagcccgaggaagccgcggatccgagtgaaggccaagacccgcaagaccttgagcaaggcaagtcatcactattctttgatcacgttgatcccaattgcgaaattaatttttgtttacaaataagattgcatgcgatgatgaacatcctatttatgattatgccatgccttgattatcgttcacctttaaatccttgtaaccatgattacgtaagagtccctagtcgattatgatgcttgcttagaaatgctacactagaatattgcatactcatatttgtcaaatattatatgcttgggcaattacctttgggaaggtaattgagatgcggcatgtggagacatgagcgccacattgccatgataatgatgacatgatttgtgaaaataggaaagaaaactaaacacttgttttagaccggggcagacggtgaatttgggtggtatccgggaaaggctagtaccgtccccggtcaattaaggaccgagccatgaagttaagcatgaaacgaccccgtacaaccacacttctcgaatggggatagacctagcggagtaaatagccgagcggaggcagtatccatgcatagtggtttctcgatgtgtaaggcaggggctctacaatggtgtcgccattgttaggactgccatgtgatgagttgaacataattataacttaatacatgtgtgtgaattttccctccccgggtgcgccagaactcctctcactgctagaaactgtgtacgcctagagtacatgaggatgaaaagttcatggagcgggtactgccaatgcaaggttatcgaaaagctttgccgtgacgcgtctcatgtgttgagacaaggctcatgtgttgggcagtcgcagaatgtgggtaaagtgtacatccactgcagtgtgagtaaaccaaatctattcgaatagccgtgctcgcggttattgagcaccgggacatgtattacacttggctagactctaaattcttatctagtgtgggatgggttattgcatgatgaatttttatgctgttggagccacttcctgagaagggggaaggtgggcgtcctcagaaaaccatgacgactcaatggcgggaagctatccttgggatcacaatggatggtggacagaaccgtcgttgttcaaatacaaacactggtactaaaatttgatcagtcaatgctaggtcttaggcttgtgaaaagaattacaaaatttgctttgcgcaaaagaaccctagccatcctttgaaatacccctatcatatgcattgttgatgtggtggcttgctgagtacggttggtactcacccttgcaaatataaacttaatcagaagcgggagatgaagcttcggaggatccctatgcctattaccaggagggtgatgaagacgatggcgctcagtaggtcttagtacggtcgttgcctgtggcaatggcgtgccgctgccttatttccgctgccttatctatttctgcttttgggatgtattccggaccgcccggtccgatgatttaagacaatgcctgcgggcttatgttgtaataattcgcactagactctcgtgtgtgtgcatttggtatttcagctatgaactcgtgtgtaccagactacttgatccagggaaatggtactgtttacacgattgatccctgttataaaaacgggggtccacatctacgaagtggagcaacggaggaggccgccagccaaaacttgggctggttgggccggcccctggttcggccgaaccagggggtttggccgaacctccctcgccgccgttggatgcagggcttcttctggatggttgggattgatccccaatgacggtcggagggtattaccgaccattccaaccgtcacaaccgtcattacctgcctataaaaggacctcctcacttcacttcactcacacacctcaagcaagagctttctcatattctctcaagttagtttagtattctcaagctagtggaataggaatagagtagaaaccaggagtccagaagtcttcggaggagttcaggtatggctctagtagctttcctttcctcttttgtaagctttgtactattattagaatactcttctttatacatttgtggtattaaaatactttccgagtatatgaataccaactttacattatgtttatgttatactgaatatgctgctagcttatctgggagatgctttggtgtgggtataatatttgcatatgcagttactctatgtcatgacgatgatattagagtagtatttggtagtttagatgtggtgtctagattaagggatatcattatttggggttatatgctgcggatgagaggtgggctgctaatggtgacagctcagtacggatattcctccgcgcgtgtatattgtcctaagttaattccctagggagggtactcctccgtttttagccccgcttgtatggtcatgacatgctgtcgtaaggaactcggcagtcaggggtggcttctcgaagtaccaggagggcatcggatagagggtattagctagtatatcaaataactagaatgtatgtatactatgtatactagaagtataggaatagattatcttcctctttttcttaccatttagcttagataatttagtatgagaacgagtagcttaatgcttgtgtgtcactctacccttggattatcttaacccctgcgtagactatgattatcacaagtaatatataaattattagtcaagttctctctacatgatcttcccacgggataaaataaataagatacccttggaatactctcgggtgaaatgctacaatgatttatccgtacgcttgcggatgaactctgtaaccataatataccaaaagtatttctgcgccattactgtgaattatatttatagtaatgtcgttaagaaataccaacaatttccatatggacacgactcaaacttctattatagctctaacagacaaacaagtcacttaggcacactcttaccaaagatatctataaggaaactactaaaatatcctaattaatagatacaattgccattctttgaacataatccttgcctggcaatactcctgtagcccttcaatcaaatccgacaatgactttgtaacccatcttgtcgatatcggctgtatcggctatccctatccgactagtgttagccgatacggtctccagccgatgtgtaatatgttttcaaccgtcaccacaatcccctccaaatctgcttcgtctttacctccaaatacgatccatgcattaccaaatttggtcattaacacatgccccccaagtgtttatccgccattggccgttaaccgcgcgcttttaaatagtaaccaccgcttaaaatttccacgccatccacttccgttttcaccacctaagcaaaatcactttccccatctctccggcgattcccacgttctccggtgaccgcacatgcgctctcagtggcgattcccaatgcaacttcaatggcatcctccccgagctcgtcaagcccgccaactgcagagtttccagaggtaagccccatcagctcaaactctttccaattcttgcgtcttcttgcaattcaatctccctctcttgcaatctgtagcatttagcgccctaggtagcagtcccaagtctgaaagaatcaaatcactttttcatgggcccaattggagatacagatcccactatattcatcaactcagaaacaaatagaatcccttttaggtagaccaatccaaacctagcccatttgtctacgacctttagatcatggccatcccaagccgataaatgggttgagtggtataacagagtagctacaagcaagcagagtcactgggaagaaataggaatatctcaatgcctttctctatctctagccgataagaagaaagatgaaccaatgttatcagctgcagcctattttggtcagacaccttaaacgctttcttgttcaaccataggccgatgactgctcttggatataatcatgatcacagggctagacatcactacatcggccaaccccatcagtttgaagaccaagtgcactcacctattcaagaccaagaatgttggtggctggtcaggatttgtttctataaacatgggtgaaaggaccttgatgtcgcctagaggggggtgaatagtcgtttctaaaaattatcacaactttatagcatattagaatgatgagaacttccggttcaaatcggaatttccggtaggggattggaagtttctgtctcaaccaaaaggttcggcggataatggaataaaacactagctatgaacttgtagctcaaacaaacaaaatgtatatgaatcaaaaggtgacaaacaaggtatctaagcaagatataaggtcatcaactatattaattaagcatgcaagtagatcgggtaaaaacaagctcaatcacaatatgaaagatggcaagaacgagcaaaccaggccgcctggagcacccttggcaccgacctcccaccgccattgccgcctcccgtggatgagctctctggccgtgggccatcaccccagcggcgaggtcctgaggaagataggagagaggtggtgaagagaggggcgagaggtgaaaatccacttgcacgtgggccccacatgtgtgttttaggccctgtttagcacagctccagcttcagctcaaccaaacagttttacctccacctaaaataggagtggaactaagtggatctctctcacaaagtgcctgtttggtagggctccaactcctaactcctagctccaaactccagctccaatgggaggtacctctgaaagtgtttggctggcctactcagctccagaaatcccgaaagagatgatatagtggagatggacaatgaactagagatgtggagctgagtttaggcaactccacaacttcactccagacccaactagctctaccaaacaggctcttaatttatcttaactgacaagaatgccacatcatccaaaacaccatccatactgttaaggaactcacttgaacggtttagcaaagatggagggcgaagatttctggtattgcggcttagggatgctagttaaactaaacgtaaagttgagggacgtccggtgaacttatttccttttgaaaaagaaaaaaagaaagcccaagaacttgacgaggttggacagactcggcccattacgtgagcttttaactacgcggcctaacgggcctgggcggactaacgttttcgctaatccccgtacgacgccggcgcagccccgcacgcagaaagacgcgacgcgaggagcggccgccgccggcagctgttgcgatgaagcgcttcttccagcccgtgcccaaggatggctccccggcgaagaagaggcccgccgccgccgccgccgcctccgcctccgactccgactccctcggcggcgacgcccccgccgcggccgcctgcgccgtcggggagggggattctcctcccgctccccgcgaggaggaaccgcggaggttcgtgacgtggaacgccaacagcctgctcctccggatgaagagcgactggccggccttctgccagttcgtctcccgcgtcgaccccgacgtcatctgcgtccaggtgagcggcgcgggggcgggggttttcggttttgggcgcgatcttttgcctcttctttttatccggcttttgctccctctagggtttaatctgcagtgctgtgcggatgtggggatatgggagtgggttttaggcgattgtgcagcaatgtggcatatgccagatttgcggtcgctcacgggcggtttcgtcgagcacgttgggagcgtacgttttcgttattcacccatgggagattaaacaagggaggtgcgatcttaatagagattgaggtttttcctcccagggttctgtccttccagatgttcacagagcttgcattgcgttgtattcacatgcaatttgaagatagttgtgtcattgcttgcgagtggagttgctaggaactcgttgtcagtgttcatagcccagtttttttttttttttgttagccacttgtgatgctagcacaagtactccatctaggcaaggactgtgacaaactgtagaccatatggtatgtgaagtgttctcttcaagttaaatcttcaattcatgatatgggaaaactcgtgatatattgaatgattgagcttttctttggtaccactatgcccactgtataaggtgttaaccacaacaaaattgaggttcacatactattctactgtttcatgggaaccagttcggcagctcctcttctttaatcacactgcctcttctttagtcacattgcaacttatttctcttatgcttgtgatcccaatatatcctatagttttattggatttatattaggcacatccttttggaatctacctcaggggcttgacgctcaagtacataggacatgaggacgtctttttgtctttccaaacctcataatgtttcattctttgtccttataatgttcagttgcctgcttattcttttgtatccagctggtcacaactattttgcttttgtctgatttttttatcagtacttacaacttcattttaagtatacatgtcataaatgtcttactaggatagtatctaaacttctttgttaggaagtgcggatgccagcagctggttccaaaggggcaccaaaaaatcctggtcaactgaaagatgacacaagctcatcacgagatgaaaagcaggtaatacaagcattaaaagattaatgaaattttctgtgacttttatgcagaagttaatattagatttgtcgtgcttttcataatactaggcagatcaagatcaaattaagaattctaaacttgattcgtatcttcatgcgatgctatcttttccaagattgacccctgtaaaactagaagatttgatatatgtgtaatgaatgtagtacacttcgcaagcaaccaagtttctatgtatactgactgatattttcaagaatggcaagctacagtcttttttttggtcccttcatgactgtttagtatattgcatttgttgtgctccaagaaattgttctaagatcacatctcgatgccatgcaggtagtgctgcgtgctttgtcgagtccaccttttaaagactatcgtgtgtggtggtctctttcagactccaaatatgcaggcacagctatgattataaagaagaagtttgaaccaaaggaagtgtcattcaacttggatagaacatgtatgttcagagttgcatgcatgacttcatattttcatttcataggcaatctcccgttatcggtgtgttttgtagtgtccatgtgcttcgctctggtgtgaataactcaatacaagatcgactttaatatgcgcaccatggtgccattatcagtctcattccaacgtgagtgtgtctctcatcataagccggcaaaatcacacggcacataagatttcacctgcaagcatagatggaaacgatttctcttgactaatatagagttgcccaagatgatgaattatttacttaccgtggtggcttttattcctgattagcttaagtgttgtgacgcttgagaatgtttttcttttgttgataaccacatcagctgctagattgttctagaacttctgagttgttcttcctgatatgttggatatttgtgtacatactctcagtataatttatattattatgttcctatatgctccctccgcttcatattataagtcgctttgatttttttcctagtcaaacttctttatgtttgaccatgtttatagaaaaatttagcaacatctacaacatgaaattagtttcatcaaatattacattgaatatattttgataatatgtttgttttgtgttgaaaatattgctatatttttttataaagttggttaaacttaaaaatgtttgactagaaaataagtcaaaaatgaaggaggtagtattgttttagtatggctgctcccaactactgttcagggaagaaaatgcacatcaaaactttaatgaaaaagaaagttccaggtcaacaaacttgttgcactgcaactttgaattaacatttggtttcatcattactttctcgcatattgctactctttcttaggaatccacttttgtattgttttcagcttccaagcatgaaccagatgggcgtgttattattgcagaattcgaatcgttcctcttgctgaacacttatgctccaaacaatggatggaaagaagaggaaaattcatttcaaagaagacggaaatgggataaaagaatgttggagtttgttcaacaggtagacaaacccttaatctggtgtggagacttgaatgtcaggtaattaataatattatttataacaggtagtactagttactgattatcttgttttccttggacatatagctacatcttcatactattttttagatttgattcaggcatactgtaacagaaaaccgatacatgacaaaatctttacacttttgacaaaaaagctagtaggcaacagaactgataacagtttttcttttcttttcttgcaaggctgatttgagcatattattatccataaatacatataatgagctgtgatatgtttttttgtattctggagctttgatcagtgcaggacgaataattcatattatattcttcttttatttacaaattgcaattatgttaccctgcagtcctgcactcctgtctgctatcatgatttcaagattagttgaacaagagcaaacttagtggcatggaatatatttttatattttccaatgcaaccacaggatagtcctgacatgttgtgatttcagtgcaacatgttagaaattccaatgcaaccacaggaaatataattattttattgaagtctagtatatttagctcacatcatctataaaatagttaaaatgtctcgtaaaatccactggtccgacaatgtgtgaaaactatggatttacttttcattaggtttaccaaaattccatgtttaggagatggacttcaggtaattgttgatatagaatttttttggaactggtcatgtactgaaatttccattagatctcaaagtgagtaagctgtcaaattatatatggacttgctaaggaactcatatttgctacaccatgaatagtaataatccactacttgacaccttccataaaccagccttagctctaatactttgcttgtatttgaaatatttcagtcatgaagaaatcgatgttagccatcctgatttttttagcagtgctaaactcaatggatacatccctccaaataaagaggtaacattactctactgattcaagtcttctatttacaagtgactaggagtgatttattacttttcatggctttttacaactcaggaactgtatgtagtcaccacattgaaatgatccttaaacagtttgtgcttttcatttctagttgcatgttagggttgttccttaatgtaattgtcccatctcgtaaactgtgcatttagttgactaaaaaagatagtgtcagcctgcgttagctgttatatcctattagcacatccctactattcctaagaacattgggtgcactcccattattgaaaacctgtaaatcgttctttttcttttctagcacttcattctccaactcagaggcagactttcttttattagtggttgttttggttctactaggacttcagggggtcagaatgggaatactcgagcagcgggttaagatgaccagtggcattcaattaagtcaagaaaaacccctgaacacgctgcgcgaccaggcatgctcaacctcacgagaggagcacacgtctgccagcgccagcaagtggggctggagccacttcaaccaattcaatattgggaagggctgggaatatgcaaatttcagttacaagaacatcaatgcatgtgaaggaatccgtttctgtcctctatcagtgccacaatattatagtagtatgttttacttgaatcatcactgttctaaaaaggtcgctgcctagcctacctaggcaaccattagaatactgatatgcctaggctcttgagaatgtgatatatatttaaatgtgcctttcacgtgctattgtaccagctggcatactgcctgttacaaaatagaagtcctattggatcactattgagccttttgatgcaattaaatctcttgcatcctactctgcaggattgtggacagccaggattcaccctgtcagagaggcggcgcttcggcaatatattgtcccagtacgtgaaagctgatacatttctacattggcaacttttcttatactatcttttgaaacttgatgtcaaaaacatattagcactacatgaattaatttcatttttataacgttttagaccataaaagatgatatgttctgatccaacccatcttgttaaaatggatttaaatctgtaatgtagtttacagtgcactggcaaccattatggatttgagtcaaaaatatataatatattggctactagctagtagtcatcacagatatggttcatgctctcgttgaatatgtctcacactcaccttgagctaactttagagaatcttcagtgatagttttattcacatcctcatcctacctaagccatcccttaagatctggctatgagagaggcttattgcagcgttggcagctctgcattatggcctcatgggctcacacttacatgtatgctcaacctgccgatggggtcacaatgttgcacatactgtgacttcagaacatgtgataatttttatgagatgggattatgggaaggttgaagttcattgatgtttgggggccagggacctgctataggccttgacaattgtggactactcgaattatcaagccacgctgagctattcaagctcagagcttgttatgctgtacaaaccttggctggccatgctcaaatcaagcatggagcgatccaagtttgaattgctcataagccttgagactttttttactactgcctgcatgggtagaggtcatctatgccagtatgcctgttctgtttacagatcatatccccaatatgcctttgcagtttacagatcatgtatcatttggcccactgactaaattactggtgggtatgggtaggaacatgccaacctcttattatttcgccatgtgtaactgggtaatcaagcaagattgtcaccctcaagttataatcttttgaaaaaaaaatatcttcagctcttaccttagatttaaacttgtcctctaactccaaaaccatgtaaaagttgccctaaacgttcagaaagtaaactggacaggacttatttggggtatatgattaacattcattatctctccctttaacaaacgtgctcaccacaccttggttaaggaatgagttttcaactgattttggagttgacaacttttttcctatccttatttaagctgaaaaccactaggaaccagttcaggcagcataatgtgaacccttttctaacaatattctgtgaacttaatatgaagcaaataaagcctcacatggcatacggttccttcgacatggaggaaagaaaataagttaaggaaaattcaagccatgttcgcagtgatgcccccagtggatcatgtcaccagcagcttacagtaagaagctatctgtgacttgatcaaggaattagttgcatgtataacatacggccataatggcaaatatcttcttccgtatctttgtgcacatgacaggtatgtcatgcaccaaggaagcaatgcttggatctaggatccccttagttcattgcaacaagacatacttctaggcttgaaattttttaatacctcatggagtaattatttgaatttacagaggaaagctggtagatgcttacagatatctgcacaaagagaaggacatggattgtggcttttcttggtctggacatccaattggcaagtaagaaagatttcaattattatgctagtcttcgtttgtttcgtagattttattgctgcattatcaaagcatgtccatatctgacattgatatgtcatcttattacattccttcattggtatgcattttaccaaaggttatcttgaacaaatattctttatctgaacagtttgagtttacaatttatcaattcaaatgggcttacaggcttaaagataatcctgtatgtttggcagatatataaatgttcttctagaaagtttagtttgcactatgacctgaactgtgaaaattatctaaaagttatcctacttccagttaaaattgtgtcagctgattctcttttttttttctctggtaatctaaacttgatccttacacaagatgataaatatgatcttcgttaaatcttttctagttaatatcttagctaatgggctaacttttgattcattacaactggaatcccatgaagactaactgatttaaaaatgcctacaggtaccgagggaagagaatgcgaattgactatttccttgtttcagaaaaactgaaggaccaaatagtttcatgtgacattcatggtcgtggaatagagctagaaggtatggggttaaaacattgcttatcatgctttccattgtgatacgcaagtatataaaagcgtcatttttacatttggcccttttaaaaaactttgttcaaatagaccagaatgaaatttgttctaagaatagacccaagtgttgatccatggatagggcaaaaagggtctgaatagtgggaggcaacacagctctcacactactatctctacgttcttaacatactgatactgtatctcttagtacttcctaagtatttcgtaagtaactcctaatctcctatcctaggaaactagtgatttagtgagagctgttatactctgccatcataactccaaggcacggtatgttgccacatcacttggcaccatctgagctgccgcattagacaaccatggaggggacttactagcatgtcacagctcagtgccatgtagtgtggtgtcatgctctcaaacatggtaataaaggttgaggtacattgttaatgtggtgcataaattttgtttactccaaatcattttgaaaatcttgttcctgaaaatagattggcgcatatgttatattatcccatcagcttgcttaacttcagctggttgcaactaatattatgcattttgtttctttttttgaggaacataacttgtcgagcctgattagctaaaatgttgttttactgtattagacatcgaactgcaaatacatgctggactattactacaatacaaattgcatgttgtcggaacttgtgacccatgttgtgacttgtgagcacactacactggttttttggaatttaaagtgcaaatggaatacgacaggtacctcaaccccatgaaaattagttacatgaacccaggtgaacaggacagagctggttgtcgcagtagtggtagtaattgcaccttgcgctttgatgctagttctgggggtagagtagaccttttctgtaattttgtgttggtgagttccatgttgtaggcaaatagactgtaggagatatggcagacaatagaaaaaatctgcaagtttagaagctccctttggaatcctcttttgctcttggttcagtgataaacatttgacctgtaactgaaattttatgcatgcctgccagtaataaacaccagcaccttgaagctattacatggtaacttccatgatcttctctacaagcaatgaatcgaacaaatttccttgtttccccctagtaaatggtaatgccaatatgctgtttaatgtcatggtacaattcattgacgtccatttttgcaggattttatgnaagtgatcactgccccgtttcacttgagctctcggaagaagtagaagcaccaaaacccaagtcctccaactaatttctatatttcgcacttaaccagacatggtggagattttagattagctgaagcatatctgctttgtatctcttgagtcattatccattattcaaatattgtctcagtctagcagtatttctgatgatgaattggatgatctagctaggatcctgattgtaattataattagtatgttactatggtctgcaatgctatctttagatcctataagatcaaaaacttctaccatttgttccattgtttttaatccgaagaaaaacaatatatgcaagctaattctggtccgcaggtagaccgcgtttgagaacatgtggagttaacctttataaactactaactactccagtaataaagttgcgtgcataacctacatgataatagcatctgtagatttttgtctagtatgattctcccgggaaaactgcagaaattacaaaatgacatcccggtgcattacatttgtgcctaggttccatgttcgtctgacacaatggaagctacggctctggttgtttaggtatgctgtagaaaaaataaagaaacaattaaaaataatttataaaataaaaactttatatttgtgatatcagcagtttaaaagtcaattttagaaaataaactacgatgaaattctttaagggcccctttgaaacattggattgaaaaaatacaggaataagaaaaacataggaataggatagaaattcacatgtaaaatagaggattgtcctctcaaaaaaaaaaaagaggattgtaaagccataggaaatgtataggaatatgtgtttgaatggagtataggaaaaacataggaatatttgcttaagaacttgggaccattttccatttctaataaatatattgcagctaaaacaaattaccattcattgcttgttcttctgtagtgaagaaagtcattaggagcttgattgcttcgatcctacgtaaagcaagtgaaaaatgagctcagactcctgtgtttctcccattgaatcagcgacgaatgaatatttccttcggttttcctatgaccaattcctacaaatcaaaggctgctacaatgaatgaatccataggaactcacatactccgtttttcctttgtttcaaaggagccctaaatcatcttagggcacctttgaatcgtagaatgaaaaaacggaagaatagaaaaggcataggattctgacaggaatgtaagcgtataatagaggattgtaaaacacaggaaaaacataggaatgatcgtttgattggaccacataataaacacaggaatcggatgaaagagatagactcaaaggatttttttttccaagaggttggacctcttgctaagtttcctccaaaacctatatactatgagccattccataggaattttgttggatttagaaaacttcaatcctttgaatcaaagggctacataggaattcctataggatttcaatcctgtaaaattccttcgtaattcctttgattcaaaggggctcttaagatttatattttcgttgtggttgataaggaatgtattttgtatttgtagcggtgtatgttttacggttatcagtggcccttatcccctctccactaaaaaaggcaaaatttgctacacgacatccaaaaaagtataattagttgtgggacaccataagaacgcgtatctactgaaaaaaaaccggtaattagctatagtacactcgtggcattattttattatatcccaaagaaatggagagagaaaaagctcaggaagtacaaatctgcccctttctccaccaccacacacctcgctctcccaacaatcgcttcctgttattgcttgctcctgtgcccaggacaaaaggggaaggccgacggacccaagccccactgcgccaccagagctaggaatgtaggatcgaaacacaagaactaagccaaccagagggggtgaatggttggtatacccaaaaacccaaacttttttgtggaataaaaagttaccctcaaattcgatggagatcggtctgaccgagattgatctgctggtctgaccaagttgataccgtcggtctgaccggagttgatcgcccggtccaaccgcctaaagattgcctctgcctcctgtcaccgttgccggtctgaccgcaggtatgccgccggtttgaccgttgccttgctgccagtctgaccgccggtgtgtcgccggttagactgctgaaccctagcaaacacaaatcgaagaaatctcaaagtagatgacaactttattacttatctatgtatttacaaagtgcaacaacaccactccttacgaaaatctcgactaaactcgaaaccctaactaaactattaactcaatgctctcaaaagcgataccgggaagcctcacgctccctcactatttatacatgaggtaggcagcctaaagccacaaaccaaactcatactagaagtcctaatccacataggaaaccttcccgtacaagaaacaaactttacaaactccaatcataccaaatttggactccttccaaattcgactccgcatcccatacgcacacaatacctccattgtatgacatatcgaatattcaccaaccacgtgcattgaactctagcctaagtatcccacatgatatctgaccgtcacggacatcgtcttatccccaagccgactcccgatccatcaccggcaatactctcccgagacatcaagtcacctacatatgaatcaaacaaagaaaccatatttcaagaccaagctatccccaacttgactcattgttagcaaacaacagtattacatacatataatatccatctagaagccataaatatgaaacaatcatggatatccaaataaataacccgaaaccgaaactaacacagagtcggccggtcagaccacgggttggccggtctgaccgctcgatcaccgctggtctgaccggcacacacagcccggtctgaccggaccaaatcacagacagcagttcctgtagatcacctgtaaaatccaatcatctccaaaaccacttcgaaaataaattccaaatatcaaaaccaataatctccaatgccaattgttcatcacaaaataacaattaaaaacacttttattttacaatctccttattcatgaacacattggcaaacccatcaaaaatgttttggtgtttggaaaaataaaaacaaaaagtggtaaaaagcacacttcgtacaaatgtacacatcgtgctcaaaatccgaaagaaaacttctctcacttttgaaaagaaagaaattccccttgaaccaaaaaacatgctcttctcaaacaactctccaacaaaaattcttctcttctcccaaaaactctcatttgcttctcccccttttgacaatgatttcatcaagcataagaattatgttcgtcaatgttcaagagcttagcatacatatagcatatcaagtcatgagttgcaataaaaagaagatgaacccatctataatatagcaagcatgcattaaagtataatcatgaatcaaagattttacaattaagttcaaatcaacaatcaaaattcatgatttcataagatttataatgcaacatcttaacaagcacataggttgaaaaataaacactaaacatatagacctattgcatttatcactatttctcaaattagctttagcacaaaacaaccaagagaatttttatcttttattttactttagcctttttgctcatattttttttctcaattttttccgggtacgtccttgtcgtcaagactgtttccaaggattcggcacccattatttttgctcatatcgaatacgtccttgtcgtcaagactgtttccaaggattcgttattcatttttttctcactcataaatatttttatcttacacaatgagcaattacaaagctatttgaggaataccaattcaataaagcatatatatataaagcatttataaatcaaaccatatgctagcatcaatattgcatattttcttaattcaaatatagaatttaagtgtcatgcatcatctcctttaaaagcaatatctaagcctcctaaaaagactagaatacatacaagctatgctagagacaaataaaccttcatattattgctagcatacacaagaaaatatcatatgtataaacaaagatccaatcatacttctgtactccttctgatcagcagcttcaccatcttcattaggatccaacacagctgtagaaccagttggtgttgatattggcttgca

SEQ ID NO: 68856 - DNA, 18452 bp, Oryza sativa
aatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcgtaataaattcatttgaagtcagaatgaggccgttcaagtctcataattcatctaaaattatgatctacatgtttgtttattttttatgtattgtttaattggtttttattagtctttttcctcgttttgcgtgatagcttgtcgtttccgttgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgttttcattgattactttattccttgataccttgggtgattataattggactagttgagctttatatatattggttcaactagatattagatataattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctccggccagagtaaaaactattcgaatagccgtgcccgcggttatgggcgagttgagcaatgtttttcgtgattagtctcacacctctcacaataatttatggatattataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaataatcaatcaacctcagttgaagacaagttgcgaaggagaagacgtttggcttataccccagttgagctgcctgtgggagtggagccggagctgcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggactaattttccgaaaacatgatttgtgaaagtttctcctttcttccttatctagaattctttgcaaattgtttcattgtctacttccctctctctttcaacttgagtagttctgaaactagttgttgaaacttgaagacgccaatgtggtctacttatggaggttaagtcaagtggatcgatgaataagaaggtgatggtcgatctgaagtgcccagatgtcaagatggaatgaagtttggatcctaccttagaacctatgccgccaatctatccttgaagaatagttagtagggaagagcgtttgttgtttgctttgtttgtaggtatggttgcattcccatcattggagtagttcattgatgagtgtgtaactatactaggttgcttgcttaatcaacttgaacaatataatggtctacgcacaccagatcagtggtaacctggttaaggtcttgtctttagtgtaacctctctccttctatcttctctaatatgcaatagatggtgaacactcgcgccagtggaagtggaaacaataacaatgaagggaacccaactcttgctcaagtcctggctcaacagactcagttaatgaacatgatgatacagcagatgcagaaccagctcaaccaagggaacaacaatgctccaccgccgcagaacaagttaactgattttcttcgtgtaaggccacctaccttttctagcactaccaacccagtagaagcaggtgattggctacacgctgttgagaagaagttggaactgctccagtgtacggatcaggagaaagttgttttcgcttcacatcagttgcaaggacctgcatcagaatggtgggatcatttccggatgaacagagcagaaggacaaccaatcacttgggaagagtttactgaaggattcaagaagacacacatacctgtaggagttgttgctttgaagaagcgtgagtttagggccttgaagcaaaaggatcataccgtggcagagtatcttcatgaattcaatggcacgttatgctccagaagatgtgcgtactgacgaggaaaggcaggagaagttcttggaaggcttaaaggatgaactgtcagttacgttaatctcccatgactatgttgattttcagcagctggttgacaaagcaattcgacttgaagacaagaagaacaggatggataaccgtaaaaggaaaatgattgtattccaggaggcacaaggtagtagccagaggcagcgtatcaagccactccaaattggtgaatcttcttccgctggtcaaggacagtcgcaacagttgaatatcgctggtgagatcaaatcagagactaatgaaagcaatgaagttaacatcgagcaaataaatcagccgatgccagttcagcaggatcagtctcgggagaataacagtagtagaagggagcagcaggtatgtttcaactgttacaagccaggccactttgcaagagagtgtccgaagccgaagcatcagcagccgcaaggtcaggtcaacaacattgtcgtcacaggagccaatgcagtaccagttgtgtcttcaagagttgcatcttcaagtgttacagctcagccactagtttcaaagcggcagtagttttctataaagccttagaataattatcggagttatggaataagatagactgcagtttacctatgcctttttctttctagccgttccgaatctcgggacgagattctttgtaaggggggtagatctgtcacatcctgattttttcgttttaggatttataaattatttaataaattattaatagaatttatattaaatgttctttaatttacaagaaaagttaaatgtgggaaataaaatttcctaaatataaagcatggatggatttaatttttattaaattctccatgattaagtcaactctctgaaattttctcggatttttcggagctcaattcctaaatgatacaaagaacagttcagtaattatttgatcattaatgatctaattatttttgttaagagcttttcttgtttaaaaatccttaaattataaattgttgtttaaaaggaattgttagaaatgattttaaaagcctaaaagagaagatctaattttaatttgttgaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaagtcggcccagtccgccgagccgccgctctcctctctctctcagccgctgacaggtgggtcccacttgtcagggtcgtcgtcctcctcgcgccgccgccgccgcccgaaaccctagcgcgagccgccgccgtctccttccaaattcggccgatcctttccttctccggccgaatctttagagggaaaatgatccttgagatctcctcttccttttctcttttggaatcatcggctaaaatcgtttggaaattcgtggattcgagttcgattcggatcggcctctttcctccgaatccccgatctttccatcccgccgccggtcgccgtgggccttcgccgtcgccttccaacccctttaaaaggacccccggtgtctcctctacccgccgcctctctcgccttcgcctaccgtcgtgtgtagcaccctagcctcgtgagcttttgcgccgccgtcgtcgccgctgctccagccgtgtgccgccgccgtttcagctatcgccgtcgctcgggaaggtcgtcatcgtggtcgccgtcgggatcgccaagtcgtcgccgtcctcgtccgcccctttgccgccgccggagaccgctggagcaccgtcgccgccgtcgacccgatcttctccgccgctttgacctcgtcgccgtcgccgtccgttggtcttccgccgctcctttggtcaccggtgagttcgtcgtgccgtccgcttcgtcccggtgccttccgttcacgccgtcgcgccgtcgttcgccggcgagcgtgcgccgtccgagctgccgagccgcccgagccgccgccgccggtggtgacgtcatcgctgacgtcatcgtcgctgtctcccgtgagccgccgtggacccgatcgatctcggccgtccgttttggatagggttgatctcggccgtccgttcccgtgaaccgtcgtcgtgcacccggtccaccgcaaaccctagccgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattatccataaattgaattaaatttatttaattctttttaaatgggctttaattagatttaattttgtaaaattcataataaattcatttgaagtcagaatgaggccgttcaagtctcataattcatctaaaattatgatctacatgtttgtttactttttatgtattatttctttggtttttattagtctttttcttcgttttgcgtgatagttagtcgtttccgtcgttgtgaaggttcgcgagtgcgccggaagtattcaagaagattaattgaaggccgattattgcaaggcaagtcacacagatcctaaacacaatcctttgagcatgttgatcctatgtttaaattctctatttatttcaactgtgcatttattttcgaatgtcattgggtggaattaacctattctttgttatggcccttttgttcttgattactttattccttgataccttgggatattataacttgactagttgagctttatatattggttcagctagatattagctatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgtttcagaatggttgggcctgagcagcataggcatgttgttcagtgttgattaaaatttttgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagacaagttgcgaaggagaagacgtttggctcataccccagttgagctgcctgtgggagtggagccggagcttcgctagattttattttccgctgcagttttcttcttggtgaggacttagtgcctcttaagtaagtacttatcgttttagttaatttgatgaatctgtatattaaattgtcagtttgtgtacctcggctgattcctggacgaggattttatgcacaaataagtttggaaatcacttgtgaatttccgggcgtgacatgtaccccggctggtcctggacggggaatttaatgcacattctgcttgaaattctattcgggaatttctgggcgtgacaagttggtattagagccgaccttgaccgtaggacaagccaaatggaaaaacctaaaagccctctgaatccttttcattgcatatgttcttggcaattggatttgttccgggaaaattgggatccgttcttgtggttcaagggaaaaatcttggtcgctcgtttaagtgagatttgtcaaaacgagtcaatctagagttttagtaaaactcttgagatttattcgttagtcagttgggatttgatgggtgaaatgcattaggtcctagctcaggaacatgggttgcaaggtatttcagctcttattgttattattagtatgtatctaatttccccattattttatcgttatgtgagtctgtcttatttattcgcactcatgcaaaatgatctatgcataaaatttcgctcttattcgattctcttatttgagtcttttattgctttatttaaatttggatttgagcatgcattgatcctactcctttgtcttctctagatggccggacacccacccaaccaccgcggagaaggcatgattgattttgtggcagagttggcacgcatgacgctggtggtgggctaccccaacgcgccagagtagacgacggttccaccgctcagtggcgagcttcctcaccgtgttcgcttggaggtccatggctacgtgggtacctgcctagctaacatggtggttgaggcgtccggaggcacagcagatcacgcctgtcaggaggcagcatacctgatgatggccagactacgggagcgccacaactacatcttccatgacatggcataccgttttcaccctcgtcgagccagtggtgatgatgtcagcaccttccgtccgacaaccggccagaacgacaccacctttggtcacatgtgtgctgtgatgagtggattggataggatgcactcggacctgcacaaggcgaccaaggccttgaacgatgggaagctcatgaggatcgtcgctctgatggacgagatagcgcgcctgaagagggagaatgctcagttaaagggtcttcccgcgccaggaggagtccggatccgcaccacaccccgcaagacgacgacggcacccgtgcgcatccagcttgcgcccaggaacccacctccatcagcagctcccgcagcacctccagttccgcccgcagttcctgcagctccagctccagctcccgcgtccgctctctccttcgctccagcatcagccgccaggggtccagccagtggcaacggaggttggttgtctgctactcccagtggcagccgcgatctcagcagcagcagctccagtggctcagagtcgggcagcggcgagacttatctgccaggctccaggagtcgctcagagggacctggtgacgagcaggaggacgccttcgactccaccgaccgcaggagccgttccgagcattaggctcgttttccattagttaatcgactgtctagcttctgcttgttagtttgtgtgtttaggttgcttgcttggggtcagtcgacggtcgatatcatgtgcctatgatatggctgtcttaataaggattttcgcttgttttttttaagtgttttaattcagatcagaacaattgcagtttaaattcctttgtaataaagcttagtttctgagcttctgtttttcttcttttccccgtctgcttctccctccagatggtctacaccaggaatggtagccgcgcaacaggcgagggcagcaacggcgaagagcgcactgatggggcgcatccccacagcgattccggcaatggtccgccaccacttcccgagaatccgacgctagtccaagtaatggcacatcagacccagatgatggcagccatgatgcagcaccagcaccagcagatgcaccagcggatgctgcagcacgccgaacagcagcatcaacagtttggtccccctccccctcagtccaagttgccagagtttctacgtgtcaggccacccaccttctccagcaccaccaaccctatggaggcgaatgactggctccatgccatagagaagaagctgaatctcctgcaatgcaatgatcaggagaaggttgctttcgccacacaccagcttcaaggtcccgcgtcagcttggtgggacaatcacatggccacccgcccaccaggtactgaagtcacttgggtagagttctgccgtagcttcaggaaggcgcaggtgccagatggggttgtggcacaaaagaagagggaattccgggcactccatcagggcaacaggactgtgacagagtacctccacgagttcaatcgcctcgcgcgatatgcaccagaggatgtccgcaccgacgccgagaagcaggaaaagttcatggcgggtctggatgacgagctgaccaaccaactgatatctggggactacgctgacgttgagaggctggttgacaaggcaatccgtcaggaggatcaacgcaacaagatggacaggaagaggaaagccgcacagttcagggcacctcagggaagtcaccagaggccgcgcttcgctcccaggcagcagggtggacctaccaccatgatcgttcgtcagcaccgcccgttcaaccctagcaactttccccagggcgccagtggcagtcagaaccaccatggaggtcagtccaaccgcggtgcagctccacgcccaccaatggcaccggcacagtcaggcccgcccgcgcaagccaagaaggagactggagcaaaaccagggtcctgcttcaactgtggtgagcttggccacttcgctgacaaatgcccgaagcctaggcgtgccgggccaaggtttatccaggctcgtgtcaaccacgcatctgcggaggaggcacaagcagcaccagaggttgtactgggtacgttttctattaactcaatccctgcaacagtactttttgattctggtgcaacgcattcgttcatttcaaagaagtttgttgggatgcatgggttaataagagaggaacttagcacaccgatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggggtcatcgattgtgcgaatcgcacagtcaccttgaccaacgagaagggagaaaccgtggtgtacaaatcactagtctcaccaaagcaaggggtctctttgaatcagattgaagcagaaatcccagtggacaccgtggagaagaatttgaggaaattggaagatatacccatagtctgcgagtatccggaagtgttcctcgaagacctcactaccatgccacccaagagagagattgattccggattgacttggcaccgggaaccgccccaatttacaagagaccgtacagaatggcggccaacgaattagccgaggtcaagaagcaggttgatgagcagctgcagaaagggtacattcgaccaagtacttcaccttggggtgctccggtcatttttgtagagaaaaaggataagacgaagaggatgtgcgttgattatcgcgcactcaacgaggtcaccatcaagaacaaatatcctttgccgcgaatcgatgatttgtttgatcaactgaaaggagctaaagtgttttctaagatagacctgcgatcaggctaccaccagttgagaattcgggaggaggatattccgaagacggccttcaccactcggtacgggctatatgagtgcacggttatgtcgttcggacttaccaacgcacccgcattcttcatgaatctgatgaacaaagtgttaatggaatttctggacaagtttgttgtggtgttcatcgacgacattcttatctattcaacgtccgaagaagaacatgaacaacatctccgtctagtactcgagaagttaaaggagcaccagctatacgccaagttcagcaagtgtgacttctggttgacggaagtcaaatttctgggccatgtcattacagctcagggtgtggcagttgatccatcaaacgtggagtcagttaccaaatggaccccgccgaagaccgtgtcgcagattcgaagttttcttggacttgcaggttattaccgccgattcatcgaaaacttctccagaatcgcccgacccatgactcagttgcttaagaaagatgagaagtttaaatggacaactgagtgcgataagagttttgaggagctcaaaaagaaattagtatccgcaccagttttgattctgcccgaccagatgaaagacttccaagtctattgcgatgcatcccgtcacggacttggatgtgtcctaatgcaagagggcatagtggttgcgtatgcctcgcggcagttacgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgcattaagccggaaaagttactgcactgccctatgcatcgagggcatgtgtgaggaattgtggcaggagtttgagcatctcaacgtgggaattgttgaacacgggtttgtagccgctctggaggcacggcctacgctcgtggatcaagtcagagcagctcaagtaaatgattctgaaatagcagagctgaaaaagaacatgagggtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccaacgagtgaaggcagagcaccaaagaccagcaggtttactccaacctcttcaaatcctggaatggaaatgggaggagattgggatggactttataacgggactgccccggacatcgtcgggtcacgactcgatctgggtagtcgtggatcgactcactaaggttgctcacttcataccagtacataccacgtatacgggcaaaaggttggcggagctttacctttcgagaatcatgtgcctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctctcgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgagcgtcaactgttcgggacagaggtattagcggaagcagaagagaaagtcagaatcatcagggaaaggttgaggattgcccagtctcgacagaagagctacgcggataaccgccgaagggagctcacttttgaggcaggagattacgtgtatcttcgtgtcactccgctccggggagtacaccgttttcagacgaaaggcaagttggcaccacgcttcgtgggaccatacaaaatcttggaacgaaggggagaagttgcttatcagttagaacttccatccaatatgatcggtatccatgacgtgttccacgtgtcccaattaaagaagtgcttaagggtacctgaagaacaggctgattcgaaacacattgatatccaggaggacctaacatacgtggagaagccgattcgtatacttgataccagcgaaagaagaaccagaaacaaggtcaacaggttttgccgagttcagtggagtcatcattcagaagaggaagcaacctgggaaagggaggatgagttgaaagccgcccatccgcacctcttcaccagctcctccgaatctcggggccgagattccgtttaaggggggtaggtttgtcacaccccgaagttctcctcccaggcctaaaatttaatttataaacgaccccccaagaaaatgcaggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttccttcttctttttctttttcctccctttttttttcctccttttttcgaatgggccgccggcccattctctccttcctccccctcctccctgctgggccggccgcaggccgaggcccagccaggccggccgcctccctcctctccccggggtcgccgacaggtggggcccacctgtcgggcccttccccaacctccggccactcgcccacgtcgcccatccgaccgccaccccgcctcctccggtccacatcggccacgcccgtgcgtgcgccgcgcctcccgcacccactccccctctctctctcgccgggccctcaaccgagatggccgggattcaaatttgaatcccgccgctctctctctctctctctcccccaccttcaacctcccacgtcgccgacgaaatcgggagcgccttggccacatccgtctctcccgagcccctataaagcatgcccgcactcccctccacatattttctttttccaccgctctctcccgtgccctccattgctcccgcgccgtgcgcccatccgccgccgcctctcccgctactccggccgcctctagccgccgctacacttgccgccgcaccgcgccgtcggcgccgttgggttcgcgcggccgaggtccaccccgttcacccctcctccgtcgaggttcgtcgccggagccctcaccccctcgcactctggtgagcaccatctctaccgccgccttcggccatggtttccgcccgccgtggaccacccctctccctctaatctctctcttttcctttcttagggcatctcggagctcgtccgcccgccgacgtcgtcctcccgtggctcatcgtcgacggtcgccgccgtcccattcggtgaggactcccacccctttcctttccttcccccgatcccccgtgcgtcgccgtcgcccgcgctcgccgtcgccttcggtcgctgccgccatccgttgccgccgtttccgcgtcgttttgcgccgtcgccccgccgccggatgcgccgccggcaacgcattcgcgcgcgcgccgtcgccgcggccggtcggccggccttgagccaagccgagccgggtgccgccgccccttttctttccccccccccgccgctgaccagtgggccccgcgtgccggcgcccttcctctctctcccgagccgctgactggtgggccccgcatgtcggcgccgcttccccgtgctgatgtcagccctggaaaatattgcgcaataaattatttaagaatttttgttatagtaataaacacagtgaatcttctaaaattcataactaattcatccgagctccgtttaagcccattcaagtctcagtaaatcaagagtaatgtgtagaatccattaaaaatggttttgttccctgtttcagtagtcttatagcctgtttgcattgtttgctttgtatgtcgctagattccgactcctccgacgctccggtgtacttcgaaatagtcgccgaggttcctccagcagcagagcaaggcaagtcatgcttgtcacttgaacatgttgatcctatattgcaaatgctctattgttttctttcaaatattgcattgttttataatattactatgggatggttacctattgttacagctatgctttttggataccatgctcctttgttagcttggggttacaacatgattagagtttggactaggaattgcttagccatgcttagttcaactagttcacaatggggaaaatcctattaatgtttagactgttggttctaatggttttgttggattagtgccaccgctttggtgttggttaattaaaataaatcacatggtgggctgtgggtgcatggttttgctggtcgcacccatggcagttaaggaccggttcgcgggatgccctgaaagaacttatcgtacttaccacaagccagcgtgggcaacggctgggcttgtagtgtagctctcatctagtcgacgcatccaggcaagggtgggcgtgatggagcggggcgggccctgcgacggcctctgtcgtttccggattcacctaggcacgagaggggactgcccgttgcccgctggggacgggggtgaaacctgaggtgtggtgtgcttggctagagggggttatgcgaagggtcctgtcacggcctctttctgatatgtcgtggtggcatgtcggcgcatggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaaattggatagtttaggtggatggttgggcctgtcgcaacgtgggttagcgttgggcagtggatagttgatattaattaattattacaacggtttaatctttcaacttctgtttataaatgctcgctttatgcaaatgaaccgctctagctcttctttgataattccctgcatcatacccctattccggtatgacttgctgagtacagtgggtagtactcagtcttgctctacttttcccaacccagagttcgagtttgggtcagataaaggtttctctgaggagtaggcttcgtccgtgccgtcgaggatgcctgtggagtggtgttcccgctgcagtttagtcaaggcttagctcctgttgtctttcttttcttccgctgcatttatgtaagacttttatgatgtttgtaagacgtggatctgaatgtcaacattgtcgtttgtgtactgtcacatcctgatttttgtttcaggatttataaattatttaataaattattaatagaatttatattaaatgatctttaatttacaagggaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttctggtttaaaaatccttaaattataaattgttgtttaaaaggaattattagaaatgattttaaaagcctaaaagagaagatctaattttaatttgctaaatctcaatataaaattgggctagataaaattttattaaatactttgcttaattctataattcctagatttttctgggatttatttgagctaaggaagtatttttaataaatggaattgcatttcatgaataatttaaattgaaaaaggtttttaaaagtcttattttggctttgggccgaaagtcggcccaaaacccctctctctttctctctccctccccggcccagtcggcccagtcagcccgcgctccttccttttctctctcggtgtcgctgacaggtgggtcccacctgtcaggttcgtcttcctcgcgccgtcgccgccgcccgaaaccctagcgcaagccgccgccgtctcttccaaattcggccgcgcctttccttctccggccgaattgattgagggcaattgatccttgagatctcctcttccttttctcttttggaaacatcggctaattttctttggaaaccggtggatttgagttggattcggattcatctctctcctctaaccccgacctttccttctcgtcgccggcagccgtgggccttcactgccgcctccttgcccctttaaaaggacccccggtgtctccgctacccgccgcctctttcgccttcgcccgccgtcgtgtgtagcgccctagcctcgtgagcttttgcgccgccgtcgccgccgttcgtccagccgtgcgccgccgtcgctacggtcgtcgtcgtcactcggaaaggccaccgtcgggatcgccaagtcgtcgccgtccccgtccgccgcttcgccgtcgccgaagatcgccggagcaccgtcgccgccgtcgacccgatctccgccgccgcttcttcctcgtcgccgtcgccgtccgttgttcctccgccgcttctttggtcaccggtaagttcgccgcgccgcgctctacgtcctggtgccctccgttctcgttgtcgcgccgtcgttcgccggcgagcttgcgctcccgagccgccgccggtgctgacgtcatcgttgccgttccccgtgagccggtcgtggaccgtttgatctcggccttccgttttggatagggttgatctcggccgtccgttcccgtgaaccgtcgccgtgcacccggtccaccgcaaaccctagccgctgatgcaataaatcctttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcgtaataaattcatttgaagtcagaatgaggccgttcaagtctcataattcatctaaaattatgatctacatgtttgtttactttttatgtattatttatttggtttttattagtctttttcttcgttttgcgtgatagttagtcgtttccatcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtca

SEQ ID NO: 68857 - DNA, 1242 bp, Oryza sativa
ctctttccgatatgtcgtggtggcatgtcggcgtacggaaacgtatcgtggggctgtgtcttgtgggtacagttgtacacctctgatcagagtaaaactattcgaatagccgtgcccgcggttatgggcggtcaaccagattcaccgtgattagtctcaccctagtgtaatcttttgaaattggatagtttaggtggatggttgggcctgtcgcaacgtgggttagcgttgggcagtggatagttgatattaattaattattacaacggtttaatctttcaacttctgtttataaatgctcgctttatgcaaatgaactgctctagctcttctttgataattccctgcatcatacccctattccggtatgacttgctgagtacagtgggtagtactcagtcttgctctacttttcccaaccccagagttcgagttcgggtcagatgaaggtttctctgaggagtaggcttcgtgcgtgccgtcgaggatgcctgtggagtggtgttcccgctgcagtttagtcaaggcttagctcctgttgtctttcttttcttccgttgcatttatgtaagacttttatgatgtttgtaagacatggatctgaatgtcaacattgtcgtttgtgtaccccggctggtcctggacggggaatttaatgcacattctgcttgaaattctattcgggaatttctaggcgtgacaccgtatgcccgttgggtacaggttttgacctaataaaaaacccatgggtactaaatggagaataaacctaattctattagggtttttacccatgggtaaataggcaaacatgtcaaattgccatccctaattgcattggctacaatgcgtagggcaatttggtggatacctggctacaaacctcacccgagcagcccttatccagatgagcgacaagtggttgaggaagggatcctatggtgcgactgcacggctccaattgcgtgaagagacggacagctagccgcatgcacgatctccacgcgtggaagcgcggctcggctccgctttgctcgttgctggggatgcggactacgcggctagaagcagaagcgacgcatgtcatcaccgcgtctgtttagggtgcttaagattacgggaagtagttggttggtggtcaatttctgagaatgtgaaaaagctaagtttcccagcgtttgattaatttctagtttattttctatattaaataactacagttttttagaatcaaagctatat

SEQ ID NO: 68858 - DNA, 2809 bp, Oryza sativa
atgcataattaatgcaacggggtacaaggggtaataagatataggggttaagttctcaagaaagcagcatttaaaagtcacttagttgcccaaagccattttaaaaagacgatcctagagttacacagtattattaatcagggtcgtgaacccgcacgagcctgccttaacccaaggcctacgatgattcagaccgaactggcaacccgaccttgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactagcatgcacccaaaccccaccgaaaaacaggttttaggggctttgaaagaggaagagaggggtatgtccaattccacaataagccaaccattccatagtatccaagtgatatgagaattccccaagtctaaagttataaaaccacctaatgttgcctaattaaacagcgaagcatctacctaaattcatactagtggaaccatgaatagagtgtccactagttggggttttgtttattctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaaaggcttttactctactaaactccatataacaagcagaaacaaagcacaaaaatgggttcttggcttcttaaggaaaaattagagacttgaacggtccaattccgagttcaaatggccaagttatggccatttgaagtttatatgctctttaaatggatatttacgaatttctttatttaaattttaatttaaaatcggatttattgcgtcagccgaggggaggggcgcgcggaccgggtccacgggagtggggcccacgcggcagcctctcggtccacgatggaccgggtgcacgcggcttacgccggccggcgccgtgggtcccacgcgtcagccgcacccgagggcgcgggcggctgacggccgggccccacatggcagccgcggggcgcgcccgaaggcggcctcgccggcacagccgacgggaggcggcgcgcccgcgccccgatggtcgccgccggcgaccaccggcgcggcggagcggcgcccgagagaggggagggaagggggaaacgaaatgggcggtccacggctcaccccgggtcgacggcgacgacgggaacggcgaccggagcggaggaaggcggcggcgcggctcgggttgacgaggacggcggcgttccggcggtcggcgggcgaaacggaagggtggacgaggtcggcgaggacgcggcgaagccgaaggaggcgacgccgaggcgggaggcggtccggggtgacgatggcggtggaccggagctcggcggcgacggcggagagagagagagcgacgtcgcgagctgaaatccggcaaggaggaaggtcggcgagaggcgaaaccgaacggaggaggtccgggaggggtttaaatagtgccggggcgatagagggtggccggggaagggaggaaaccagcgcgggaggtcggccgccatcaatggcgccggcgagattaggggagcggtttccacccgaattcgagggagagagggtgggaaaaatggggggaaagagagagggaaacacggggagtgatttccccctctttattgcgcgcggggacggcgggaggcggcgggattcgcggcggcggcggcgctagggcacgggcgaggcggtgggagcggcgggaggatagggatgacaggtgggccccacccgtcagcgagggtggcgggcgggcccgcccgtcagcggcgcgcgcgtggggagaggccgagtgggccgcggggaggaggagagagagggagggagatgggccgagccggcccaagagggggaagggggggggggaaaaagactttttagagcttttctttttataaaaccattttaactttgtttatttcttaataattattatttgtgctctaaaaattccactaaaatttgagggctccttttagaccaaggagaatttaacaaaaattctccgggccacatttgaatttttcttgtacgtattttagtgtttgccaatttcttttcgaattttaattaattctattattccttttagagaat

SEQ ID NO: 68859 - DNA, 2817 bp, Oryza sativa
tagttcatcagacggaatctaagcagaaaagagcaaaaacaccaaaacaacacataaacaagcatgaacagtacatgtggatatttttaacatgtagatctcgattttagaaaaatttagagacttgaaccaactaaatccgagctaagatgaattagttatgaatttttgaagatttaatcggattaaaacacttatattgattttaattgaattatgacgcaataatgaattatttttgaaaaggaaaagaggatttattgcgtcagcggatagggtttgcggtggaccgggcgcacggcggcggctcacgggaacgaacggccgagattgatccatccaaaacggacggccgagatcgatcggtccacgaccggctcacgggagagggcgacgatgacgtcggcggtgacgtcaccaccggcggcgacggctcggcggctcgacagctcggacggcgcacgctcgccggcgaacggctgcactacggcacgaacggagggcaccaacgggtagagggcgacgcggcgaactcaccggcgaccagaagagcggcggaagatcaacggacggcgacggcggcgaggttgaaacggcggcggtcttcgagtcgacggcggcgacggtgctccggtgatcttcggcgacggcgaaggggcggacgaggacggcggcgacttggcgaccacgacggcggtcttcccgagcgacgacgacggctggaacggcggcggcgcacggctggagcggcggcggcgacggcggcgctaggttacacggcgctagggcgctacggacgacgagaggcgaaggcgaaggtggcgacgggtagaggagacaccggggagccttttaaaggggctaggaggcagcggcgaaggcccacggcggccggcgacgagaaggaaagatcggggtttgaaggaaagagaccgatccgattcgaactcgaatcaaacacattccaaaccgatttagccgatgtttccaaaggagaaaaggtagaggagatcccgaagattgtttcccctcaatcaatttcaccggaaacggaaaggaacggccggatttggaaaggaacggcggcggcgcgaaactagggtttcgggcggcggcggccggaggtcgacgacgaccctgacaggtgggccccacctgtcagcgggcggacgcgcgcgcgcggcggactgggccggactgggccgaggagagagagaaaggttttgggccgactttcggcccaaagccaaaagagactttttaaaacctttttcaatttaaattattcatgaaatgaaattccatttattaaaaatacttccttagctcaaataaatcccagaaaaatctaggaattatagaattaagcaaagtatttaatgaaattttatctggccccattttatattggaatttattaattaaaattagatcttctcttctaggcttttttaaaaataaatctaataattccaattaaacaacaatttataaattttgaattttcagggtgtgacatatgttgataggtctactttgactttggattcgctttacacaaaactcaaaacacatgagatgaatattctttctcgaagagttgattctaagtctagtgcttaggtttcttcctcgacttctttggatgttggtgcctcttcatcgaagtcttttattcttgctttaattaatggcatatccgatgaacaactcgaataattcgaggaggatttggttttggttactaacaagttttctcgagctatgaataatgttaggtacaggaaaagaggtggtccaaattgttgctttgaatgtggttctcttgatcaccttcgtttgcattgtccaaagcttggaagaggcaagatggaagataatggtggagagaagaccaatgacaacaagccgaagagcacattcaaagggaagaagaagaaggagactctcaagaaggcttttgatcaagtctatgctgcttttgagccactaagtgatgtagatggtgaaagtgaagatgaagataagggaaagaacatttccggtgtttgcttcatggcacgtggtgaatcggattcggagtgtgaagacaatgaggtacgttcttttgagaaagctattcttattttaagtgcaaaaaataagaagtgtgagaagatgtatagaaaacaggagtttattattgaatctcttaattctgaagttgctagattaaaatatcttattcccaatgattgtgattgcaaaagttgtgaggttttaatgaatgaaatttcaaaaattagagatgtcaatgctgcacatgatttgaaaaatagatcttctctagatcttggatttgccttgcgcacacacactttggatgagttgtttttgactaaaaagttgttgcaaaaatatcaaattgcttttcgtgctagtttgatgtttaacataatttgagccaaaaagttaaaataaccacatgatgttttggattgctcaacatgtacattaaacaagatgaaactaaaagatgctttaggtcgtgttgagtcaatggaagatgttgtgaaaactaatgaagtgatttcttgctccaaatatcgtaaaagcaaaggtgtcatggtaaattgtgaaaattgtgctaatttggaaaaagaggtttcttatttgaaaaattctttgcaaagattttctgatggtaagaaacaacttaacatgattttggatcaatctaaagtgactagttacaatagggtgttggttttgatgttcatgactatttcaccaaaaatcaaccaaatgttttgagtgtgactgaacatggtgaaattt

SEQ ID NO: 68860 - DNA, 1648 bp, Oryza sativa
aaaaacaaatctttcaaaaccatcttcttttaaagaaaagtacacttgttcttttttgtggtaaggatgaacatcttgatggttaaattagctcgtaaacagaaaaaagaagagataaatggcttttgcaaaatcaaagtggcaaaaatctggttttccctcgaggaaaccggtcagaccgcagtgggtcccgcggtcagaccggttactgagcggcggtcagaccggtggttcagaagcggttagaccggcccccggtgagaccggctactgtactacggtcaaaccggactcggagaaatttttctgaaaattctcaaactgtttttgcacgtggatatatgcctattggatctactggtcgtgtgtcctagattcctaaatttgtattatctaaccccagtcctgaggcttcaacatcttcatgtgtgtaggctttggtggcgaggaaggagaacgtgtggatcgtggattccggttgttcgcggcacatgaccggtgataaaaattggttctcctccctcaaacaggcatccaagactgaatcgattatctttggtgatgcttctactagtgcagttctcgctacaggtttgctcaaggtaaatgacagattgaattgaaaaacgtagctttagttgaggatttaaagtacaatttgctttcagttttacaaattgttgatgaaaattttgaggttcattttaagaaaactgaaagtaaagtatttgattcttgtggtgattctgtactgaatatttctcgctatggaagagtgtttaaagctgattttcgaaatcctgtttcacctgtgataacatgtttggtcgctaagtttgataaggatgtgatgttttggcatcgtagacttggacatgtttgttttgatcatctcactaggttaagtggtttggatcttatttgtggtttgcctaaacttaagaaagatcttgatttgatttgtacaccgtgtcgtcatgctaagatggttgcttcttcacatgctcctattgtttctgtgatgacggatgcaccaggacggctgttacatatggacattgttggtccagctagagtgcaatctgttggacgaaagtggtatgtgttggttattgttgacgatttttctcgatattcttgggtttttttcatggcaactaaggatgaggcttttcaacactttcgtggtttgtatcttcgattggatcttgaatttcctggttctttgaaaataattcgaagtgataatggtggtgaatttaaaaatgctttatttgaacaattttgcaacggaagaggtcttgaacatgaattttcttctcgtgttccgcaacaaatggtgttgttgaaagaaagaattctgttttggttgagatggctagaacgatgttggatgagtatcacactcctagaaaattttgggctgaggcggttaacactgcatgctatatttcaaatcgggttttcttgaggtcaaaacttggaaaagcttcttatgagctttcacatttgcgtgattttggttgcaaatgttttgtcttcaaatatggaaatttggataagtttgaggcacgctctactaatggaatgtttcttggttaccccgcacattcacgtggctatcgtgtacttgttttggaaactaaca

SEQ ID NO: 68861 - DNA, 603 bp, Oryza sativa
agtactagttgaaatcgaagaaggaaaaagggagtaaacattttgcaaatagcattagggaaaaggaggaaaagggactttcgcaaatagttttatgtataaaatatgtccttaggttttatccacttggcttatcctacagtcgagatggctctgataccatcttgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggattagcgggcctatggctccatcttcacaggcgctcaactggggtgtaagccaagactccacctaagacatcttctccaaagcttctcttactgaagggggaaaagatagagcaagaatgagtacaaccacagtactcagcaagccacaccggcagatgcatgattaatgcaagggggtacaaggggtaataatgatataggggttaagttttgcagaaaacggcatttaaaaatcacttagttgcccaaagccattttaaa

SEQ ID NO: 68862 - DNA, 684 bp, Oryza sativa
tatcacaatcaatccatcctcgttttgtttatttttgaaaacccacttgtttccaataatattatgtctagaaggtggttcaactaaggtccaaactttgtttccctcaaaattttcaagttttttcatgcatggcattaatccacgatacatcagttaatgcatgagtaacatctttgggttcaaaagaagcaacaaatgcagaatttgcacaaacatcatgagtcattaccttagaccttgtagtccactcacctatattaccaatgatttgttttggcggatgtcgtcattgaatatgcaaaggagcagcgacttatgatgttatatcacgttttgtaccagtactggtcgaagttgtaccctctagaggaccatctcgatcagcatcaacagaaccggaagccaacgatcctggccagtctgaccgctcatcctgagtcggtctgaccgggggtgtactggtcgaagttgtaccctctggaggaccatctcgatcagtgtcaacagaaccggaagccgacgatcctggccggtctgaccgctcatcctgagtcggtatgaccggaggtgtgtgttgactgtcattatcaatcaatttcgaccgtcaataatacccaaaatagaggagaactagtgatgcttgcaatgcatataaattgttacaataataatattccacta

SEQ ID NO: 68863 - DNA, 4991 bp, Oryza sativa
ttatgagacgttgctgtacaagattaccagcattttcttcccaatgaacaatacagaatgttgtttcttattaatggttctatccagcaatccagtcttctataggttgtcctgtttttgagcagtattcaggagggcagatccctcccttgaatttggaagtgactagtatattcaatgcgtgcgcatatgcaatgctctttgcaggcacacaacattattttagcttcattgaattctgacatttgctgttttggcaaatagttatgaacctctcaacaccagtctgtgttttgtaggtaccctactttgaatatgctcacttgcttgtaatttgcagtataattgattaaagttcctcctgaagtaacttccatcaatctattcgcgcagttaatatgtgtacgcatgatcaagtttcagtattgctatttgtatcacagttattctttatgggttggttttatttactttgcttcacttacaagactgctcagagattataagcaaagctgtgtctttgtaatatgtgggggtagaccattccttctttaggaaattcctgatgctgattccctgtactggaatctgatagtagaaattttttaagaaatttttttatgctgattccctgtactgtaatctgatagtagaaattttagcactgagccactgactggcgttttaataatcgcagagctcacactgaagtctgccctcatgctctggtcttaatttgtcatattactgatgaaagtcttaggaaatggtatgagcaacaaatgaaccacatagttcttttctattgttgtatggcttgataggtataagtaaagtacctttgttgttgcttgattccttgcaatacatcaactgtaaactatgtgttgaaccaaagttgcaaagttttgctgctattcttgctacttaatcttcgtttctgtgtctgttcagaaggaagcccatgacttgaactgaaaaggtaacgttacaaaagaattagtacaaggccgaaagcaacaggaagggtctccaactgaagagaatagaaaaaaaaaatccagaggagaccatggcagataacagagaggttcaaagcctttgcattgctctatctcaaagaccccgaaccatcctcagttccatttaaaacgtgcttaatagaaaggtaatgtttcagtaaaaaataaaaactaacgttaaagcttgggttacagtacgattacgtcttgatgcaaacttgcaaagtgagagtctgcttccttgataaaaacaaattcctgaagacttggtggtttgttgtttttctacaatattgctttgagttcttgctaaactatagctgtgtaatgtaatgatgtagctaagtttcagattctgtggttcattagtatgcagagatataagcgtgatatttaccaattttctagctctcataatgggttccatgttcaagtttactagtgtttcagtaaagcctaagtggaatcttgataatctctgaatagagaattttgatttttttaaaaaaggatttaaaattctgctaagtacttaagtaccatgccgaactggtacatgctatttgtattttacttatgatctttgtcaatttctaagattctaatcatggatacgacttgtctaggccacgtgtgattcataatggtgactggtgggcgtcttctatggctgcagcactcttggaattcaacttggtaattggtgtgaatcatcaaatatattgttacatggttccgaagttctaggacggtgttgcataattgcagcatattgttattatattaatcattctaagatgatgttttcgcttcaatataccatgtaaggtattcaattttgtgacatagccgtgaaagtttctacctatccatcatttctcaatgaaacgtatgtaatgtatattttgaactcatcatatgggattctgaaatctgaaataagaacgtaactgtgttggctcgaggattcactgaattaacagagttaggctccacaagcttttaacttcaacttgtccatgctttaaactgctttgcacccactgaacttttcaagtgtagcacattttacatataacttattgagcaaagaatgaatgtaattcttggtaataacaaatatcagtttccatttcattgtctgcctagtgctgcctgtatatatctgtgatgaaatatttttacagcgaggagaaatgtggaaatatgtctttccccttcctgcagcattgcaaccatggagtgaaaagagcgctggctggttgaatggtggtgaggaagcatccggcattatttcatcctaagagcaatgtagtaaacatgggtcatccaagacatggggctagcctccacatctgttgccactgtacactttacaattagagcttctttatggtttcttccactgcgcgttcataatacctcattctctgtgtagctttcactgcacggtcgaaatccctcctttcaaatgcttcctggaaggaatgggaccaggtttccagctttctcttaatctgataaaggtgatatagtgcgagcctagaaatcagtcaagcgtatttatgcttcgaaataacaaccatgacataattgtgcttaacagaacctgagattgtatcttctccagggtttgagaatcattggcatcattaactgcttcacgtatctccatcatctgcaaattatgtagaaatatagctttgtttcttcaaattgatcttgaattgaaatatacatgtcatcgcaattactattacttctgtgtgaagttattgacacaagcgtcatggaaatatataaactagtgattaagtggctgcatcagaaccacagaaaaaaagattcaaacaggttacctccataagaagttcaggatcagtgatagtcttttcttcatcaatgggtatcccctctagttggagctgcagaatggttttatatggttgagaagcaatttaaaagatgatgtagatggatgcttacatagatgttccatgtaaaaaaggtcatatgtttacaggtcaagtatattttttatattattttgagtggagatggagatggtttagcctcatataatcataacctaatatgggttaaaatgagatgaaataggctgtattttttaagtattactggaagaacttaccaagtataatgcccttgacaaaggtttgctcagtgtgcggtatgcatcaattacaagtgctgattgctcagcagcaaaggctctctctttctacacaaaacagaagccaagtcacaaattgttttgaagacaaaggtacgaatactatagattggtaagaatgccagggcctagggagagacctcagatttagaatgaactaggtcaggatgtaacttcttctgccagtctttgtatttcccttctaaattgttatcctttatggtgtattccctttctctgccaaagtaatgaagtaaattattgatgtatgattaaggcatagaaaatattgacagaaacttatgcaattgtagaaaattttgaaaatattattttaagagtaaaattcataacgtgattaccatgatggtaccactgtatttatcatgaagcagatcattggaacaaattgtgaatttgccatatcattacaggagaggtcaaacacttagggtggacaaaatatacagtgtggatacaagactatccaactgaaacgctcacgagttttctgaaggggagatttggaaatttaataaattataagcattaagcaaataggtagaaaatcacgaaaccatcaccaaacaaactacttgcgttattacctaaacagccaacatggaaatgaatagaagggaacttatcacttatcagcataataaactatgcagacatattcccccaggtaggattggtggatagagcaagttggaatatgaacttcgaactatatccagctaatcccaattccacctcccaataattcttttttttaatattacagatcagtgcatcaacaatcaaacattatactaacataattgcattgccctagaaatttccctaaaatgacaacatgttttggccaacctaagagtcgcatcaaaatgcacatatcttgtaacaatcattgcaaattaccagtcctattatcgcaatcacatcaaaattgccagtaggataattttcgtcctaaccataaaagctaaagctggtgtccagtttccctttctgcataacccatcaagctacgaacacttatttgcgctgcagatgatacaaagaaggcccaagaacatagaaaccgtccttgtacaagtagcatttcagcattgcaatacataatgcctacgagctgagcagttatgacgatcactgcacaatccaattatacccaaaatacactagaattcgaaagagacgacacgattcattcacaaacaaaagacaataatgagccaattagcatctgattaagtggggatgctactcacaggccaaagatccggaaataatcgacggcggggtcgacgggctgcacgctgccgcaggacccgcatgagaggaacgcgccgctcgcgccgcagctccagcactcgcctccccctgcccggtccgagaggctccgggaggaggaggaggagccccgagcgaaggctgcgagatcgcgggtggtggtggtagaggcggaggaggaggaggaggaggagggcacggtggggacagggggaagcgggttcctcctcctggcgccgcggccagcggctccggccgccgccgcgaggtggaggcggagctgcccgggtcggcgccacatgtggggctttctgcggcgggggcgcctctgtgcggatgcgggtaagtccggcgagcggcggcggcggcggcggcgcggagagaagggggggatatgcggttgagttgagagccaagtattttgtgtgggtttcggtggttgacaggtggggcccctggtagctttctcccgtgaa

SEQ ID NO: 68864 - DNA, 3273 bp, Oryza sativa
ggcgcctctgtgcggatgcgggtaagtccggcgagcggcggcggcggcggcggcgcggagagaagggggggatatgcggttgagttgagagccaagtattttgtgtgggtttcggtggttgacaggtggggcccctggtagctttctcccgtgaaaaactagtgcggaggtgtgttggttttaatggctttggtttagatcccatcatggcttatgtggacgttaagagcaagtccaataatataaccaattgttggttctaaatcatttatatctaatctaatactctagtcatcctatctttctataaagttatcccccactaacttcttaagcttgacatgcaaagatgccacatcatcatctactaacaagataccatatcattatccactaattaacaagatgacacatcatcatccactaacaatcatcatatttaaacatcatgcaaacatactatatctttatagtttttataatttaagagttttttaaatacaaacatattaaattatcatccaatataattcacataatgtttcaatgtatatctttattatgttttatgatatcctatatacttatatagttcatccttagtttgtgcttaaataattaatctatggtccaaattatttttctccttttttttctctaattaagtcatatcacatcaattatttttagcctttagataattaatctacggtccaaactatctccctactactagcttactttttacatttgaatcaccattctacatactatataaatttaaattatcataaactacattaatttatttaatctgatgttatctagctattttacatgttattttttttattgttatcatactgaattcccgcagcaatgcgcgggtttcacctagttggatataatagttactccctcggtactcataaaggaagtcattttggacagcgacatggtctttaaaacacaactttgacctattgtttctataaaaatatttattgaaaagtgatatatgtatacttttatgaaagtatttttcaagacaaatctattcatataatttttacattttcaaactcaataacttgagagttatttatgatttatattcccaaggtttgacttaaacattatccataaaggaatagaaacaataggtcaaagttgtgttttgaagaccgtgttgctgtccaaaacgacttcctttatgattactactccattaatactctgtcctacctctaatatacacataacgtcttagagtctgtgttacagccggctacaaatctgtagctcgcttttttctcactcttctcttttcttctcgatatgtggttatagttggtttatagcttgctattgtacctgctctatgcaagtactactagtactatctgctcggaacttggtagattctctctttttcaagtttctttttgtaagtttacatgtaattttgacaagtttattacgatactcgaaatctatgtaagagcagagattaataaatgatgcgctaccatagatcatggttgagatgataacaacatttttcgtatgaccataacaggataatgtttacaacaaaaaataatactgatattattaagcttgatatggccatacagcgaagcttgaaattgaaattaattaagcacaaggtggtacaatgatattagtgtgctaacccaagataatgtctattgataaaaaggaaaatagccaaaacaatgtagcttgcagatcaaaagcggacaaattggataagtctagtgtttgatcatgccatacgctagttgaattctagtggacactactaaattaccgacaagttgaaacgacgctgctactgatacggataatcaatatttatcatggatataaaataaaacgagagaacatgaactgagcataactttttttatagtcaaatctacacatttagattcaaattcttaaacagtacgggtgttcgaattttttgctaaattataattcatgtgaaaggtcacaagaataaaatgtctagtgataaaataaccagtttctttagacataggagtgatttatgccagacattttgactagctcttaacataaacataattagaaatggaactttactacaatgccaaagcaccacgggttttgacgctgaggcccaacaccttaacaccgtggaatatactacgaaaacaataataggcacaaatgggggggggctcctagttagcgcagacgcgccagataattttgtagcgcgcacttccgtaacttcctcctgtttcgacgatctgtatatttttctgttccgcatcgcttcaggggaggttaagcgtgtgggtccactacagccacgcgtcattagcactaataacaacgctaaccatatggattaatctagttatagtttttattatcaaaataatacataaatagttaagttgaaagtttcgaaaatatgatgaaaattttcaaaatctgagttgaaagttttaaaaaaaaatcttgaaagtttcaatttcgagttgacagttttgaaatttgagttggaagctttcaaactcgagttggaagttatcaaatttaggttgaaagttttcaaatttgggttgaaagttttcaaatttgacttgaaagttttcaaattttgagttgaaagtcttcaaattcgggtcgaaagtcttcaaaactcgagatgaaagttttcgaaattgatttaaaagtttaaattttgagttaaaagtttttaaattttaaattgaaagtttaaattttgagttgttttaaattatggttgtgacttttaatttttcatctataaaaagttttaaatttcacgtatatattttaaatctttagttaaaaaatacaacctcatgaaaaaaaaggaaagattaattaaaaaacataattatcggaaactaattccgtcaactaatataatcttgattattttctccgaatctagcgcacttgagcacgcttcccggtgttccctcgcgcaaaaaacagaaatagaagtaggccgaagagaaatcacgtacgaggacatgggcctaaaacgcacgctagatggctagttagcgcgtctgcgctaattaggaaattcgcaaatgcaggttatagcatgcgtactgcagtgataaatggtgtctgtattatcttggagatcaatgtttgaatctttatcgctgcaatattgtttcctttttctttcgaagtgctgaagaaaaaaaaaaacaagacggaacagattcctaa

SEQ ID NO: 68865 - DNA, 1086 bp, Oryza sativa
  unsure (1)..(1086): unsure at all n locations
caaaatgcatatgtaacgccgtatcgcctaattaggaaatctcgcaaatccaggttaaagcaatgcgtactgcagtgataaatggtgtctgtattatcttggagatcaatgtttgaatctttatcgctgcaatattgtttcctttttctttcgaagtgctgaagaaaaaagaaaacaagacggaacagattcctaagtggcaaaaaaacaacgataacgcagattctgaagtggcgaaaaaaaacaagatagtggaagtgggtttggacctagcaccttcacaccttatttagaaacaatgatagtgggcctcaacaccatgacccatgacgctgagatagaaatctatttttggtttataattttttagtttgtgtattactcgatgccaaaatatatgatgctaaggattcgtttggagagtttaaagattttaagaagctgctggttgatacccaacttctgataatatgcaaaaaattgagttcaacttctgacttctagcttatatgaatgaaaaacttaattattttgggagttttcgattcagggaaaaaatagagttttccaaagctttttcaaacaggctctaagcttctaatttcaacatcaagggtaggggtggatactgacatgactcggctcggtctactcgttaggataacgagccgaatcctaactcggctcgactggcaactctagctagcttgtttagctcgcgagccaatacatccgtgactcaatagaaatctctcacttcgagattctggctgccaacaattttttttgcaattgcttaagaaatcaaacaaccgacaaatcacaaagacttggcacaaatttttttttacacattgcatccataaaaacagatctgaaagtctcgtcatattggaaccaaacaaaacaccaagcaaacaccctagtgaatcctagaccaaccaaaattaacatgggagattgacttgccggagtgccgaactgccgacggcgacgaggacggcaagattgaacttttgctccttgatttatactcgtagcgctgtcgatggagatgcatgctcttgcatnctgcagcaggggacc

SEQ ID NO: 68866 - DNA, 1713 bp, Oryza sativa
  unsure (1)..(1713): unsure at all n locations
tgccactgtaaatgtggcaaattagaaaaataccactactatttgttttattggctaggtgccactacaaatttttaaaattgaaaccatgccactccgtcactatttctgtcgttctctctcacgtcgtcatcctctaatctcacgtaggcacggcgagggcaagaagacgaggcggccgccggcgaggacgtcgcgagcgcggggagcggctgcggccacggccggcgaggatggagacggacgccgagtggttgaacagcagcttgccgacgtcgcggacggcagagccaacaggtcgaggaggcggagtggcggagttgccggccggcgtcatggccgccatgccgccgtgctaaccgtgcagaggctgcatccacgccaccatgccgccatgacacgcaccgcgtgcttgacgcatacgaacatggacctggcattgacagccatgacgcggtcgtactcgtcgatgtcgagcacgccgagcgagtccggagcctgtgctcctatgatccggcgttgctgtaaaggacgtcgaggcggccgtggcgcgtaatggcgaggtcaacggtcgcggcaacatccgccttgacagtgacatcgctgtgcgtgtacaacgcgcgtcagcgccgagcttggcagcgacggcacggcgttcgcccgctgctgctctcgctccccatgccatcgccaccgccggagtgccgccgcggggttccgttgctgctgctcctgctcccgctcccggagcgcgccggagtgccgcccgcgacccgccgcgtcgccccgaatcgtcaactgccgcgccgtcgttgggggcgggctgcgccgcgacggccttgtgctgctgctgttgtgtgtaccgtcgctaccgtaagtggtggtcgccggggaaccgagncggcgagccaccagactagctcgtcgncggggctctccctgaccaagccactatgcacgcagtccatggagaacgagagctgctcgtggaggacatggagatgcacggcgaggataagctcctcttcctcaacggcgtccgacgagaaaggtggtaatgcatagcggccaaccgcgcgaggaacgaggcccgcagctgcggcaaccggcattgtgaaaatcaacgatgggaacggcgccgaaggtgaagaagatgaagtccgatctccccgttccccgtgtctccggctgaggttcttgaggcttcttgaagaggacgtcgaggcgacgacggtggcgccatggcttgctccggcgtgctccggtttgacggcgacaaagacgatgtcccggtgatggcgtctagtcccggcagcccccacggcggcacggaccatagagttaggaaattaacgggggaacgacggaaaaggcgacgggatggcatggattcaatttcccaaaattccagcggcacctagccaatatcgtaaatagtagtggtatttttctaatttgatacatttccaatagcatggatccaattaaccctagtttttatcataggtcatttatataacaagttttgtggaagattcaaaatatcatttttttggcaatttatgtcccaaatatactaccaagcataaaaaaaataaaataccaattctatttctgccgtgaattattatggaagtaaagagaaaccgttcaaatgataaggaaggcaaaccttgcagagaagggaattatcaatcggaacacatcgctgcg

SEQ ID NO: 68867 - DNA, 681 bp, Oryza sativa
aggaaattaacgggggaacgactgaaaaggcgacgggatggcatggattcaatttcccaaaattccagcggcacctagccaatatcgtaaatagtagtggtatttttctaatttgatacatttacaatagcatggatccaattaaccctagtttttatcataggtcatttatataacaagttttgtggaagattcaaaatatcatttttttggcaatttatgtcccaaatatactaccaagcataaaaaaaataaaataccaattctatttctgccgtgaattattatggaagtaaagagaaaccgttcaaatgataaggaaggcaaaccttgcagagaagggaattatcaatcggaacacatcgctgcgcgtgttcatcatactacctacgaaagtacgaagccgtcaggaaggaagagcccttaaaaaacgtttaccacttaacccccttgaaactccttgtaatcaccatcccaccccaccccccctccgtccccccacggggctcttcttcccccggttattcgttcgcctctcccaaaaccctagccctccgcgagcgcgcgatccccgataccctaaccccgccttcccctccacatcggcgccgtcccatggcctcccggggagcctacgacggcggctccggcgccggaggcaagatccggaggcgccccccc

SEQ ID NO: 68868 - DNA, 2157 bp, Oryza sativa
tgttgctagcatttcagtaactggtaggcataggtaccgccgatatatcttttaattgcataataccccaaatacagcatacacctaaggaactgaacttgatctgcaatgatggggtacatccatgaagttcataacacagcatcacactattaccatgaaatgatttgtactaataataatttctatgtgaccaagaaaatataaaccatgaggctatagaaaacatgggtttccctaactggtttttctttttttaggagaaaaagaagtgtacttcagttctaaagctgggaactaagaaatggacagttgtatggcatttactttggtattagttagttgtagaaaataccattgacatttctggaaggttctgttaccttagataatttttcttacccgtgtcttctttttctcatacgtttgtttatgctaccacattctctcctgtaccttctcccttctttttttctcacttaccgagaccaattttctgtggtgaagttatacttcattgttaatgtcatgaaccgaggccatgatggcataaccaccactgggagggtagccgggcggcgccggctattggagaagggatgtatatttagactagggataagaagatattaaggaaagaaattatactaatctgattcattgcttaatgataatagacacaatcccatccttatatagattatataacttgatccttaagtaaggactcaatctaatctttgactgataatcttatctctatatgggctgcttatggccctcagccttttggctcaatgctcatcacaattaacttactttattgtagttccatttaggctggtatacattggagaacactaagaaaattgatacatcctgcatagaaaaagaagttcgcattttctttgtagcagttaatgcatcagcctgcagttgtatatgatttgcgtacatgatttgtatggagtagcaatgcagttgggggaacacatcttcttgatagttcaatcctcatttatcctttaatacttccatgcttctgtatgagttgaagtgcaatgccatgttttctttgctagatcctattgttgtgaatacctgttttgcctattgcattgtaacttgcaaatttgttttgctaatgtccaagtgtacagtagaaatgcgaaaacatatttctatcttacaaataattttctgtcttgcaggagtgaatttgaatatttgtctgagttgttgttatctagaacggttgggtccaaattattgattccaggagttggtaatatgaagaaaatgcattttcctgagaaggcaagtcgatctggagacttacctgttgatttctcctttagaacattcaacacttctgttaatacgcaagtcatgttgctcactaaatattcctgttcatatgatgaaattgatttcttttacaatcacccatactgtactgtacagaacataatttaaagtgttgaagcaacaatataatttcttatttttaagatactagaaaaaatgcccgtgcgttgcaatgggtaaatgctattttaattttattgttgttatatggtttagctagggtaaaattcactgtgggaattcgcttggatatttttttttgaaaatcataagctgcaagagtccgtatatcatctcaagttagcatgcgagtttttttaatgatatttcttatacgactccttctgtatttccaaaagcaaatgagcttaaaatccaactcaaacacggatctgtatttctaaaagtgaacgaacttaaaaaccgactcaaacccggatgacataccaaaataccggcaaaaacatcttcaatttttataatagtagagatatggcatattgttgagttaaaacccttgaccagcagaatagtttgttatttttttttcgaagttgaggaaagcatatcataggtcccccttattccctaaatttttgcaggtcacttgggtctctggatttgagtgggtacataaaattgtataagtgggtcaacaaagtcatcctacttttttttttggtatacttcgataggaggcctgtggttgctttttggcatggtttaacctgtacttatgccattcacattttaaggccctattttccattttccactttagaaaccaaa

SEQ ID NO: 68869 - DNA, 1505 bp, Oryza sativa
  unsure (1)..(1505): unsure at all n locations
tggggcggngnnaatggaacatcaatactccaactatacacgtgacactattcaaacttgcgcttgcatgcctgcacgttaactgtacaggatccccaccttggataatgcatcggtcaatctcactggataatactagatttgaaggagcatgacttctcaaaggcaatgttggaggtttctccttgtttattattccagaactcatatcattattctctgggattggtgattgctttctctcagttttatcatttccttggttgagtgacaactttgtacttcccctacagttatccatctccaaccaatcctacaataaagaaaatgtcagtatgttgataaaatattatgtaccctaggaggaaaaaggtgccatccaaacattaccttgggcatcaatttagctgatttgtcagatgtagcatcaacagtattgctgtcttttgcggcggaggtaaatttagcagcgcagttggagttattaggtaaagactccttaactcgtgacgaagatggtttcaaaagactgccctgtgctgatacttcagttttctgagaaataggatcctcaacatctaagatgtccacatgcttttgccttgttgctaatgtgccttccttctgtgaaggaattatcgtatcaagctgcttcaatatctttgcagccatttgaattgactgtgctggtgcctgaccaaaactgctatcatttgctctgtcatgtacaccacttcgagtaatatcaccaactttatccagacacctacgtttttgactttgtactgagtgttccaaaccttcatcaagtttgctagcatgactaccactatatccacggtggcctgaccgagtttgcaacagtggtgacactctgttgtacctctgatgcattttgcgtatgggaccaacagaggcactctcgttattgagagcagcactcttcctcttcagaacctgttgattcattattaacagtaaatgttacatacaaggtagcatcaaatctaagcaggtaggacagcagcaaagaacattaagtggactgtagcccacaagtaaattatgtaaccatgaaaatttgcacaggtatccaattcaaaataattattaggcatttaaacaatgttatgcactattggtcatttaacataaaatatatattgtccaaatactgtgtcactaactgctagcaatatataaactgtaaatcacatcctggaaattagtgtttgctatatttatgcattcggtaactacaatagtagggtaaaaccttaaggtagtgcaaacagtgtaaatgcagggcctgaagaagtttaaggtaaacagtgcaaacagtggtggatgcagggcctgaagacacttgtagggacaccaggcctcaccatcacacagcaaaatggagggcatgtcataccactagcgcttgatgacgccagatgctagctgaagttgtttttgcccaagtctagaaaacttctaggtacaccactaattgccaa

SEQ ID NO: 68870 - DNA, 2378 bp, Oryza sativa
  unsure (1)..(2378): unsure at all n locations
ttttcgactttagaaaccactttntagtagtccctggtacacatacttcttttttctattcctacatgagtttcacttgcgattctatctacatttgccacaaaatagcaaagctcgtaccatgaactattttatctcctgacacatttgttgtttataccattgatatgccatatgttccgtgactacaagggtaacataatctcatgctattcattcctgcaggatcaagttgcttcacctgcagaacttgcaaaggcatacatgggttcaagatcttctaagggatcaccattacgtcttagattgcatgacccctctgtactttccaaatcgatagaagctaatacaacacaaataacgaggcctcccaccctctctctgctcgcgagtgcaagaaatcatgctccaaccacctctgatcgtcttgggagcaactacacgacaccaaatagatcagcaatatacaaaatgtcatcatctccttattttaaggttctgttatttcctacttcatttaatgtctaattactttatgcccgcagtatttctgttatgtatttgcacaaagagcacaatagtacatcagatcttgcatatttgttaaatagaaaaattgaataggtagccacagactacttgagaaactcaaagagacaactaaaaatgtattacaccttaatcaatctgtttagtgcagcatggcaatcatcaagttaccttgattcaagtattatgttaccacgctgttgcagttgctctctctgaatttcattagtagaaaataaaccttccatacattattttcttatttggcctcttaaaatcacaatttaacatggaaaggtccaaggtgaccaagttgtcgtatgtatatctagtatatgagttaaatttaattagtgtgtgtgaacaatgccaaatgtgtcttttagcgaacaaatatcagtttatttgttttaagcaatattagaaattttataattgttctttttctatcgaaaacatgtgcaattagctagtgctctacatactgccttattttattctcattcttgagcacaataccctatctctgttactatgtggttacatctctaactcaagttcctcaatctgttcagagtgctgtttcttccagggatttgtttggtactgtatctccatatcaggctccaagcagccttcatacatttggaaggcaggtattaatcacgaaacataatcttattttgctgtaaatttgttttgggtttattaccggcttctggatttatgttgaactgctactgcatgacttttatcttggcttctttgtttgattagtgaatgatttatgacatgaaatgtttggaccttcaatattgatcactgattgactcaccacataattttgttgctttaaagtacacgatacaatgttaattgcagatttttttgatcggatgctgcctattttatgcgtaaaacacaagctattattttgaaatctaaagataaactagacgactctggaatatgttttcttgaaccctctttaatcatggtaaattggtaatagtagttggcaattagtggtgtacctagaagttttctagacttgggcaaaaacaacttcagctagcatctggcgtcatcaagcgctagtggtatgacatgccctccattttgctgtgtgatggtgaggcctggtgtccctacaagtgtcttcaggccctgcatccaccactgtttgcactgtttaccttaaacttcttcaggccctgcatttacactgtttgcactaccttaaggttttaccctactattgtagttaccgaatgcataaatatagcaaacactaatttccaggatgtgatttacagtttatatattgctagcagttagtgacacagtatttggacaatatatattttatgttaaatgaccaatagtgcataacattgtttaaatgcctaataattattttgaattggatacctgtgcaaattttcatgggtacataatttacttgtgggctacagtccacttaatgttctttgctgctgtcctacctgcttagatttgatgctaccttgtatgtaacatttactgttaataatgaatcaacaggttctgaagaggaagagtgctgctctcaataacgagagtgcctctggtggtcccatacgcaaaatgcatcagaggtacaacagagggtcaccactggtgcaaaacttcgtcaaggccaccaggggatatagtgggtagccatgctaagaaaacttgatgaagggttgggaacactcaggacaaaggtaaaaaacttaggtgtctggattaagctggaggatttacctccaaggggtggacatgtcagagcaaaatgatacaatttt

SEQ ID NO: 68871 - DNA, 1851 bp, Oryza sativa
acattggtcatcgccgaggctttctgttgtgtcgccgctgttgccacctgctccccgcccgccatgtacagggttcgctaccacggccaactacttcggccaccttgctggctgggtggctgccgccgccaccgctgctgccgtcttccggccactgccacctaggcaggtcgctgtcgtcgcctggaccgtatggttcgggaataggggaaacagcgtcagggccgattgaggagacagatttctgctctcattttcttcttttacgtatatcaggggtagaaaggtaaatcaataaattccaaaatgattattcctctttattcttattattttgttatcttaacaattccagtttccgggccgggtccactaacttccataaaaaaagagtaaacacctccttcatttgaaaaaaatgggcaaaaaacccaaaactcgaaaaaaaacacgagcaaaaccataattgaacattaaagtaggagcaaaacaaaattgttcctaataaatataagtcgttttacgtaagcttgcatataaatattcaaaaatggataaacagtccatgtctccatttagggctgatatagctagtgtaatatttttttttggaggaaaggaaagaattggttttacagatgtcaaaggaatttcataggatatatagagaaattcctctacattttggagaatttctagcataagatcttcaaatacttaggagatttgcaatctaacttatgtatctttccctcctttctatctataagaaatcaccccatttgccgcgcaagggcgcagcaagccccacgccctagccgccgtgactggccgtcgctcgtcgcgcctggccaccgctctccacaggaagacgagcctgccctgccgtgtagcgtctgggagcggttgccacaggaagtcacgttgccctgactctccacgcctaggagggctgccgtaggaagccccgtggccgccgccctgccggagacttgccggagtgtcgtcccacgctcgccgccgccgccgtgtaggtctagggttttgttgttcactgcacactcggtgggcaggagaggactcaatccctatctattcactgcacacttttttgattttttcatttgcctttctgtaacacaaaaatgtggggtctatcgaacagccgttaaaagtaagggcaaacgacttgtttgttttggaaaagtgggggcaaaattgcaaaccctaaaaaacgggctgtcggccgacccaccagttgccgtggtccacaaaaaactgaaatttgagggaaaaaagggaaaaatttaggaaatatagaaaatatgttggaaagataggataaatatgaggaatatatgaaggaaatcgggaaaattgagaaaattacatggaaaaagtatatgggctggcaaggccaaacccgtgccgacctacaagataaggtgttggcccaagaaggagatgcaaacagactgggcaggcacggcccactggttgcggatcgatatgtgcatactacttaacggagtatatatttgtacttacggttaaaacagcttgcagatagaaattacgtgcatatgtttgtaaagtgatatcgcatagatcataatctattctgttaaattttattacattcgatctttcataactgattgaccgagttacgtacaagaaacgacggaacatttttcgacagaagacacatgcaactttcacatatatatatgaagttgtacatagtaggggcatacatccaccatatgcaagcacaagcgcgcatgcagctagcattcgcttatttatctacatggagccatagcaacaagcttctaattcagggggaga

SEQ ID NO: 68872 - DNA, 1911 bp, Oryza sativa
ctctccctctaacccctctccttttgttcgttaggaggttccgaagctcgtctcacggtcgccatcgccctccgtcgctcgccgtcgtcgatcgtcgtcggtagggcttctcctcccctttctccctctctcccgcgccggttagccaccgcgccaccgcttagctgcttagccgccgctatcgccgccggtcgccacctcgcgtcgccgctgcgtgcgcgccgcgctgccgcgcgccatggccgccgggccggcttgagccgtgcccgcgcgcgccggccgcgagccgcatccgccgtccgatctaccgggcagtagatcgaggccgtcggttcggctgccgcatggctgccgcgtggccgccgcgtgtgcgccgcgtcggcgccacgtgtgcaccactctctctcttgtggggcccgcatgttggcgccgctctctctctccccaggattttaattattgcgcaataaatcaattaaggatttttctgtttatagtaaaaacacagtgaatattccaaaattcatatctaattcatccgagctccgtttaagcccattcaagtctcagtaaatcaataaaaatgcatagattccattaaaaatggttttgttctctgtttcagtagtcttatagcctgtttgtattgtttgctttgtatgtcgcttagattccggctctcccaacgctccggtgtactttgaaatagtcgccgaggttcctccagcagcagagcaaggcaagtcatgcttgtcacttgaacatgttgatcctatattgcaaatgttttactgtttttgttcaaatattgcattgttttacaataatactatgggatgtttacctactgttatagccatgctatttttgtaccatgctcctttgttagcttgggatatgacatgactagatattggactagggattgcttagccatgcttagttcaactagcacacaatgggggaaatcatataatatatagacttcaggttctagtgttgatgttggattagtaccaccgtcctggtgttgctaattaaaatgaatcctatggtgggctgtgggtgcatggttttgctagtcgcgcccatggcacttaaggactggttcgtgggaaaccctggaagaattcctcgtacttaccacaagccagcgtgggcaatggctaggcttgtagtgtagctttcctctagctgacacatccaggcaagggtgggcgtgatggagcggggcgggccctgcgacggcctctgtcgcttttggattcacctaggcacgagaggggactgcccgttgcccgctggggacgggggtgaaacttgaggtgtggtgtgcttggctagagggggttatgcgaagggtcctgtcacggcctctttccggtatgtcgtggtggcatgtcggcacatggaaacatgtcgtggggctgtgtcttgtgggtacagttgtacacctttgattagagtaaaactattcgaatagccgtgcccgcggttatgggcggtcaaccagattcaccgtgattagattcaccctagactagtctaatggaattgaatagtataggtggatggttgggcctgttgcaacgtggtatagcattggacagtggatgattaatattgattaattattacaacggttttactactttcaactactatttataaatgctcgctttatgcaaaggaaccattatagctatcccttgataattccctgcatcatacccctattccggtatgacttgctgagtacagggggtagtactcagtcttgctatattttccccaaaccccagaagtttgagtatgcgtaagatgggggcttctccgaggaagaggcttctgtcctgcccgtcgagatacttgtggagtggtgttcccgctgcgtgcaagtcaagtttatct

SEQ ID NO: 68873 - DNA, 1812 bp, Oryza sativa
atccatatagatctcctcctccaactctccattgaggaaagttgtcttaacatccatctgatggatgactagaccatgagaggctgccagagtgagtagtactcgaatcatagtcaagcgagcaaccgatgaataagtgtcgaaaaagtcctcgccttctttttgggtataacccttggccacaagtcttgccttgtactttttaattgtaccatcaggcctaagttttttcttgaaaacccatttgcatcctacatgcttgcacccatatggacgctcgatgacttcccaagtaccattagacataattgagtccatctccctgcgtaccacttccttccaattgtcacttaatcagcgtcaagagaagaatatgcctcttcaatggttcttggagtatcatccacaagatatgcaatgtagtcatctccaaaagactttgcagtcctttctctcttattctttcgagtggctacaatgttatcctcctcaggattttcctcaagcgtttgatcaatgtgttctatcggcacaaagtgttcaggggataaaataggttcttggctagaagtgctaggtgcatttttcataggaaattcattctcaaaaaatgtggcatctatggactcagtaattgtaccaacacgcatgtcgggtactccagaattttctattaagaacctatatcacacactgtggatagcataaccaaggaacacacaatctacggttttttgttcaagtttacgctttttgactatatgtacatttaccttgggcaaacaaccccatgtgcgcaggtgagagagatttaatttcttcctttcccattcctcgtatggtgttacttcctgatgtttagtaggaattctattaagttacttcattatgtatgtaggctgggtgtgcttggtgctcttcttttaagtagcaagcttctttatgttgtctcagagcatctccaacaacctctccaagtgactctctaagctaaattttagctattctagccaaaagacgtctttcaacatcctctccaactggatggctaagccatccggctagccaaaactctcaccctccctccactagtcaaattaggaagctaaaaatcactagccaaccatgggcctcatacacattccacctccatctccttcggctcttctccaggacggcgcaggcggccacgacctcgacgccgccgccgtgcaccgctgcaaccaccagcttccggcaccgctcgatggctgtgagcgctacctgcatctccaggatggcgcagcggagcccaccagccgcaggcgcggggtcgccgccgcccggtgaggaggggccatggcggggttcccggggcagtgcgggccggcaggggagagcacgacggcatgcgcggctaggatgcggtcgaggagcgccatggcgcgtgggatctccgcgaaggcgtccgggctgagggcgttgagctgggcggagcggttgaggcggaccttgtaaaccaccgtggacgggtcgggcggcgtcacggcgagcgtcttgaacccacgccggagctccgcctcgagcaaggcgccgatgccgccgaggcgccctcctagtgtggcgagggagggaggaagcggcggcggggcggctcgacgagaaagaggattggagagaggggaaggaagaagaaagggggatgagaatgactggtggggtccattggttaatagagagtataatgcggagagtctgttggaatagaatgcaaatttgactctctaaacttttgttaggttggccaaataggtatttggagagctaaaaatg

SEQ ID NO: 68874 - DNA, 1614 bp, Oryza sativa
catatgagagtaaagttaccctgtttctcaaaaaaaaaaaaaaaaagaaagagcaaagtaccctttaaagtacggataatttttcggacgtcggatggagatccatcgtctcacagccctccccttcctctctaccctctaccgagtcgagcgtcgcgtccgccgccgccggcgccgccgccccccgcctcttctcccacccgcgcgccaccgctctccgccggcgagccgtaacactaacccgctcctccccccgcccacaccactccattttcttcctcatctccggtctgcaaaacggtagttaaacaacggggatatgttcgccgcgaaatcaaaccggggaagaatgtacatggcgacgaggagcgccgccgccaggctgctctcctcctcctccgccgccgccgccgcctctcccctttggtccagacgccggcgccgccatccattcctccatccgccctcccgctccaagaccacctcctcctcctccagcagcagcaagcctcctcgccgcccaccgcctcgcaaggacggcggcgggccgcgcccgtgcctcttccaagaactctccggtctcgtcgccccatccgccagcgatgaccccgcgtttcagcctcggcgagatgggcaggagcggtgtggcctcctcggccatgacactgcgcagtgcgcggaaggtgctcgacgaattacccctgagggagcggctgcggcttctggttctttcaccggtagcgttccgaacaatgacgctcttgggttccttcctgatggtgggattgggcctcgtagcactgcaacaggcggtgctccggacagtgagcaatctatccaggaggtgggcgatggaaatgctggagatgttgagaatatcagtgaggttgtgcatagggtaacagaagttttgcgggcagaggtgcctggattgtctgtggaacagaggctggagaacctgggagttacatatacaccgaggcttgtgagcttggtgctcaacaggtgcttcaagaagaggcatttggggttcaaattctttgactgggttaggcaagttcctggattccagcacaccacggagacgtacaacgcaatgctgtacattgcgggtgaggagaggaactttggggccatggagaagttgatggatgagatggataaggagatgtgtttgaaggacatcaagacatggacaatcgtcatatccagttatgggaaggcaaggcagattggcaagatgctatctacctttcaggctatggggaaatcgagacatgtggcagcagatagtaaagtttataggacgatacttcatgctttatgcaattctgcaaagtccgagcttgctcttgagttctacaaagatatggcaaggaacacggaggttggatctgacatttttcgacttctattgtgttgtctcgcaggatcagataatgctgaaggtgttttttatgtcagagatgatatgattaagagcatgaagtatccagaggagtattgttatctggaagctctacggagcttctgtgtttcaggaaaaatagaagaggctcagaaaatcttccagcagatgatgaacaagtccattgctagctcatctgcatttga

SEQ ID NO: 68875 - DNA, 1917 bp, Oryza sativa
aaagtactggagggctatagtgattcaaactggatatctgatgctgatgagataaaggccacaagtgggtatgtgttcacacttggagggggcgctgtttcctggaagacttgcaagcagaccatcttaatgagacaatggaatcagaactcacaactttagatattgccacagttgaggccgaatggcttcgtgagctcctgatggacttgccggtggttaaaaatttcagtaccagtaatcctgatgaactgtgataattaaacagtgattattaaagtgaacagttcgaaggacaatatgaagtcatccaggcatgttaaaagaagactgaagtatgttagaaagaggaaaaactccggagtgatagcatttgactataccctgacggctaaaaatctggcagatcagtttatcaaggggctaccacataatgtgatagactgtgcatcgagggagataggcttgagacccacttagagatgcacaatggtggtaacctgtccattatgatcggagatcccgtgaatttggatggcaaaacaaactattgggtaactgagagaagagaccctcaaaatgagtttatcttcatgatgtacttctcttctattctgtatggtacgatggtatacaccttaatgtgatccgagtggcttttcataaagcagagatgtcatcctacagaatatcttagaaggaacacacctatatgagtccaattgctagttatagtctatgagatctgggtaatctctagatactcatgaaaagtccaggagtatgacttatatgatccaaacagaggggatgcaaacggcagcccagtaccagttaagggtttgagtgaaacctgaatcgcacaagactgacaattcaatgcatagtccattgttcagttgtgatatggtgtagctcttttcctaggtggaagttcaacttaacagtctccatcaaaacactggtataactaacaggttcagttttgagaacatttgttgtgagccatgaaatttggtggggattgttggaataaataggctaggcccaatttaattcaactaaaatctcaagagcccacaagtaatgttagagacaataatactgccttgaaaatttaggtagaagaacctcaacttaaatagggtgatattggagattccctattgaccggttgaggtgatggttggactgctacacacgcgcgcgtgcgccgagttggcctcggcaatgggcgtggcgaggcggggcggccgactgagccgagcctgcctgctgctcttccgttttgtaatagacgagaataaagtcaccattaacaaatgaaattcattgtgttgtaacctccacaacgaatgagacattcattgtgttgtaacatccacaacaaatgagagatttatttgttgtaatctccacaacaaataatagattcaatgtgtggtaaccttcacaacaaatgagagatttatttgtgtggtaatggagatctctctatatataacgcaaggcagaggctctcaaagatcgaatcttcctcctgctgctgttcctacgtgatactctccttcagttcctgcgctatctctctgtttccccggttctgttcatcccgcgcacacgggtgatcggaacgagtaggtgcctccgaaactccgtccgcttgagaacctgcatgggtagacaggcgaagtttttggggagcgctacacgcgactgcttttgttcgtcttcctctgcatcgtctgcgccaacatgtcgaacaccggcgacaacagtaacattggagacaaggagaaggaggctcccgtcaacaccaacggaggcaatactgcttcaaactccaacggaggaccgttctcggggatataacgatttactattaccattcgttcttcatttcctactactatcagt

SEQ ID NO: 68876 - DNA, 1885 bp, Oryza sativa
tataagggataaaaatccaagctttccatttttagacacgttcaaagaatgagaaagatcattaagtaaatcaggagctttaagttatccctatgatgatttctatactagtgtaacatgttaggaaacgataggcaaacaaacgataaagaacaatagatcaatcacagaagacacgagattttaacgtggaaaaccctcccaaagcaggagagaaaaaaaccacgggcgctagccagcaaaatatcttcactatatctagggtgaggttacatcgctgcacggcggcttacaagaggtatatatatggtggaaccctaaaagggatgacgatccgtaccgtgggggctctgcccccgcacccccgggcgtccccaggtgcacgggcctccgctccactacggcgaagcaggtctttatcaaatgtaaataaatttggattacaactcaacataacattcttacatgtagcatgaaaaatacacaagcatgcatatctttttaagataaaggatagaaatccgaacagctagcctctgtatctgcaagtaaacagaagcatccacatatatatgtgtcaagtccagaagctagagcttgacgtacaacaggcacgttgagacgacgtacatcacaggggttgatagataattaagtgcagttcttgcggcaggagtcgccgcagctcgtcaagcattcctgcctcagcgcctgaaggcagctctggcaagcctccggcgagcagccgtcgcactgcggggcgcacgccctggggatagtgtctgcgtagatgcacgaagcagtgcagatgtcatcgcagctgccgcagaacatctttgccgcggccggcgcgacggaggaggacagtactagcacggcgaagacggcggcgacggcgatggccgccgtaggagagtttgccccggaaggcatgctagttgtcagcgtactactaattgtgtgggtcaagcaaagctagaggaagaagctgagatagatggagagcgaggaggagactgagattgatgctcggattaatggaccaaaccgatgcggtgcactggggaagatgcactgtgttgactatatttataggcagaaaacgcgacgctactatctgctcccttcgtctctaaatgttttaaccaacacaaatgaagctggaggataaaagtccttcgttaatatggagaaaaaaaacgacttgttattaaagagctctatagaacccactataaaatacaatcaatgtgagataatttgagaacttttatgttataatatattggtggtatatactgatagtataagtgatataagcgtttagattattttgtcctctcttattgtagtaggaaatttgaagtggtaaaattgtcttcctatactattagacggtagcaatgatagatgttttcctcgcttgatctcattcctcgtcatccttcacaattgcgacaccgccatcaaccaccacaatatataggatgactcggcattagttagaaattaaagcatgaaactactaaaattttatttttcatttcatggcaaatttctaaattgtctttgttatcaatatatacttaacgtaaaagttataggctaaaatcaggtttggaaattttggtttagccgatttgatcagacctcgccgaaatgctgaaatttccgtaattttgaataaagtttagttgaatttgaacaaatattaccaaaattcatgaaaaaaaataaaaaaataaaaaaattctgccgaaataatatcgtatcggaggggtccgaaatgaccgatttcgttctataatttccaaccctggctgaaattactttgagggatggaaggagtagctagctatccctaatcagtaaattacatgaccat

SEQ ID NO: 68877 - DNA, 831 bp, Oryza sativa
aacgggggtcatcgtggcggatgggcgacaagcccgaaagttcttggaaaaggcacgggcgcggcccgccgctgtccttgcaagccggtgggcggcgagaaggcttcttcttgctggaggaggagaaggtggtcttgaagcggaagggcggatgaaggaatggatgccggcgccggcgtctggaccaaagggaaaaaccggcggcggcggcggaagaagagaagacacagcctgccggcggcgctcctggtcgccatgtacattcttccccgggtttgatttcgcggcgaacatatccccgttgtttaactaccgttttgcagaccggagatgaggaagaaaatggagtggtgtgggcggggggaggagcgggttagtgttacggctcgccggcggagaacggtggcgcgcgggtgggagaaaaggcggggggcggcggcgccggcggcggcggacgcgacgctcgactcggtagagggtagagaggaaggggagggctgtgagacgatggatctccatccgacgtccgaaaaattatccgtactttaaagggtactttgctctttctttttttttttttttttgagaaacagggtaactttactctcatatggataggatatatgccactattactttacattctgatggctaggttagtccaagattatctaaattcgatgtttctgtttggttactgtagaacgttggacctttcgaatgcgttgaacaaccacatcacgaggtgatcgccggccttaggctgaggatgaagggcaattggagatagaggttgagatagataccttacatgtggatccagatgtattt

SEQ ID NO: 68878 - DNA, 954 bp, Oryza sativa
atttaaatttgggttaaagtttttaatttttaaattaagttttaaattttaggttgttataataatggttgtgcttttaatttttcatctataaaaagttttaattttcacgtatatattttaaatctttggttaaaaaatccaacctcatgaaaaaagaaggaaggattttttaaaaaacataattatcggaaacttattccgtcaaataatataatctggattattttctccgaatctagcgcacttgagcacgcttcccggtgttccctcgcgcaaaaaacagaaatagaagtaggccgaagagaaatcacgtacgagaacatgggcctaaaacgcacgctagatggctagttagcgcgtctgcgctaattaggaaattcgcaaatgcaggttatagcatgcgtactgcagtgataaatggtgtctgtattatcttggagatcaatgtttgaatctttatcgctgcaatattgtttcctttttctttcgaagtgctgaagaaaaaagaaaacaagacggaacagattcctaagtggcaaaaaaacaacgataacgcagattctgaagtggcgaaaaaaaacaagatagtggaagtgggtttggacctagcaccttcacaccttatttagaaacaatgatagtgggcctcaacaccatgacccatgacgctgagatagaaatctatttttggtttataattttttagtttgtgtattactcgatgccaaaatatatgatgctaaggattcgtttggagagtttaaagattttaagaagctgctggttgatacccaacttctgataatatgcaaaaaattgagttcaacttctgacttctagcttatatgaatgaaaaacttaattattttgggagttttcgattcagggaaaaaatagagttttccaaagctttttcaaacaggctctaagcttctaatttcaacatcaagg

SEQ ID NO: 68879 - DNA, 1022 bp, Oryza sativa
cactcgattttcttgtacactcctgctcctttgtaaccaccgtagcccgtctctttcacgccgcatggatacaccagtgcaccttctcaaccacacatcttcctttgtccccatcgctgacgttgtgtctcctctaccatgttccatgatccactctcaacaccatggtgctccctacaagaggggccatttcactttattgacttcaccacgcggctcactaggctctgcatgggaccagatccttggcgagaatacgcactaatctccaccaccaacaacgaggacctggagcgagtgcctcctcctcaaaggtgagagcctccacctacttcgccatgtgctaggatgccaccgttgccatcagctagcctccacaagcttaagtaggagcctccaccatcccctttccttcgtagtccaccatcttcacaatggtatcattccagtttcttcatatatcactagaacggataccctcatctcaatcggacggtaagccccatctcaatcggacacagcatccgtcacaggctagaagtcactgatgtgaagagttatctcaatcgggcaaacggccgtcacgaatgaatatatctcaattgggccctaagtaaagcccgtcaccgatagctttaacccagacgaccagtcaaactatagcccgtcacagatgacctatctctatcgggccacaactagcgcccatcacagatgactactaacctttatcgggcctaaactagagcccgtcacagatgatactcatctcaatcgggcgtaaactatagcccatcacagatgactgatgacctcaatcgggcctaaaatagagcccgtcacagatgactactgacctcaatcgggcctaaactagagcccgtcacagatgactactgtcctcaatcaggccgaaactagagcccgtcacagatgaactcatgtcacatcctgaagttcttctcccaagcctaaattgaatttagaaatggtctcaagaaaataccggtgtaaaacgggga

SEQ ID NO: 68880 - DNA, 2246 bp, Oryza sativa
  unsure (1)..(2246): unsure at all n locations
accattttctgtaatttcgtaaagtacatccatcgttttgnaaacatcctttttccccaagtaatagatcatgatgaggtatacatatgtggttttgagctatacataaattcttattttctcaaagcttagctaaagcatcttaaaagcgatccctcctcaacaacgcgtgaatgagactcccatacatgtatgcacttcttgaacatccataattcttaatattatcgaacaaactgagagcttcggccattctatcagacctgcacaatgatctaatgagtatggagtagccagcctgaatagaaaatccatgtttacataatagtactactgagctttcagcacgatctatcatcccacactcacataacacagaaagatatgtgcaaaccattccattgtcaggtatatagcctgcacgacacatttcatggaaaatcttgactgcagcatctactttcctcccttttctgcggctgaggtacattattaggtgactgtaagtagttttgtcaggctgaaagccaccctgcttcatctggtagaatgtttcaagggccatttcagttagaccagcatttccatactgacaaatcatgacattccatgtatccactgttgggcaacactctgcccatatcatctctctgtaaagatgcctcatgtgcttaaaatcttttgcagagccagcgagttttatggctgtgttatatgtctttgttgtctgcatgtagtaagatcgtttgcctacccaagaaaaaaattgtaaagcagcacgactgtttgccttacaacgcttcataatggcatcaacaagatctggagtaaaagatattgatgtcatctctaaagcctgttctattgagctccagcaatcagaagatgacagaatccgacatatttgttcaacgtcttcattgttgtaatcctttgcttgttctaaatcctgtgtgtcatcacaaggaaagctccctgagacctcacagtctttatacgaaggatgaccaacaaactccactgtcctttccttctcttccggaccagatccagatgatttttcaaatttaccagtgtagtcactttgatccaatgttctgcgttgcagctcttctatagggctacaacaattaaaagatgctcgcatcctctcaatattgctagcttcttccaaatagtgattgtcatacagagtggaaataatcctgctgaaagtttgctcggaaggcctgaaatctgattccagcatttccttcagaagttttagtgcttcaaggggcctggaggccttacagagctcttggatgaacactgtataagctttcaatgtgggtttctgaccattctcattgatattcctaaatgcatcccatgcttcagatatatgtccattacgaacatgcccacctatcagtgctgtgattgccacaacatctggttcaataccattttcctgcatttcctcatacaatctacatgctgcttcatgttgatcaaatgcaaagaggtgttgcatgagctgagtataagatgatgccaatggaacacatccatattccctcatttcctgaagcacctcaagtgccttcatacgctctcctttcctcaggtagccatcaatgagagaaccaaaggtggcactgctcgcagatgagttgcttttcatgtactccataacttgaagagctttatccatccttccatctttgcaaaggcccctcaataggatttcaaatgcagatgagctagcaatggacttgttcatcatctgctggaagattttctgagcctcttctatttttcctgaaacacagaagctccgtagagcttccagataacaatactcctctggatacttcatgctcttaatcatatcatctctgacataaaaaacaccttcagcattatctgatcctgcgagacaacacaatagaagtcgaaaaatgtcagatccaacctccgtgttccttgccatatctttgtagaactcaagagcaagctcggactttgcagaattgcataaagcatgaagtatcgtcctataaactttactatctgctgccacatgtctcgatttccccatagcctgaaaggtagatagcatcttaaaaatctgccttgccttcccataactggatatgacgattgtccatgtcttgatgtccttaaacacaatctctttatcaatctaatcatcaacttctccatggcccccaaagttcttcttctaaaccgcaaaggaaaag

SEQ ID NO: 68881 - DNA, 2198 bp, Oryza sativa
cgacgccaccttcacgtggtgagaggttatttattagtaatcaacgtatataagcagcaacttgtcgaatggacaaatctaaaatctataaactacgagcttacctttattgataagtttttgaagggaatatgcagctcagatggtgtccgctgagtgatgtcatcaacggggcaggtggttttgtcctgggtttgcatggcgtccatgctctgtgatcctccctgccccgttgaggcgcagttgctacgatttcctgaagggctcacaattgcaggaggaatggttggctggggatcattggaccaatgtgcggccatgcgttcatcaaccttccttgccacctcctcttgcatgctgagctcgtagctcgataccctgaactcaagatctgcaatcttcgcctcggtatctctcttgctcctcatccgactcctgtacgtgtggatgtcctccttgaacccaatcttccaaggaatcacccctttccctcgtgttcatcctggatgctctggagtctgcagggcgagtgacagctcgtccttctctctgtcgggtcggaacgtaccctgagaagaggcttccactgcgtccgttagtcgacgcgtagcctcgcgtatctgatcgctgaagaccagggagccatcaactgggttgagcgttccaaagtgagcatagtaccagaacttcgatcgttccggttaattagcggtggccggttcgatacccctctcaagtaagctagcctccatctcctcccacttcggcatcgcgacgctatagcctcctgaccccaagtgtgatggtacttcttcttggcggcattttctttgtttctttccatcatcgcctgcccttgttcacatgtcttatgtgcaacgaactcgtcccagtgatcccttagctttgggaatgtgtcgaagttcggtgtctgccccttcaggatatatttctggtacagatctcccttgaagctctgaaactgttctgccattttatttagagtccaccttttcactttgtcctctgtacctgtgggaagggtgaatgtctcgagcattgtggtccacaacatctctttctccgaatatgggacaaagctctcatgatctccgtgtgcccttgttctgcgccagtacaccgtactgacaggcacgttatcccacacaacccaaccgctgtgacgtatgtagttcttggtggcttccgcctaggcactaggtcggccgtcttcgtccacttccgttatgatgtgccaaccctcaagcttcttcgcggcacctcgttgcccgcgtgccctcttctgtccagcggagggttgacttccactagcctcctcctcctggttcccctccacatccctctatacgtgcccctcctggttcccctccgcatccctctccacattcccttcctggttcaagtactggtttggatcctcgttcccctcttcttcgttcaagtactggctgcttccctccgcaattgtatcttacaatatatgttcctcatcgcgatcagctatctgttcatacaagaaatagttcctaagtcatgagacatttttgctttaacaatcttatatgctaacaatcatatatgctaagtctaaacacaaatctaataatcttatattaaaactataataatcgtatacgaaaactcaaataatattgtattaaaactgtaatagtcaactatgctaagtctaagtgacgtatattaggaccctagctagtcaataattatatactaagtctaattacaaatctaataatcttatattaaaactcaaaaaatattatattaaaactctaattataatgctaagtctaagtgtcgtatattaaatctaatagtcttaattgcgttaaaaatctaacaatcatatatttacatcacttgcctgcgcgaattccttcgagggctagcaaccactccggcttgagggacgacgacgacaacgtcttttctgcaacatacaaaaagatgtattaggagaaacgcgaagtaacatatattgtatttctcgttcgcgttctcattaagttcacgtttcgttcacgatcgttcacgttcgcgttctcgttaagttcacgtttcattcacctacgttcgttcgttcacgtgcgtccacgttaacgtacgttaagtaaagttcgttcacgcacgttcgttcgtttacgtatgttcaaata

SEQ ID NO: 68882 - DNA, 2157 bp, Oryza sativa
atacacggttccatttagccgaggctaaatatattttcccgatctttccaaattcttttaaacccggttagggttaataaccgggactactgataagcgcactgaatattaatttccattacatatgtgttcctaaaatagaaaataatgcattaaaattttttaaagtcgaaaaattaatgacaattacttcgaaaaattattgttgtctgtagtaaattaagtggataaaacgtaataagcaaatatatgatttaaattaataaaaattctaataatcatatatatacttagcgtatgaatgatattaaattgttaacaattgtaattaacatatgtatatacatacgacatgcatgatttaaaattaataaaaattctaataatcttatataattagcatatgaatgatattaaattaattgttaaaaactctaattaacatatgtaaatacatatgacatgcatgatttaaaattaataaaaattcgaataatcatatataattagcatatgaatgatattaaattaatttttaaactctaattaacatatgtaaatgccacaagcatgatttaaaacttttaaaaatcctaattatcgcgtataactagcatatgcagggtttaaaattgttaaaaactctaattagcatatgtaaatgccacatgcatgacttaaaacttttaaaaattctaattatcgcacataactagcatatacatgatttaaaattgttaaaatctctaagtaaaattgttaaaaactctaagtatcatatgtaaatgccacatgcatgatttaaaacttttaaaaattctaattatcgcatataactagcaattacatgatttaaaattgctaaaacctataataaacgtacgtaattaacatatgccatacaacaactgatttatatggataatcaatacatccaaaatagtttacatcgtgtacacaatagttacgacaatacatcagcggtgacggttgaccgcacgtactttctcctcactattgttccctccttgtgatcgctacgtgagtaaggggtgtcttcatttgataggaggatgctagggtcaatcgttaccatgaaagggggttgcccatcaaactgatcgtaatcctcgtcagtcttgtcctcaactccgacgatttttcttttgcctgagagaaccacatgacgcttcggctcgtcaggccctctgcccttctttcctttgctagacatttccttcacgtaaaagacttgcgttacattattggcaaggacaaaaggttcgtccgagtatccaaccttgttaaggtcaaccgttgtcatcccactatcatcaatcattacgcctccaccagtcaacctaacccattggcaccggaacagagggaccttgagaggaccatagtcaagttcccatatgtcctcgatggcaccgtaatacgtgccagttgttccatcgtgtcccattgcatcgatacgaacaacgctgttttggttcgtgctcttcatgtcttgggctctcgtatagaatgtgtacccattgatctcatatccctggaatgtcgcgatcgacccagatggtcccctcaccaggaaggccagttgttggttgatcgtctcgttacccatgagatgttgtcatagccacgcggggaaagtatcaatgtgatgccgtgtaatccatgcatcggacttaccgatgtttctggcgtgaactagagccaagtgctccttgatgtaaggagctaccaatgaagattgttgcagaaacgtgaaatgggctttacggaataaattgttgtctatcgtcattattgctttccttccgagagttccctttccccgtagtctcccttcatggcgtgattcaggtaccccgattgggcgaaggtcttcaataaattctacgcgaaattcgatgacctcctctgttccataccccttggcgatgcttgcctctggacgagcatggttacgaacatacttcttcagaacgcccatgtacctctcgaaaggaaacatgttgtgtaggtacacaggcccgagaatactgatctctttgacaaggtgacaaagcagatgcgtcattatattgaaaaatgaaggtggaaatatcaactcaaaactccacatcattcagaagggcttctaatcta

SEQ ID NO: 68883 - DNA, 6132 bp, Oryza sativa
tgttgcaaggattcgacgatgaccatgtacacaaccttcttcaagtgcttaagatacgtactttctgtttcatccatacagtgagtgcaagccttgtcccccttgttggactgtccggatgggttgctaagtgcaggccaatcgttgatggttacgaacagtagcactcgtaggttaaactcctcctgtttgtcctcgtcctacacggggacaccttccttcttccacaacagtttaagatcttcgaccagcggtcttaggtacacatcgatgtcgttactaggttgcttggggccttgaataataatcggcatcattatgtacttcctcttcatgcatagccaagggaggaggttgtagatacacatcgtaatgggccaagtgctatggccgctgctcatctctctaaaaggattcatgccattcgtactcaaaccaaaccgtatgtttcgtgcgtcctttccaaagtctttaaattttctgtcgatgtttcgccactgcgaaccatcggcgaggtgtctcagcatcccgtcctgttgacgctcttcagtgtgccatcgcatcattctagcattccccttgttcctgaacaaatgccttagacgtggtattatagggaaataccacatcaccttagcaggaattctcttctttgttagctgcccatcaacttctcctggattgtctcgtctaatcatgtatcatagtgctttgcaaacagggcatgcttctaggttctcgtacttcttaccgcgatataggatacaatcattcggacatgcgtgaatcttctgaacttccagtcctagagggcagactatcttcttagcctcgtacattgtctcgggcaatttgtttccctccgaaagaatgttcttgacgagtttcaataaattgccaaatgccttgtcactaacaccattttttgccttccattgcaagaactccagagtggtatccaactttttgtgcccctgctcgcaacctgggtacaacgacgttctgtggtcctctaacatcttgtccaatttatgggcccccttttctctttcgcagtcctccttggcgtcctgcaacatctgaccaagatcatccgcaacgtcgttaccatcagcatccctttcctcctcgcccgtttgatttccttcaaatccaacgtactgagcaaagtccagaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccttatgcctgttagcttcggccactctcaaaaaatcatgcacgccatcaataaactctttggaccgccgatcagcgtacatccattgccgatccatctacatgacatgaaaaaaaatcatacacaaataattattcttacaataatgacagtcatacaataattataaaataattacaaactctttcaacagtcatacaataatgacatatcattattcatacaaaaatcataaaatattacaccaaataattcttatttactatttctaaagtttacaactaatattaatgtgttttacttcttttaattttcattttagtttgttttctattatttaagattaactatcactatattttccttctcaactattttataaaaccttctttagcaaaataaactaaatttctatatattctttcttccccacacaaattttctctctcatcaacttacaactaaattttggagacaaaaaagtgtgcaaaacatagctccaaatgtaatatgacaaaaaaaacattggaggatgaagttgctaaccttttaggcacctctgatttctatataatcaccaaaataaatttactagaaattttggcatgacctcccctcttttttgaagaaaaattgaagcttgctcgggcagttggaggaggaagaagacatatatatataggggtaggactttagtcccggttggtaacaccaaccgggactaaagctatgatctttagtctcggttggtgttaccaaccaggactaaagatcccggggggggggggggggcttgataggccttgacagcatttgaatcgggatctttagtcccggttggtgttaccaaccgggactaaagatcaaatatgcccgttaccctttttaaccgggactaaagatcatctttagtgatctttagccccggtttttattgcaaccgggactattgtggaattcggccgaccgacgaaagatggtttctccaccagtgagcagacgactccatttataggcagcaaacgagagttcgatgccactatattgctactagctacttattctatcaccaatttgcatgtggaagtaacatgcatcatggatggtaggctttggtttaggagtaaagaatctcacagaattgtgtttcgattcattcctcatgaccccatgcatgtagtttaagctagatcttttgattcatttaagccaacatgtctgctgatctgctctgacttttggatagtccatgccagtgaagcttgggaactagatatagttttatgattacacatagctagcgcactactggagagatgggcatctctgccggttcgcaaccccctttactcccgggtaatgaaccgagacgtccaattcgggactaaagatacccatctttagtcccggatgaaataacccagagtaaaaatggatctttagtccccgggactaaagattctagcgccattttagtccggtttcctttttttgtttttattcttgcatttattatcaccctcaaatccccacaaatcatccccaaatcacacaaatcacccccaaatcatgcacaacaagtcatccccaaatcatgcacaattctcagcccatccacgaaatcatccacaatccacaagtcattcagaaatcatgcacaacaaatcatcctcaaatctaaaataaactacaacaaaaattacaaatcattcaaaaaaaaatcagaaaacacgccaccgccggccacccggccgtgtgccgcctcccggcctccgcccctcgaccgccgccacccggccgcctccgctaggccgccgctgcccggcctccctcccaccggatatggcggagggtaggccgccggccgtgcgccgctgccgcttcgtgcgctgcggggcgcccgctgtcaccgtcgtcgacgtcagaggagggaggggggagggggaggagagggtaagggggaggaaggggaggagagggggagggctggaggagatgaaggagttagagaaaatggaggggagatgagaggatgagactggaagaagagttggagtggaggggataaggatgaggcggggaggacgaggcgcatgcggctaggtggtgctcggtttttttttaactttgctcctggttggtataaacaaccgggactaaatatgatgaggcgcgcatggctcggtggtgcactattttttttttaacttaatttgctcccggatggtataaacaatcgggattaaagatctatttttagtcccggttgataacaccaaccgggactaaaaaatagggctttgacatgtttttgaatcgagagtaaaattaatatttagtttcagttggtgttactaaccgggactaaagataaaaaaataccggtgtgttttcaaaccaggactaatgtgatttttgagtgacccaacaaagatcatttctccggtagtggcggtaattttatttttacccctacttggatatgtgcccctgttttttttaaagattttttccccagttcttttaaacggagccaaattttatctttattttggagggatatgttgacggtgtgaagtgaaaaggtatatatgtctttacttactgttacaaaattgtccctttatttgtgcattagttgtgtttttccccctaatattgtaaatgcagctcgcaaccactactaaaaaaccctcatagggactagctcataggtgccggttcatttaaaaccagcatctatagagcatttcccacctccgagcaatgaaaaaatatagaaccggcacctttaaccatgttagaaccggcacatatactataggtgccagttttttaaaagaaccggcacatataatatattataggtgtcggttaattaaagacttaaagaacagacacctatatgttgtttttaaaaaccggcacctataactttgagccaagccgacgagccgagaccatccgcgcacgcatgcgcactgcacccaccgcgcgtccttatctactccctcgcctttcctatctctcgcatatctctccctctctctctctcgcgtctctgtacccgtctctctcgcagcggctgcccagtggaggcagggtggcggcgggctcttctcttctctctcccatgttcttctcttctctcccttctagctatctgcatctggggcgggcttggggcggcacctctagcccccacggtggcgcacggcgggtggtgggcggcctccctggtccggcgggaagggagaaggcaggccatgggtggcggccaggcggaggcagtcgggtggcctctctctctcttctttcaggcggtggcaaccgagcggcggtccggcggaggcagcagcggcggcccaagttcatgcggaagcggcaacgcactgtttagttttttttttattcttgtttagttcatgcggcagcggtggcgcactgtttttgagttcttgtttaggtcttcctctcttttctcctccttgatccatgtcccaaatgtatgtgaacttgttgagttcttgatgcatgtaggatttcaattaatgtgattgttgttaagtttggccggtggttcgctgttggtttgctgttgagtacttgatgatgtgatccaggtttgctgttgagttcttgatgatgtgatccaggaggcggtgatgaatgggatgtgaggttggtgagttcgactcgaatgagccggctctctctttttttttttttttttttttttttttttttttttttttttggctcgagcaaagcttaaaatgccggctgtatatttctaataggtgccggttgctattatatatgtcggttgggaaaccggcacctatagacggtttttaacaagcaccaatgagtatttgtgtactagtgaacttgattttttttaaagatgtttaaaatcaaatgatttttgacaacctttgacaaatataacaattttgacagaatatcaatagaactatcacaaatttgatagtagaaattaaacataatttttccagtaaaagaaaacataatttttacatctttttacacagctagcagaagtagtcacagcactttgacaggctgctccttcactgctgagtcgagccgacggctgcaggatcacgttcacctaggctgcctgctccccgcgctctgcctacggagtcatcgccgcgaccttctcctccccgccgctggtcacattggtcatcgccgaggctgcctgcggagtcgccgctgttgccacctgctccccgcccgccatgtacagggttcgctaccacggccaactactccggccaccttgctggctgggtggctgccgccgccaccgctgctgccgtctcccggccactgccacctaggcaggtcgctgtcgtcgcctggaccgtatggttcgggaataggggaaacagcgtcagggccgattgaggagacagatttctgctctcattttcttcttttacgtatatcaggggtagaaaggtaaatcaataaattccaaaatgattattcctctttattcttattattttgttatcttaacaattccagtttccgggccgggtccactaacttccataaaaaaagagtaaacacctccttcatttgaaaaaaatgggcaaaaaacccaaaactcgaaaaaaaacacgagcaaaaccataattgaacattaaagtaggagcaaaacaaaattgttcctaataaatataagtcgttttacgtaagcttgcatataaatattcaaaaatggataaacagtccatgtctccatttag

SEQ ID NO: 68884 - DNA, 5345 bp, Oryza sativa
  unsure (1)..(5345): unsure at all n locations
cttagccagcagtgcagcacaaggattttaattaatcatatccatgatgcatgtgatatatattctccttgcattgcaagtctaaatgcaatgagtcaagtcaactccgatacattcatgttgatctccattacaataacagatatacgattacagtcagggtttcaaaaaccgctgggggcccggttaccgccacccggcggtacggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctgattacagatttacagtacgtcaaatgcaaattgattacttagcttgccaggtatttctaatcaatagtcaatggtgcgaaaaatagccctaaaaaatcataaccagccaaccaacaaattcaacaaaaggggaaaattgatggaataaattctgaaggagcccatagtagagattgcatgcatgtcagttgcccagtcggtgtgcgtgatcaactgttggctccaaacttcattaatttgaactagcttaatttggttgtcagcagggtacgataataggttatctttcaatatctctccattaacgggctttcaatggtgacatgctcctagctagccacccactgattacccttcggcttataattacgccacattcaaattttgaattttaaacatcagtttggagttgatcttatgttttctttcgttgtagtttattttctaacattttcttttaaattgctaagaaacatattatcattaagaattattttttattgctcataagcctattgaaagccaaaaggtttgtgctgggaaaatctagacaccaggtttacagcgtagggagggtcaaagccctcctaaaggaaaacagacagactccaaaacttactaccagctctaaaagcagcaacacaactaaaagaaccaaaagggctgccagtacaagcagatttcaaacatcacaacttcagtagatagaggatagtgccacaacttagggaacctcttaactaatctatcacccaatacccagcctatcactttcagagttggcagcagcggtcttcatcttctctgccacaaccatcatcgtgctagcttcttcagtatgccctaaaaccttccactgcagcaaataagaagcaatacaaaaaggaagcattaggggggaatacaccaattgagatctgaatatcatattgtttcttgtggtccaaagaacccaacagatagcagcaagcaaagaaaccaaagctcttctattactacaagcattatgttttattagcaagaaaaactcttcaaagctgcaggggacagtatcccagttcacaacatctctacaaatgcagcaagcaaaaattgccattggacagttaaaagaatgtgattggtagattcaatagtattgcatagcatacaaagttctgaaccatcccaacctttctttttcaattgttcacaagattggatcctatctctacttgccaaccaaaggaaatgtttaatttttatgggacagggagatttccagattagttgtagcatctcatctttcacccatctaaaagccatagctctgtataaagagttggtagtaaatctcttactagctgtcaaaccccatttcaaaatatcaggagagtcagtcaactctagctcttctaggattgtcctaacctgctgccattggtcaagttccagagggccaaaagttctcctaaaagataaaccacctatacctatctgtttcagctcagaattgtgattgattgtgggttgcatatctcaaaaatctcatgaaaacttgttttcagagggcaagacccataccaaacatctagccagaaccaaatatgggaaccatcaccaatcttctattcaattcagaaccaagcatcattcattttcttgtattaagaatcccagaccaaaactgagaagcaccttcagtagagcactgaaagactcccccagaacacaagtatttctttcttaatagctcaaaacagagactaccatcaggagattcaaccttaaccaaccatttagccaacaaagcaatgttaaacattctagtttcagtaagacccaaccctacaaactcttttgggaagatcaaatctgcccatttcatcatatggtattttctcccttgtttgttaccagcccagcagtatctacctcgaattgaattaaatttctgatgaatcccctcatacagctgatagaaccccatagcatacgagggaatcgatgagagacaggcattgatatgtacagctctccctgcatgagagacagaacaaccagaccaatttcctaacctcttttccattttttgggctaaacaataatgatgatattataagcctgtaaggtttataatatcaacataagcgaaacaataattatgattaatccaacctaaagaagtcaatggtcagcacacagcaggatattcttaccctgaattatatattatcacaaattatcagacgtaataagatgcacgtacgcacgataatgaacaacatgcgtatgcagacctagagaaaaattactctatattatctcaagatcgatcgatggaccaattctagtcaatacgtttaccaggaccaatattttactgatagttatctcatcaattaaactatgtaataaagctcacacagatatgtttacgtactccgccgaaatttagctttgttcctaattaatttgcgccctatctggaatatgcaaaatatcacattatggtttcaaaggaattttatacatcaatagttcaattcccagatggaagggtacgtagaggccattaagagcttgtggggaaaagaaaagggtgaatagctaatacggtctctgaagtttcgtttcggacttagtttagtacttgaggttttaaattgtctaaactagttctccaaattaatcatttgggttaatatagtacttggacccacaaaaagtgtcacgtgagcatgccaaatcatcctcacatgcaacggtatgaatgaaatgaccattctacccttatgtaccaatagaaaagaaagaaaaaaagaagatagttgtttcacacatgtatgatcgttatagaattgtcacttgcgattgctgtagccaagcactgatcgtataaattcctttgtcacttacgatttctgtttgtatcttttctttcttttctatatgatatgatatataagggtagaatgctaatttcattcataacgctgcatgcgaggatgacttggcatactcacgtagcatttgtttttaggtccaaagactatattaacccaaatgattaatttggaggacttgtttggatgatttaaaacatcgagaactaaactgagcccgaagcaaaactcacccgaaagaaaacgatctcttccgtaacttcatttttctgtgccgtgtctttccggacggcttcggtaactacttgctgttgtcagctagtacaattattatgcctgccttgcaacgtttaccgttccataatcgcaaaatttgattagtgtgcgcgcgcacgatttggcgttaaccaacaacacgtcggtgagccgtttgattgtcataaaccacatgattattgcatgtatggacgtggacgtgggtgcagatagagccttctatcagataagtacacatgtggagataccgcgcaccaaacaaacttatgtaatgtttggtacatctctactaatataaaaagtatgagttcatccacaatcctgcaatcctacaatcctggatccaacccacccagccacctggacccactccttatcacgtctccacaaaccgaacccacgtcggtccgggagaaagaaaaagaaaaagaaaccgagaaaacccacaaaccaccgttttctcggccgcttctctccgcntgngcagcgctcctcacgccgcgcgcnttttccttttgcctccccacgccacttgtcggcgctaccctccccgctcccgctcgntccgcagcttccctccacttgcgccgccgccaccgctgcctccaacgctgactccgacttcaacgctgctccggttgctgtgcaagagggaagctgtagtggcggcttaacgagcgagacctcctcccaccccgcctccaccgcatcaccgccgttgcgcagctcctgctcgcccgcatcacctcctccttcaatccgtgccgcccctaaccctagccaaaccgagctgcatccctcgaaaccgagccactccgctcgcgcgcggctgcgaacctaacaagggaaagttttaacagaggaaacttggtggaaactggattaagctctactgttggttaaaaaaaaagcatgcttctcatatgtcaccactgtttgcacctattccaaaaaaccaccctcttccagcattttgactttcaacaattagaaacggacactaggtaatggtgagcagcgactcccttgtcatatccaattagatttgataagacctaaactgtagtaaaaaaaatgtaccacatgctttctcatatgtcatcaatgtttccacctattcagacaacctccctcattcagcattttggttttcaactagtatcaaacactaatgaagcaatcgccactaggtaatggggcactaccttgtcagatccaactagaattgacaaggccatcattactacaaggcattcagcttagccgtgaattatgtcggcggctacgacggtagtgcaactaaacttctaaattggtttgatctttctttgttttggtaactccatactcaaatggtttgatctttcttttgtttgctaactccatactcaagagtagaagatcaaaggaatgtttctctcaaattacatgaaacgttcgacagccttcgacgatatcgnctcatgctcaattcagagaagtgcatgtttggagtaccaatcggcaagctacttncgtttctcgtt

SEQ ID NO: 68885 - DNA, 2196 bp, Oryza sativa
agcgactcccttgtcatatccaattagatttgataagacctaaactgtagtaaaaaaaatgtaccacatgctttctcatatgtcatcaatgtttccacctattcagacaacctccctcattcagcattttggttttcaactagtatcaaacactaatgaagcaatcgccactaggtaatggggcactaccttgtcagatccaactagaattgacaaggccatcattactacaaggcattcagcttagccgtgaattatgtcggcggctacgacggtagtgcaactaaacttctaaattgttttgatctttctttggtttggtaactccatactcaattgttttgatctttctttgttttgctaactccatactcaagagtagaagatcaaaggaatgtttctctcaaattacatgaaacgttcgacagcctccgacgatatcgcctcatgctcaattcagagaagtgcatgtttggagtaccatcgggcaagctactcggtttcctcgtctctggcagaggaatataagcaaatcccgagaagatcaaggcaatcaagaacatgaagtcgcctacaagactcaaggaagtacagaagttaaccggatatatggcggcattaagcaggttcgtcgctaggatgggagagcgaggacaacctttcttcgctctgctaaagaagcaagacaaatttgtatggacacaggaagccaaagaggcattcattgcactcaagcgctacctatcaaatccccctatacttgttgccccccaacctaatgaagaattatttctctatattgccgccacgccatattccgttagcactgtcattgttgtcgagagagagaaggtgcaacaaccagtctactacgttagcgacgctctccacgacacaaagacaagatatccacagatccaaaaattgctctacgcggtaatcatgacatcaagaaagctacgccactacttccaagcccacagggttacagttgtatcctcctgccctctcggtgaagtagtgagaaacaaagacgttctcggccgcattgtgaaatgggtagtcgagctaagccaatttgacatccgctttgtgccacgaacagccatcaagtcccaggtacttgccgacttcgtagccgattggactatgcctgataacaggtcagacaaccaaattgacaacgaaaggtggacaatggcgttcgacggcgcactcaacagccaaggagcaggggcaggattcatcttgacatcaccttcgggagatcaattcaagcatgcaattcacctcaacttcagggcgaccaataacacagccgagtacgaaggactactcgccgggataagagctgcagctgcactcggagttaggcgactaattgtgaaaggggattccgaactagtcgcgaaccaggtgaataaagattacaagtgctctagccccgagttatccaagtatctcgcagaagtcaggaagctggaaaaaaggttcgatgggatcgaggtctgacatgtataccacaaagacaacatcgaaccggatgatctagcacggcgtgcgtccagacgagagccacagccaattgaacctggcacctttcctgaccaggccatcagtgaaagaggcaagcggcgaagatagcccggtcacccctaacatcagctcgggggctacagaggcagagcgcgccgttgccgatatcgagagcacagatgactggcacaccccactcattaaattcataggcagtgaagagttgcccgaggacgacacagaagccaagaaaatatcccgtaaagcaaaagtctactgtatgatcggcaacgatctatacaagaaggcaccaaacggggtacttctaaaatgcgtctcgtccgacgacgacagacacctcctccttgacatacatgaaggaatccgtggatcacatgccgccggtcggacattagtcggaaaagcttttcgacaagggttcttctggccaaccgcccttaaagacgcctgcgacatgattcagcggtgtgaagcctatcaattctacagtaaacacacaaggctaccagcgcaagcacttcagactatccctctcacttggccgttctcgtgctgggggctagatattctcgggctattcccacgaggatagggcggctgcaggttcctattcgtggcgatcgacaaattcactaagtg

SEQ ID NO: 68886 - DNA, 912 bp, Oryza sativa
cctctgtcgcttttggattcacctatgcacgagaggggactgcccgttgcccgctggggacgggggtgaaacttgaggtgtggtgtgcttggctagagggggttatgcgaagggtcctgtcacggcctctttccggtatgtcgtggtggcatgtcggcacatggaaacatgtcgtggggctgtgtcttgtgggtacagttgtacacctttgattagagtaaaactattcgaatagccgtgcccgcggttatgggcggtcaaccagattcaccgtgattagattcaccctagactagtctaatggaattgaatagtataggtggatggttgggcctgttgcaacgtggtatagcattggacagtggatgattaatattgattaattattacaacggttttactactttcaactactatttataaatgctcgctttatgcaaaggaaccattatagctatcccttgataattccctgcatcatacccctattccggtatgacttgctgagtacagtgggtagtactcagtcttgctatattttccccaaaccccagagtttgagtatgcgtcagatggtggcttctccgaggagtaggcttcgtccgtgccgtcgaggatacttgtggagtggtgttcccgctgcggtgcaagtcaaggcttagctccagttatctttttattttccgctgcatttatgtaatacttttataatgtttgtaagacgtggatctgtatgtcaaatttgtcgtttgtgtaccccgaccggtcctggacgggggttttaatgcacattctgcttggaattctattcgggaatttctgggcgtgacaacctatttcaatcgggcatttagttatggccggcacagatggctttaattcacaaaaaaatttgttttttgggtaagccct

SEQ ID NO: 68887 - DNA, 2286 bp, Oryza sativa
ccacctctatcaccttcaaccccattcaacttacggggaacaatataagccgcatcataccaaactacattctccaagacaagacgccggatatcgactttaggaataagcacggctagtcccttacggtgtctttggatactgtcaggagagacgaaagtgctatctctgtcctcaccggtcttgacctcgaggagaaagcctaccctgttgtagactacgagtcagacctacagaccgccatgtcgacaacagttagataggctaccccaaatattgtactggtgtgattatggtgaataagagcaatacgggcttcggccaacaggatgtagggttattacctgacaattcaggggcccgaccctgtataaaaatcctcgcctctgtctcttttacctcaatctcacgtatgtcctagtaccgacgatccccatactatgcaaataccggaatcgcgacttcaaacgtcgactgaaatcatatcttgatgtcgcttgaaacaacatatttgcatgaagtgacacgtttgctcgacaagggcatgtcatattcacaatgatcatgcatatgtggcctttcatatgcgcttattttagtagtggatgaagaatccatgtggattgctacatctttacgtgctttgtatggtctatgattttgttgtagtggatttagtatttgccatatgtgcttcatgtttgttcttattggaattaaaggatggacatcctttatacgctccatttatatcttaaagacaaagtagcttcggatcgaatgtaagcacacagtaaaattgtagagtaccaatgatggtaattagttacgatgatgtacaaggatatatcaccccgagtttcacatgtcaaatatgatgatatctgagcttatttttaacttccgaaccactataatgttaaaactcagtacaatacaccgccaagggtggtaatgctactaggtgcactatagtacctagggtagataccatatctagatggcaagttcaaagccaacagagcttgagcttgagcttgacccagattccgatcaaagtagagatcatcaaactgctggagttgtagctgctgcgctatggcctgaacaatgttaatatcttgatagtgagactgttgcgccaccagcctgagctgttgccaaacttggttgtttttcagctgaaacgcagctgattgcaataaggggcttgctgctatgccatactgctgccttacgaactcattatatgggctaagcacatgttgctgtagcaggagaggtgactgcagctgatattgcctataactttgacctaaaacatcaaactgcgcagaggcgctgtttgcagcaatagcaagaagagcaaagacgaaaatgatcttcattgctacgggacactagatctttctttttttgttgtataatgcttgaactgtgtgaacgatggggagggttttcattgcgcttgtctatttatagatgcaatggcactgattttctttcaattcctcatcggttgctttggagtgttagttttgctttcatgtcctattaggatccaagtgagtcatgtcattcggacacatgttctattaggtgccccaacaaatcccctttgatttcatcacgaaagtaacttttgtgtccatcacatatactccctccgtccagtaaggagaaacccacttctagggatgaacctggacaatcatttgtccagattcatccctaaaccctaaacattgtccaggttcatccctagaagttgtcatattttgggatcggaaggtgtacgtgatggttagcaggctagaaagataatgatatgactcatcgctcgctttatacgttagtttggtaaggattgcaaccgttatctagctatatttgttatgttttgtaagctattatttcactaatgcatgacacgttgaacattaaggtcgtgtggcctcatgcattttatgttacaaaatttcaacaagaatgacaaaattatggtatgccaagtgctttttattgttccgttgatacggtaccgaacatttgattttatagcaagaattaggtttgcactgaattcttaaatcaccattcgagagatttacaagaaatcaccattttgctctacttgtagtgcaggattgacgtaattcgtattcttgtaaactaacttgttacgtgttttcttgtctaaactttttggatagacttggactgtgttcggaatccagggtacccaacccatctccattatattccacgcgcacgcttttcaaactg

SEQ ID NO: 68888 - DNA, 669 bp, Oryza sativa
tgacggttgaagctttgtggaagtccatacagtttctcaatggcgaggctacagggtggaggtaccttggcccccacacttggggaacaacctaaactgttgcccaggtgacctgcacttacaagagatatttatgctggtccacaatgtgtggtggcgaaaagtggggatgtgaatgtgatgaacacacgtgaatgaactaaggaatcctaaaaactggacacattggtaagataaaaagtgaattactttgagctaaccgaagattatataccgacttttcgcgcagactggaggcacgattaaacacctgtgagcacctgctgctcagtgacaatctacgacatcttccagaatattaaccatgcagcatcaccgacatttcgacataggaacgagctcacgggacattgccagaactgatgccgtgagttaccccattgcgtgtcttgtaagccgcatgagaaaaaatacagtgcccgacaaggattgctaatttaattacaggatccccaacccaacctgggtgcgacaagaaagctagcaaactgacatcaaaagcggaaccgtgttatatttgtcattcagggcatgcactgaatagctttctaacaataaaacaagacagccaacttggatatccataatttgaacccggcagaagccggg

SEQ ID NO: 68889 - DNA, 957 bp, Oryza sativa
  unsure (1)..(957): unsure at all n locations
ttattgagtatccttgcaaggggaatgttggaacatagtatttcatccgtttcatattataagactttttagtattacccacatatgtgtgtctagattcattaacatctatattaatgtgggtaatgttagaaagtattataatatgaaacggagggagtagtaagtaaactacccatctttacctatctacttaaacttttataatgaactagtctattagtgttgtactccttctgctcaaaatataagggattttaggtggatgggatatatcctagtactacgaatctagacatgatcctctccagattcatagtactaggatacatcacatccaactaaaatcacttatatttagggatggagggagtagctacgtatttcctctccaacttcacgaggctagagatgccaccggccggcgacgacaagtcgccggcggccaacggcgccggcgacggctattcaaaggtactgcagggccggtacgagctcggccgcgtgctcggccggggcgcctcctccaaggtgtactgcgcgcgcgacgcccgcacgggcgcccatgtcgccgtacgtcaaggccatccgaaagcagccgcagccgcactaccacccatgtcgctcgcccgaggcggccgccgcggcgcggaggtgcgtggagcgggaggtcgccgcgctccgccacgtgcgcggacacccgcacgtggtggggctccttgacgtcctcaccacccgctccaccgtctttacctcgttctcgagctcgcccgcggcggcagcgtcctgtccgcgctcgacggtcgcggcgtggggcactacaaccagccccgggggcgccgtctctttgtgcagatgggcttccccgtggcccacgcgcactctctcgactgttccaccgngaagtcaagtaaaaaaacctcttctgacgagcgtgccgacctccggtttacgact

SEQ ID NO: 68890 - DNA, 714 bp, Oryza sativa
ttactgtgggctgttcaagtctgtaccctattttttgttctctagttagccattgtgcaaattttccttgaatcagattctctacctgttgtctatgtgtgttatcttggtctgttaatttgcatagcccacttgttcattacaaaaggagatctttactacttacaaaaaaaaaaatctagtgggaaagtggttgcaaataattgaagaaattatagctagaaggtgtatccatggtggtggcttgagcccttgaatcccgttattttgcatacaattacatatgttattatagcttgcagagtacaccattagctgtagttacctggtccaccgtagtatacatgcatacagtaagcattaattccataactatcggaggtacgattttgctatatatttgtcgacaaatttttcctttgacagatgtaattacagtacaatcgtagtgtaattatattgtaacttgcatgtaattacactgtaactaacttgtatgtaaccttttaaaaatctctccataacatgttattttggtaaaatagaggtcatgggaacaaaatctttcacatatgtgtgtgctatgatttgttttttttttctcatcaaaataaatcttataatagatctaacgattcacaattatgtgaaacttacatataaattacagtgtagttacatgccagttacagtgtaattacatattagctaccg

SEQ ID NO: 68891 - DNA, 968 bp, Oryza sativa
  unsure (1)..(968): unsure at all n locations
ttattaataaaaatttaaattttcaactttaaatttgaagttgatttagaggtttttcatcgaagtttattttttagcctttgtttttagatcgctaaaaacacgtaatatttttattaataaattatttttcatttgcaaatatgtcccaactgatattgctgttaatatgttaatatggtatcagagatagaggttattgattaatccgcgcaaggggaatgttgttggaatataagtaaactgctcatctttacctatctacttaaacttttagatcgaactgtatcaatgttgtagctacaaatgcatacaacacaataaatatgtgtgcttattattgttaccaataaaataagtcatgtgaacaatttgatgttatgctgtgtttgtaagtgcctgtatatataattgcactttttaattctgccttttttaacatggtgcacatagcaatactttgtgtccaggtacacagcccagctaaccactgtacaaaggccttttagcacagagactccacgagaccacgagcagagaatcaaccgacacaaactactctccatcaaatcatcaaaccaaacaccactactttcctcttcaacttcacgacgccggagatgccaccggccggcgacgacgagtcggcggcggacaccggcgacggctactcgaagaaggtcctgcagggccggtacgagctcggacgcgtgctcggacagggcgcctactccaaagtgtaccgggcgcgcgacgaccgcacaggcgcccacgtagccgacaaagccatccgcaagcagcagcaagcggaccaccacccgtngtgccgcttcgccgaggcggacaccccggctccggaagtgcttggaggtggaaacgggagannccaattctccaaaaccctcccaaggggggggggggccaaaacaactcccccgctttctcccggcgggggggttttttttaat

SEQ ID NO: 68892 - DNA, 1553 bp, Oryza sativa
  unsure (1)..(1553): unsure at all n locations
acaacatctgtctttcctttcatctgcatgtgcattttgtttctcaattagtttacgaagacagacatttttttccacccatcacttgtgtatctgcaatatttgctttcacttttgaaacattgtaatcacgctactttgttctgccaaatagttaatcatgctttattgtctgtattgcagtattgcaagttgccgtgaaaggccattctagggaatgcagaaagatgtgcttgcacgccagagatatctcctatgaagagaagggcatttctcccattgatttgacatcactaattcttgatgagcgaggatttcagttgctcacctggtgcattctgcaatcacaaagtaataatgatgctatcaatgtcagaaatactgctatgctagatcatgcaatttctgatgatggttgaagtttttgcttttacggttttcctctaaaattccaataaagaattgtccgctagcattgttttgaatgatggaacttgagaagaatggaaacattctactgcgaaagtatgagattggaaaattattggggcaaggaacttttgccaaggtttatcatggtagaaacatcgtgacttcacaaagtgtggctatcaaggtgatcgacaaggacaaaatttttaagggttgccttatggatcagattaaacgagagatatctgtgatgaaattagtgaggcaccccaacattgtacagctgtatgaggtcatggcttcccaaatcgaaatataccttgtgctaaaatattgcaagggcggtgagttgtttaaccaaattcttaaggtaggttgaagaaaaatctgcaaggaatcttcccccattagaaagggctgtggattttgcccacgaaagcgttattattccaattgtaacccagaacccactgttgataaaatggaacctgaaaatccccgttttgattggccctcttgcttaatagacccaagaggccttttcccccacttgggaaatccccatttggggcctcggggatcccccaaaggtgttacggtcaaagcttccctcgtcttcgcggtactttttctgttatggcggntttccgctttaagagttaacttgatgggaagccccaaaacgcgaaaccaaattcaaatcccctctgtgttctctttcttcccaaattatcttgaatcttttgtcaccacccaaatgcacccccttcaaactattgggactcctgtttcaaaagggctgtctcctccattctttacactcgggcaaataacccttcccgccttgcgtggttaagtggttcctcctcctgcggagccnctctcataaacctgcggacaccgctccttcatctnccnccgctgcgttcttatattttttttggcgggttgcctncttgctttgggcgccctgcaaanataaagggtnttctcacatcccgcnccttnttccatacgggtgntccctcctccctaccgacaaaacaagagcgtctaaacatcccggtaatgagaaggcttccatncaaccatatgggctctttttttgacaaaaagccacg

SEQ ID NO: 68893 - DNA, 1224 bp, Oryza sativa
  unsure (1)..(1224): unsure at all n locations
cagtttgagtgccacatgactatagggcgaattcgagctcggtacccagcatttcttgaaacaccaagtgtggaatagaaatcctgtaaattaaaatatcaaatccatgtcaggaaactggattttctaataataccagcaaagaagaaaagcaaatgaagtaactcacagcatcagctctgacaatgaaccttgaactccttcgatggcgaaatctcggtgatggtgcatggttaaatagtcgagaagatgtccgtgattgtaaactagcagtaggtgatacaaggtgtttaagcctgcctccactactgcacaaaaagagatatatcatcttcagtttactcagaaatcttgcctttttataatatcaatgtgtcctttattttagtattcctagtacatctcactgatcagaacacattcacatacccacttttcgacaccagaaatcttggatcagcataaataactcttgtaagtgcaggtgacctgngcaacagctgaggtttttccccaagtttgggggccaaggtacctccaaactgtagcaacgccattgaaatacttgctggatacccacaaagcttcaaccttcaatatactagctgccatttcacagagatagagtcaggtgaagcataacaaaagcaatacacaaaagaacgatattcgagtaagttcacaattctattcaaaaaacgttctcttctaaatttaaataaccaacacatatcgactgtcatttactccttactnncttaagaagatgaataggggcgagggtgtgtacaactgacatacatatgtactgcttgcaagaaccttttcaagagacattggcctgctgagcaagccattgctaccgtggtggatgcacaccggggcccacagctagtaacttaagtacagctgcaacaatggcttttcaaccaggccgggataatttgcatggattaatatgggggattgacaattcttgcagtatacaccttttaaggtcaaggaaaataagtttgcattttggccttcataccaagggaattgtgatactaagaaattggcatacagggcaaatgggacacattccctttttttcttgggggggggagggggtggaaaggggtttgcttctctcgcggcccaaaatttaatttgccaacacggcccccggagagaccgggttaaaaacagggtatttttttttttttgggccaaatacaaaca

SEQ ID NO: 68894 - DNA, 660 bp, Oryza sativa
tagaccgagccgagtcatgtcagtatccacccctacccttgatgttgaaattagaagcttagagcctgtttgaaaaagctttggaaaactctattttttccctgaatcgaaaactcccaaaataattaagtttttcattcatataagctagaagtcagaagttgaactcaattttttgcatattatcagaagttgggtatcaaccagcagcttcttaaaatctttaaactctccaaacgaatccttagcatcatatattttggcatcgagtaatacacaaactaaaaaattataaaccaaaaatagatttctatctcagcgtcatgggtcatggtgttgaggcccactatcattgttctaaataaggtgtgaaggtgctaggtccaaacccacttccactatcttgttttttttcgccacttcagaatctgcgttatcgttggttttttgccacttaggaatctgttccgtcttggtttcttttttcttcagcacttcgaaagaaaaaggaaacaatattgcagcgataaagattcaaacattgatctccaagataatacagacaccatttatcactggagtacgcatgctataacccgcatttgcgaatttcctaattagcgcagacgcgctaactagccatctagcgtgcgttttagg

SEQ ID NO: 68895 - DNA, 944 bp, Oryza sativa
ccccttctccccctaaggaattactttccaaaaccctgagccaaggggaaggaaagggagaaaaggtgcggcctcggttctagctcaaggaagttagatctggcaaggccaagaaaaaaataagggcaaaaggtcaaaaaaaaatacgttgctccacaggagttcaaactaggcatgccattgggtgaagatgacgtgcttgccacaatgggcaccgcttggaaggaccttcacttatactacatggagaaatctaacgccaggaagccgagtaaagctaccgatatcttggagagcacgatggaaagccattccttggtccaacaaattatgtcgtggtcgacttcaaggatcttttcgacctctacaggctccgaacggtggacacaagcctccttaagtgctactccttgtaagtattgtcgcccaactcattctggtaataacaatcggtttaacttgcttacaagatcgtttatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcctgccgagacaaggagtacattatgtgcgcctataatcaatagtaagtgtgttaactaaatatacacaacaaaatgacacacattccttgagtacttaattaactttcactatattaatgccgcagtgcccattggatccttctggtcataacacctaagtggagtacatgtcactacctgaactccagaattgataagaacgcatataattggaccccaattcaactagcaatagatgaagcgtgggcccaatatgtgcaaagaggagacctcaggaagacaggacatgacaccctcatccacaaaaaagacttcccggtgaag

SEQ ID NO: 68896 - DNA, 1468 bp, Oryza sativa
atttaataaaatttgctattacgtttatcccttatttactaaaacccaataattttcgagtaattgcattatttttcaactttaatattttatgcaattttttctatttagaaacacatatgtaatggaatttaatatccagtgcgcttatcagtagtgcggttctttaccctaccggagtttaaaagaatttggaaatagcgggaaaatatatttagtcccggttgatgagaacaaccggtaaagatatctttactcccggttgttctcattaactgggactaaagatctagaggtatatatattcccgatgtgcgccctcgtcttctctaccaacacttagaaatttttgccccgatcgatctctctcggcttctccttcgcagccactgcctagggcatccccgcaccgacgccgccgtcgtatctcgacgccgtcttgcgcgtgtcgtcatcgccgcctccgctgccgcctccgaccccgacctcgatgcggccggcaccggcgacaacgtcgccctggcagtgccgacgaagccgcgccacaataccgcggcgacacgacacgccgggacgccacgacgccgccgcggcacggcaccgccgcgccgccccgccgccgccgcacccaaagccgcggccgcgctgccccgccgctgctccgctgccgccccgtgaacgaacgaacgtgaacgagaacgtgaacgtgaacgaacgaacgaacgtgaacgtgaacgaatgaacgaacgtgaacgagaacgtgaacgaacgaaacgtacgtgaacgagaacgtgaacgaacgaacaaacgtgaatgaacgttaacgaacgtgaacgtgaacgaacgtgaacgaacgaacgttaatgaacgtgaacgtgaacgaacgtgaacgtgaacgaacgtgaacttaatgttgtatttgaacatacgtaaacgaacgaacgtgcgtgaacgaactttacttaacgtacgttaacgtggacgcacgtgaacgaacgaacgtaggtgaatgaaacgtgaacttaacgagaacgcgaacgtgaacgatcgtgaacgaaacgtgaacttaatgagaacgcgaacgagaaatacaatatatgttacttcgcgtttctcctaatacatctttttgtatgttgcagaaaagacgttgtcgtcgtcgtccctcaagccggagtggttgctagccctcgaaggaattcgcgcaggcaagtgatgtaaatatatgattgttagatttttaacgcaattaagactattagatttaatatacgacacttagacttagcattataattagagttttaatataatattttttgagttttaatataagattattagatttgtaattagacttagtatataattattgactagctagggtcctaatatacgtcacttagacttagcatagttgactattacagttttaatacaatattatttgagttttcgtatacgatta

SEQ ID NO: 68897 - DNA, 550 bp, Oryza sativa
atcaagtcaaaaaacactataaaatgataacataagcacttatgatatcattttatagtgttttttgacttgattgtcgttttatagttgagatatggtagtctgacacatgccaattatgcttcagtttccaatttatgaggatactcacttatttccagcacattaatctgacatgtctttttctccagggttttcaaaccaggttcagaagaagcctcagtttctaaccaacgtgatacaaagtcgaatacagataaaccaccaatttctcaaagctctgggcaaattgtttctttcactagtaatccagtatttaacgtcatctcctcaaaaccaacaaccttaagcaatggcctggcagatacaacaaaatctgcttctgctgctgtatttccttccaatggatcaaccaagtcagtttgttctacaaatgctggctcttcaacaccttcgttcccaaagttctcatttcagcctggattccgaacatcaacctcttcagtgcaatctagcggtattcaagagcctgctataacagctccattca

SEQ ID NO: 68898 - DNA, 1474 bp, Oryza sativa
tcctcatcgtcgcccccatcatacgcagccatatcagagtcaggtcgataagaacgaccactccatccccttcctcttccttggcctcggccttttcttccgccaccattaaaccagttacccgatcttctaaactcaggtgctaccaaagtatcaggatactgtatcgcttctggaagatgcacgccatcaccatgctcctttgtgacatgacccaccagaccacaaatcccacagaagaccagcatcttctcatacatcagccggaaaaaccacttcttcttattcaaagtggtgctcctactcgcaggagaggcttacgaacatcaactttcacccttactcgaacaccatcaccactcccttttactgacgcctcatctaatttgatgacagttcctgctttacggactaactgagttgcaatactccctgttctgatcttctctttcagatcatgaatctggacccaagtgggataggtttcaagaaccacagattcaatctctgaccaaccatcatattcagcaagcagcacaggacaaccacggaaaatccatggtccttcctccataactcgctcccaatcagcaagacaattcaattggattgaaaacaaattatctttcatggacctgaaatctacttccttcgcacaattccatgcagatcgcatgctggcaaacaaagcaccatggctaaaggatttctctgtatgaaccctagctagggctaaccatcgggcatccgcttccagctctttgagatcttcctccaattcaacatcctcttcctcgtccttcctgagatccaaaccctccaaaagcatctcaatatcatcctttgcctcatcttcttggcttgccggggatcctttagggttcgccgacttctgactctccgttgcagaggctgcgctcgccatgagatccagtaaaatcgctcttcgtcttcacgtcgacttgcagagcagccatagattgaatttctaaccgactccgggacaaaatcaacccagatcggagaggtagggtgaaactccaaggcgtcgcgttagaggagagaaaccctaattttaggcgtgagttagtgagatacaatgtcaatcaaattttaatggatagtcgatgcgacagtgatcttgatcgtttgattagaaaccaacggctagagaaaaaagatgacgtggaatcaccaggatgcagagaattcctagtagtggggatgatttgtataggtatataggataatagctcacaaaacataacaaatatagctagataatggttgcaatccttaccaaactaacgtataaagtgagcgatgagtcatatcattatctttctagcctgctaaccatcatgtacaccatccgatcccaaaaatgacaacttctaggggatgaacctggacaaggtttagggtttagggatgaatctggacaaatgattgtccaggttcatgcctagaaggg

SEQ ID NO: 68899 - DNA, 1218 bp, Oryza sativa
  unsure (1)..(1218): unsure at all n locations
ttggttttaagggagaaatttttttcaaaatttggctcccctaacacttgaaaattcggcttattgaaaaacttggaaacctagccatttncggaagctttagagaagtttaatttaagaaagattagtaagaatttgggagtagatggcctacaattaatgagaccaaagcaggggctttccaataaaagagctccttttataaccactttggcaagatgaaaaaaatattcaatggttgctcgaatggaaggtccatttttttgaaagaccacatccctataacatgataattcgaaggcacaaaatggttgagaagccaaataatagattggataattcctcccacaatactatgagaatggaaattttagagtctgtgatttgtcatacttatctaaagnaaacttccagttaggattaagacatcaattacccatgattgatttgtacaaaacctaaatattatcaattatcaagtatgtttgcttaataatcttaatgggtgtttttatttctttggcgagtagccttcatagcaattctcataggggatatgcaatatttgacgtctccaccctacacttcccattgtatgcctattgaggaagggtaaatgtccgtacatagattattgtattatttgtcatgttcaagaaatattcccattgtgtgcttattccccatgtttacaatgtgaatttcattgtatgcttatcgatgtagggaaaatgcttcattgaagcaatatttgtcgtctccaccctacacttctcaacagttccagggttgattcagacaagatattggaagagtctaacctaattggcatggagggagagttattatattgttgcctcatgttcttctgggcactgacaaccactacataacctagtaaataataacgaatcgaacacaacatgtttgccaattagattttatggaagtacaaaagtaataatggtttagccctacttacccatcctcaccggccgggaatctaacgtaacaagaaaaatataataagatcatggtggagtagaagtgttggcggttagcaatgtttaacctaaatcacatgcgaaaccaacagtttctccctgcgtattccttcccgttgtaaaggtaaagacacggccacaccgtttcagtctcaaccatcagtttgctggaatttcccagcgttctagaatggaatatagctaaagccgcaag

SEQ ID NO: 68900 - DNA, 2170 bp, Oryza sativa
  unsure (1)..(2170): unsure at all n locations
aaaccccctttaattttttaaagggggccgggaaacacgagaaggggttggacccttgttttttaaacacaccatttttttcaaatatttaacaaaaaaccgtgaaagtgttgtttaacagatatttaattggtcatccggccaaaatttaaacccaaaaggtatttccgggaatcctcggaaagggtgatttaagattcagggccaacctaatttcgtgttgaaaaacaaattgtgggtgncacaccacggaacaaataaaagcccttgggtgcccaatatttttgcccctcgtgtaaaatttgatattanaaagcaataggccacncgacttaaatgtccacgtgtcatgcattagtgaatataatagctcacaaacatacggaaatatagctagataccggttgcaatccnttcccaactacggtaatagagtgancgatgtgtcatatcataattttttaagccgtgctaccaacattgtacacctttcggatccaanaaatgacactttccaaggaatgaacntaacaaaggtttagggttttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaatgaagatcattttcgtctttgctcttcttgctattgctgcatgcagcgcctctgcgcagtttgatgttttaggtcaaagttataggcaatattagctgcagtcgcctctcctgctacagcaacaggtgcttagcccatataatgagttcgtaaggcagcagtatggcatagcggcaagccccttattgcaatcagctgcgtttcaactgagaaacaaccaagtctggcaacagctcagggtggtggcgcagcagtctcactatcaaggtattaacattgttcaggccatagcgcagcagctacaactccagcagtttgatgatctctactttgatcggaatctggctcaagctcaagctcaagctctgttggctttgaacttgccatctagatatggtatctaccctaggtactatagtgcacctagtagcattaccacccttggcggtgtattgtactgagttttaacaatatagtgggtcggaagttaaaaataagctcatatatcatcatatatttcacctgagaaacctcgggtgatatatcctcgtacatcgtcataactaattaccatcattggtactctacaatattactatgtgcttacattccatccaaagctactttgtctttaagaataaatggagcgttaaaggatgtccattcttttaatctagtaagaacaacaccaagcacatatgtcaaatactaaattcactacacaaaatattttgaccttacaaagcacgttaagatgtatcaattcacatttgattcttcattcactactaaaaaaaagcgcatgttgaaaggccgcatatgcatgatcatttgtgatattaacatgcccttattcagccaacatgttacttcattcaaatattgttgttgtttcaagcgacattaagatatgtattcaaagtttaaacactgggtattaatgactctaatactgccatttaattcaaatgaaagccattgttgccacatcttcctacaatattatggtccaaggacttttaattgaggtccctcctttgtgtaccagaagtttacctgacgtaacctattcgtttaaaccaaaaaggctctccccctataagggggaacaccaaaaagattttttgttctctttttatctgcccgaaaataactaaaaaaggcctctcttcaaaggaaagaagaagtttcttttatgctctcaccgcgggggttttcgccccccctttatagaagatttccacaaagggttttacacacaacagtaatactcttcg

SEQ ID NO: 68901 - DNA, 2562 bp, Oryza sativa
  unsure (1)..(2562): unsure at all n locations
aatctaatttggcggtttaatgttcccagaagaaaacatttaaatatttttaaggggggcgagaattgtgtgttcnataaaccaagcacatacacaagattttttcaaaaaaaaagatgggcgttgaaacacaccgcgtccttttccaatttttaatccgtgtaaaagcccacattaatatagtgcccaaatcttttctatttagtataaaggccacttatattaatcacggttccacagttccaagtgtgcttccatccctaatccaagtgacaantgggcattccaatcaccaatccacnggcttcacttgcttcacagaaatccaaagaaaaccaggcctgagcacttgttcttaatcattttttatcgaaanggaaaatgnacccacncncnatcattttcgtgacatatattatatatgttggagagtattttgtttactagaataaagcctnacacttgaggtgagattgagaagaananaatcaagctgaatattaattgtgaataaatatttttatatatttagagctgatatgtgaaattcttaggatgaatgaaaaccatacnacatgtttctcttaaaaaatacngacatggttatcctagtggctatgtatcttcttatccaacgactgctatctttactctaatatgcaatctaatggttagaaagtgtttgctttatatgagttaatgttccttagtggatatcaattatatagaaccaaagatatcattgcaacggatgatcattttaggtaaactttttgcatttttagcatttcaaaaaccacaactgagtgactaaatcgaccaaaacaactttaaagtaactctgaaatcaaaattggctgctacttataactaaggcaaagacaagcaagctcaagtagttattaataagtattgcttgaaaggtaccaagaaaaaaaaaacactagtaatatatttttgcaccatcgtgtagcatcattacccttcttgattatagggcagcaatgcttaattactgtttgtcggaatatatatcagtacataacctgtattttcggatcggtattaagcttttgaattgaaatgataagtaacctcatctttttttttatgcttatacttattaataaaaatttaaattttcaactttaaatttgaagttgatttagaggtttttcatcgaagtttattttttagcctttgtttttagatcgctaaaaacacgtaatatttttattaataaattatttttcatttgcaaatatgtcccaactgatattgctgttaatatgttaatatggtatcagagatagaggttattgattaatccgcgcaaggggaatgttgttggaatataagtaaactgctcatctttacctatctacttaaacttttagatcgaactgtatcaatgttgtagctacaaatgcatacaacacaataaatatgtgtgcttattattgttaccaataaaataagtcatgtgaacaatttgatgttatgctgtgtttgtaagtgcctgtatatataattgcactttttaattctgccttttttaacatggtgcacatagcaatactttgtgtccaggtacacagcccagctaaccactgtacaaaggccttttagcacagagacttcacgagaccacgagcagagaatcaaccgacacaaactactctccatcaaatcatcaaaccaaacaccactacttttctctccaacttcacgacgccggagatgccaccggcccgcgacgacgagtcgccggcggccaccggcgacggctactcgaagaaagttctgcagggcccgtacgagctcgggcgcgtgctcggccagggcgccttcttcaaggtgtaccgcgcgcgcgacgcccgcacgggcgcncacgtngccgtcaaggccattcgcaagcagcagcagncgcaccaccacccgtcgtgccgttcgcccaagcngnncgcccgcgccgaagtgcnttgaagtttgaccgagnctnncnnnncccccntcctttctgcccccctccctccttgtcgtttttctcctttcttttatctcttcttctcntttttctttctcaatatctatancatggcaaacattgccttcctggaaagacctttattcgtaatatttggttcgggtaaaaattcttttttaacccttttattctggatggggcactaccttcctttgcgagttttttattcttctaaggggtttatcgggctacatacattttataaaccttggaaaaaacaattttctgcccgatttaaaagagggattccatcttcaaccgctaatcctgggtggttaatctttcgagaccatctttaaatgtctgtactcactctgatgggccacctttctcacgttctaattgtgaaatctggtagttgttgtcttacccggtgtataacgcactccatattctcgttcgtgaacactttataacgtctctctttttccaccacgtctttttctcaacacctcttctcctgtatagatatgtggcgattaaataacgacaacatttcgattgtctctctgtcg

SEQ ID NO: 68902 - DNA, 651 bp, Oryza sativa
ggtttcgttggaccgggcgcacggccgccggttcacgcgaagggccgccggagatcgaaccattccaaacggaccgcccaagatcgatggggtccacgccggctcacgccgaacgactccgatgacgtcagcgatgacgtcaccaccgccgccgccgctcgccgggttcgggctcacacgctcgccgccaaccgccggcgcgccggcccaaccgaaaacccccggaatgaaccggccgccaagcgaacttccccgttgaccaaaggaccgccgaaaaaccaccgaacacccccgccaacaagaagaaaccgccaaacttttcggctttcagcaggcgacggccgttcggcggttcacaagcgcggccaaaccgccgaccgggaccgcggccactttgcgattccgacggttgcctttccgaagtgaccacgaccgccgtaacgacggcggcgcccggctaaaccaacggcggccacggcggcgccaaaggttccgaaggtaaggccgttccccacaccgccggccaaagccaaggaagccaccggtaaaagaaaaccttggggtccttaataaaggggcaaccaaccgccaccgaaggcccacgccgcccgccggcgagaaggaaactttagggtttgggagagagaggaa

SEQ ID NO: 68903 - DNA, 1699 bp, Oryza sativa
tcaatgtcatacatgaccgtcttccaaatcatgcatggtcgtgtgtatgtgttacacactagtacagatccttctatctgtgacgggctctaatatgcttagaaatagtgggccgtcacaaggaagtcatctcaatcgggctgaaaagtgcccgattgagatatggtcgcatagacatgttagatgggtataaaacttaagcccgtcatggatgacacctatcagtgacgggccacaacttgaggcccgtttgagataacaactaggcccgtcacagatgactcatcagtgacgggctatatacttaatctctatcgggcattaactaaagcccgtcaccgatgactatttttccatttttcatatgaaatgtttatatttgtaagttgactatagcaaaataatttttacgggtagttgactagcccatcacagatgacccttatctgtgacgggcattaactatcgcccgtcacagataagggtcatctgtgacgggcgctagttgtggcccgattgagataggtcatctgtgacgggctatagtttgactggtcgtctgggtcaaagctatcggtgacgggctttacttagggcccgattgagatagaatcatccatgacggccgtttgcccgattgagatagctcttcacatcagtgacgccatgcccgattgagatgggcttaccacccgattgagatgagggtatccgttctagtgacacccaccactgcagcagcaacgccggatgttagagatgacgagttcaccattaaagctaggttccactagcagttcttagtctaacctgaatttctacgcttgggtgttttctgaaatttatatctcaagtataatccaaattgtcatgataatgtttgaagaaagaaaaacaatagctagaaatcctgagaattttggcaatctcttgtgcacgaagccaaactccaacaataatcagtagcatatctgccatgattttcatttttacctttgaaagcagctttccgaatggttcccagttcgttatgagttggatcgtcggaggcaaggcaatgttcacttagaccatagtctagacggtctagaccgcgtctagacgctagacgacgggttatcgtctagtttaggacctaaactgtgaattagaccgtttgaccgtctagtcggtcaactagaccatctagaccacacaattaaacaacatttagatgactgtagaccgtaaacctatcgtttagattgtggtctaagcaatagatgtgacatcccggcccaataaggattaggcctgtgtagcccatgtgagctgtgtccgcatgtttagtaccaccttgctagtttagcacgagtggaaccgacttatgaggcctcttccctccaaccacatcactcccgggttaacccttttacacgaagcaaggacgaaagtgtaagtggggtggtgtgtgtaagtgggcccgctcatcggttgggctgggctacgcggatctggagggagggctgttacaaatggtatcagagccgaccctcgcggttgcgcgtacgggtcagtgtgcgggcatatggcgcatggcgcatgtgcgcactgtgtgaggcacaaggcatggcatatggcatcgacactggacgtacggatgtgcgctaagagggggtgtgttcctggacatttgcctgtgtggctgggtaagttggac

SEQ ID NO: 68904 - DNA, 2072 bp, Oryza sativa
  unsure (1)..(2072): unsure at all n locations
ggggttttaggggattttccttcgaaccaaatcatcgcggggttaaccttttaccccaaaaagggcacaaaagtgtaaatgagngtgttgtgtgtaagtgagcccgcttcttcggttggggtggattacgttgttttgtagggagggttgttacaataggccaatgcattttttttattgctggagctgaagcaacgaaacttcgagcccagaccaaagccttatggttttgaccccattccatatttctctcctctactcttggctagtcacggcaacgaaatcacgtcatctctcctctgctagtcgtcgcagtggaccttgctcccacctctctccaacccacaactttactcgagtggctgcccttatcatagcactgctagttctctaatattctgtgaaaaatgttaagcatattacgatgaatatattctgccaagaaaaatatgcatgaatatattacgatgcaaaaatatttatgtttgtaaaactacttttatgatatatgtaagttacttttatcatatatatatatatatatatatatatatatatatatatatatatatatatatatatatatatatatatatatattacttttagatttgactaagttacttcttaaacattcataatgctctaaaatgattatttttattatttattctagtcaattctataatttctggactttaaatttaatttttagatagaccatatttttctccttccaacgaatttacttctaatggtgtaataacttacttccattttatgtttgtcaaggttatggataccatatacctaatagtagttaactaaatctcggcaggacccaccacataccatgtcttatacggaaacaaccttcggatataggaggagttccgcataaggaaggatgaatagagttctacatggaaacgataaggactactcggattgtatccatattggtttctctagttctatttggacaagaggacacctatgggtataaatacaaggccccctaggaagagaggggacactgaacaatagatcaagacacaaaatgaacatacaagccaacatgcgccaagacaagacgctggatatcgacttcagagataagcatggctagtcccctacggtgtctacggatactgtcaggagagacatagcgttgtctttgatctcgtcggatgtggattcgaggaggaaggctaccgactacgagtcagcactttagaccgccagatcgacaacagttagataggctaccccaaatattgtactggtgtgattatggtgaataagagcaacgaccggcttcagccaacaggagtagggttattacctgacaattcaggggtccgaacctgtataaaaatcctcgtccctatctcttttcttacaatctagcatatatcctagtaccaacgatccccatactatgcaaataccggaatcgcgacatcaaacatcgacaatgttaagttgcttttatgatttatgtaaattactttaagactttattgaatttactttcataaatgcatttaattaaaaatcttctctacatttttctcgtgaatttactctacatataatttcttatttcaactcagtcataacttagttgcttctaatctatagagagttacaatttaaataaattacttttaaattaataaaatgtttaaatatattcaacatggatcttgttttatcatatattttatgtagagtacaataatataaatatatcttgaagataatatgtaatttaaaagatataagttattaaagatgttaaaaaaagacatgcaccatatactaaagggagaattatatatggaatggagtggtctactgttaggactaaagcactaccatgcgagttcagatcccctggagttgaggccaacttcaccagataggtttgggtaaatctgaaccnctcggtttgcttctacagcttgcatnctttccccccccccccccttcccttgatttttattatgtccattggaagggaaagtttccaggggtccccccataatattaaaccccttccggctaat

SEQ ID NO: 68905 - DNA, 695 bp, Oryza sativa
cctgcaccccttctcaaattgccatcaacaggttagtgaattatataatatctctctaacacttgaatttaattatgtacctatcggggtgaatcctcccatcgaccaattgggaaaaaattggaaggttccctttaattttcttatttatatgtatcaaaccaagtgatttaaatgtcctcattctcccaatgtccttcttcgccctggcctaggggtaaaatttcactcctctaaaaccacccacatttagttggtcactgtttctgtcccgttgtgaggcatcaagaatcaataagcatttcatcatcgtctttgccatcaacgcacagatctctcgtaggccctatgcatgatattcacgtcatgtggccagtggcggagctagaaagtttccacgtctaggactgatctaatgggaacttaaatattttcataaattacatagtatttttcaagattataatagggattatggagctaggcatggggcccaagccctagctgccctatgcctgattccgcccctgcatatagcctttacaattttcaccatgtatgtggctctctcttgatgcaccacacaacatttatttgactgaagtgccaatagcccatgcataggagaagaagagatgggacaaagtcctatcaatgtgagaaatattatctttccttcatccttatgcaccact

SEQ ID NO: 68906 - DNA, 758 bp, Oryza sativa
cctgcacccctatggaaccaaaggtaaaaaaaaagaattaacaaacaacgcagattaggaattaaatggcttttgattaccaacttgcccccctccaaaaagaccagccagtcccaaaagccgaagaacattttctttttggttttccccttccgggccccccggttaacctccaagggcttcccctcccccggccaattccggcggaagaaacctccccaaaacttattccaattcggccaccggccgaaccgccggggccgccgccgccatgccggaccgcttcgccggccacctcagcaagcattgcacgcgatgcagtccatcggcaggtcgcacatgcccgtgccgcggccgccgccgccgttcgactttcctctgcatgttggatatatgtatatatcgttctcacgtctgcccttctgctgttgttgaagctgcttggcggcgagaggtggaggatgaatggcaaaatgcgggcatatatatgcatataaatgcttgttctgtggtaatgaaaataacatggtgtcgcgaccatggcgacacgcagagctagtcacctgcgtcctgtagtttctgttttcattgtaagcgaaggacgaacaagcgttcttgtgttaatcacataatgacgacatcgtgtataagagcgtacatagaaaggttgacccaaccggtcggtcggtgaagagaccaatgatgactagctaatactccctccgtttcacaatgtaaatcattctaacattttccac

SEQ ID NO: 68907 - DNA, 7915 bp, Oryza sativa
taaacagaatacaaggcacattctttccacaaagaacaaatcaatacgtagtgcaataaactaatcaaacatgcatctctttctccacacacaacatgacttgttagagcaattcagagcgacaacattcaacacatttcatcaggagaaccgtatggtatatccccgaggccacgcactggccatcgtcggcaccgcgtgccactgacaagccatggccgctgcgccaggctacacgcctaaggacgtactccctctgtcccaaaaataacttacctaggatgggtcacatcctatcctagattgagctattttgggacggagggagtagaagcaaaacttagattttttttataataattattaagagatatgatctcagccgtagaagaaaaggagggtctatatttggccaaatccacctggtggggtcgtccacaactccaggagatctgaacccgcactctacctagtcacgtccatataggcaagatgggtaagcagatgggcaagacaaattcggatggaaaaaattccaccttgaaatttttaaaaaaaattcaaaaaatttattaattagccaaaagaatattctatacggggaccgaaaatgcaatccaaaattcaagatgggtaagcagatgggcaagacaaattcggatggaaaaaattccaccttgaaatttttaaaaaaattcaaaaattttattaattagccgaaagaatattctatacggggaccgaaaactgcaatccaaaatatgagccagccaaatcctagtcctttaaggcagaagacaattttccacgggaattagttattggtgaagaaatagagtgcaggtatcttctatgattatgctataatctatatatgaacccctcattgattgagcacgttctaggattggaatttggatttgagggcatttcacacatttcccacatttgtctgttatcgttcaaatcacttcatgtgcatcactaaacatatacagtacgtgcgttctcttatcttttttattaaactagtgaacgtgcacgtgcaaagacacgttatcgtaatatatattattgcaaatagaaacatatcaattattaagtgatagttacaaaataacttatcccttctattaaaaaaatgtaattgtaaaacaatgctgtcaccttagcaatctgcaaccaacaaattaatgtttcatgactattggatacatgtgagatccctagctagatatgtgaactaaaagcatgtaggatttctttcaaaaacaacacaagggaaaagaaatcagatttgatccttatgggctttcaccttgtcaaattcagtgtcctatactctcatttgatcataccagattatataagatttctttcataaacaacacaaggaaaacaaaatcagatttgatccttatgggctttcaccttgttaaattcagtgtcctatacttcaaaaaaaggtatcttgttgctgcctctagcaaatccttatgcacattctagttcttgaaaatgtcacaaatatacataacttatgatttttttttcaaaagggaaaatgtcaatatcaacatttgctttaggcttgtacgatgctattgtctttatgatcatcacgattcctcgtgtttttaggaaaaataaacacaataaaatgatctagatttacctacaaaatatcagcatacgtatagaaaaataaatgtaaaactggatcatggcatcttgcagttacagaacaaattgggcaatttatcaaacttgggaagccacacataagagagcagatttatatgctttttagtgcatgtacaattcatacaacagaagttaaacaccattatatttgccaatatattcttgagaagttaaatacatttcctttctatggaatcccaacttcgcctaagcatctgtagctagaagtgctcatctcgtccctttcctatgtggtcttcctcaaaaagactcaccagagatggttgcagcggtgattaactttctgaacttatgtcatatcttacaaagattcctctccaacaagctcatttttgccacataattcctcatatttgagctccctttggtgcatctgcttgttgccctcctccaaacctatggctagaggtgccaccatcccaagtaggttgcctcctcttgcatgcacagatgaaaaaaaaaggtctattaagaactcgttgaaatgctgaaataatccaaagagcaatacatatatagaaatccatattttaattacattgatagcacacattgtgccactggttaaagaacacagaaagtgagaatatctgaatctgtgatgttgaacctgatcatcacctaattctctgatatttatactaccaattagattccccttgactgaccagtaggatgagacagccttcctgatccaaagcacaccaatatatcgtcatcagtataatccttcagaataaagctcatagaccacaacaagttcaaaaacactacacttgaatgcaactttaggtttatacagacgttagtgatgcagtactttgcagagtcaactgaatgcaatcaaaagaggaagttacaacttgtaaatataaaggggtggctgttgatgcgaaaaaacacacactggcctgggagatctgcttaactccagtgcatgtcctaaatcttgctcttgggttcaaaggcgtgccagttgatttgatcttgcaatcaacaagaaggaaaaacaagaaagacgaggttaaatccataaacgataaccgatcggctaagggccgatggcatatcgttaatcattgaaccgatgttactggcattagatcgacaatgaagaataaagcaatataaagttaaatctactcgattggctatagatatcaacgatatataatcctcttctcgagatatatttaagccaagtgattgggatagatcgaacagtaagtcgagacaatataaatcacttatgcttaaaggtactttaagatgaagattatatatacgttcatagcatagccgatcaaatagatctaacatgtatcgactaatactctgatatcactctttattaagatattaaaacagacaaaatatatcaaacgacaagtctaatatactttaatgcaataagatcttaatataaaggacagatttagcatatcaagtgaacatgtaagcattaaaggtaactaaatcaggtaagatcggctgaaaccccgatactatatctattgatgatcataagacaagctagatattgcaattatgaatattacttaatagatcaaactcaaccgatgcagcattaagcataaaaataaatacaagatctaaacaggttgatgaaaacctctgaaagatggtagatatgctatataatctagattaacaacgatatctaactctatcagctgccttccaatgatagatgttggccggtttagggttagattatgatattaataaatattatgaagcatatatgataactcaatgatttacataaccaagattagagtgtcataaagatgtaagcactaatcccgagaacacaagtcgtcatgacaagttttacctcttgttgaagatcgaaattgatgcagctcaacccaaaagcaagaactcgtcgaaacaatgaaaatagaaaaaggtggcgatgcgccgaaagtgttattaaactgtcgttagatgtttacatgggatcgggttatatttatacccgagatacatgactggtccttgccgaacacgactcttatctctaacaaactctaagatacgaacaagtcttcacgatagactcttgccgaagcatatgtctaaataaactttttaaaatatcctaattaatagatacaattgtctatccgtgtgcttatctcaatcatggtaatccttgcacagcacgttgatcaatctcggagacgattatataaccaccttaacgagatcagctacatcggctgtcttctgtctgatttagccgatgcagtcttcagccaatgccctcgtagccgatgcgtactctgtttccagaagacaattccctatcaaatccgcttcgatcccgatgccgaatctagttcatggcttaccaaatttgatcgttaacagtggcctggacattgaactgttattttttttcactcacagatctcctcgctgccttttctctggtacagaacaaaaaacaaatttcctcactgggggattccatcgagcacctactacagaacaaacatgatacctaacagagtttatatccacaatttatggaaacaaacatggtacctatcctagttcctggacaggtttgtgtgactatagaagcattagtctcttcacgggttacattttcttgaccttgagcagcctttccatgagtgggaattacaaatagagagcatgtttaagaaaatggatgaagtattatacttgcttgtggtgtcattcgagggcaccagcctcactggggcatccggactggcaacggcggcgatgggtgtagcgacctgggggcatggaagtgaagtgaggaatcatgtgcatatatgtaaatcaaaaacaatatcatttcaatgacaatgtgagaataaaaataaaataaatagaaaatctagattatcacaagtggagcatcacaggtggtatgtaaaataaaaatataattctgttgtttcattcatacgaaaatttcacatgtccatttgccatgatcaataaattcagagagaagtatttcctctcataacagcacgacaatgacacttcgatagaaaaaagaaattcttgtgaaaaaatccacgtttgttttcattgttccattttcttttgaataaccaaacaccatattaatttgcatttaagaaattaacataaaagcctgagtatggtctgatataagatgctttctttaatgtgtaatactcataatataaagcttatgtcaatttaagaactatacattaatgcaagaagaattgttggtatgtgcagacaaataaaggttagaatgtactaatctaagaaaaggaaattaacatagcactctttgaaatttgaaacaatagggatatgtctcaatttcttagattatacatagttggttagatgttgctctgaagaaaaataagcatatttaatcataaataaacataatagaccatgcagttcttattcaatagaacatatgcatcatgggttaatcccatctctgtagaagcaggtcatcaaggcatataaatacgaattaacattcattgacaaacgtaactaaactctgattttgcttggtgcctatgctttcttaccctgcaatgccatgatgtccctcttatctaccttgacaacgacaaaatccatttgttactccataaacaaaaataataaacaagatcatgataaaaaggaagatgatcaccaataaaccatcattgtaggcaatacatatgtcaattgtcaagtcagtgtgtagtaccatcacagttttagtcaattagcataacttccagtaaacagatgaacagaaattgtgcgacagcaaggtagtagtaaggtggctgctgctcctcgctggagtagccctgataccccgaaggagaatggtttggcaacaagaatctgaatcaatcagggagtcaagcaaaaacctgggtagcctcgtcatgggtaggatagccaccgccaggatcaccattgtatataaagatcagaaagttacctctatattggcctttgttagtgtcctcttctctcgaaagtaatgaaaaaatacataaagattttgttcatttaaattaactaataaaatgtgcattcaagggaaaacctattttctaaatatcatgccagcacgcgcatctacattcaaaggaaagcaacctaagccattgatcctgttcacttgtaaaatcttgacaaatagatattttaaatgaccatcagaatcatgacaagagctagctatatcgtttgaagatatattattttcgtaccaactatatcattttatgaattgggtctggatttttgaatttatcctagtgatcgaattgaaattttctgttttttgtgtgcatttacattcttaaattgattgttcagggtactgatttgttgctacttgattagcccgcaaatcttattgttttggataccatcaagtggctagaggctggagagctaccttaagacacaagaagtgtcgataatcatcatttctcacaacagggcttttctgaatttgtgtgctctgtgatgactgatgaagcaatctgaaattctgaatgtgttcgctgtctgtactcagaaattcaaagaatgtgtattgagtttgtagtgtatttgtgcatttttgccaaaatctgagaatgtctacaactggttcattgatcaaaacgtgagcataggtatctctgattttttttgtcacaacctgaccatgtaattactgccatgattctgcaaaatgtgcaaatacattattcatcactaatttaatatagtcctaatggctgtgacttatctaaactcatttttttcagtgattgattctatatatggactgcacatcatagccataggtacggcaccactggtataatactccctccgtttcaccataagtcattctagcatttcccacattcatattgatggtaaagaatatagacatatacatctatttagatttattagcattaatatgaatgtgggaaatgctagaatgacttaaattgtgaaatggagggagtagaacataaggaggcgattggaggaaagacttaaaagaacaccatatatagcaggatgaacaacaggaagatctttagaagttatcaacgaaacatagccataggttcgctggaatcaaagaatttttttttacctccacgagacgaccagttagctaggataccgccaccttctccttctcttgatcctcattgacttgcataaagtatgtacactagtaacatcgctactcatttctatttctattttctccagttactctctgcccctatctgtagctttcccatcaacattacaaatgtgaaatgtgatgccctgtacatggccaaggtgaattatactctcagaaatctttggtgcctagctaaagaacaaactccagttttcagtttttcaatcaattcccctcccccgtcccaccccctctctctctctgtgttaaaataaaattcattgccgtttctgatcaaatacaaaagaaaggacaaataagaagcggaaggagcaaatcaagaagacgatggacgtgacctggtggcggtgaatcggcgacggcgctagggatggatcggcacggggcagatggggcgacggtgaatgctcgacgacgagcttagggtcggcggcggcgccaatctggcgaggctggaggtcggatatggccgaactggtggaagcgtggacgacaaatgacgcggggcaagtatggcggattggagcggccatgctgcggggcgaagtcggtggcggaggggacaggggcgccgggcgcaacgatgtgcgagggaacagaggaggagcgacggggctgcagcggcttgtagcggccgcaccatggggcgaagtcagcggtggagggggacggggggcgcagcgacgtgcggaggatggcatgcgacggcggcggggttacaaattgcgtgcgtgcttttctgccagtgaaccccgcagcggcttcggcgggcgcgcgcccggaagtcggcgcggaaccccgtgcgtgcaaagaggcggcgaggtaaggcgcgcgactctccaagaagcggcgagctgctttcgcatgaagccgtctgcggcgggcttgccagccgagaaacttttttcgtttttttttcgcttggacgaaccctaacccgctggtaaaccttgtagaacg

SEQ ID NO: 68908 - DNA, 680 bp, Oryza sativa
tgtgagtgcaagcccccccgtcgagcgtggcgacggtcccctgaggtatctagaaatccagatcctcactgtctccgccatcatcggcgggggccttgttcttggcctcctctcaccggtcgccggtcgaggtcgcgggggctttgccctcccgtcgaccctgccgcttctcctcatcagcctttcgaaaccactcggccaaattcctgaccgagcggcagtcggcgagactgtggcggtaggtgttgtgtaccgaacacacccaagttagtgttttaattcttaaaacctgcctaacaactaaaatgtggaatggttggcctgggttggcttgggacgagctgggacctagggtcgggttgtcagttcggtctgaatcatcgtaggccttgggttaaggcaggttcgtgagggttcacggccttgattaaataacactgtgtaactctaggatcgtctttataaaatggatttgggcaactaagtgacttttaaatgctgttttctgcaaaacttaacccctatattattaccccttgtacccccttgcattaatcatgcatctgccggtgtggcttgctgagtactgtggttgtactcattcttgctcaatcttccccccccccttcataagagaagctttggagaagaagtcttaggtggagtcctggcttataccc

SEQ ID NO: 68909 - DNA, 4436 bp, Oryza sativa
caggacacccccggactaaccggtcccataaccctggtctgttcagcctcctccaaaaaagtaaaggatcaaagccactaagtgcaatctcaacgcatatgctctagtgtagcctattgacacctcattgccaagttgccacccatcttatctttagtacaacaaactagaaaacaaattaatcaaacatttcgatcggcgataaaacctcgatagacaaatagactagctttaccgtcttccgtcattcgccttacactgtcaaattttaatccatggtgatcatccttgacatactcgtcatgtggtcctaattcaaattatctcacgcaaataaaatggttagtgtacaattagtgtttgtcattaattaccaaaatcaacgatcggggcctagatactttaggaggcgacaacctaaaaggtttggggatttatcctatcccttgacctaattgatgcttttatatttgttggtgtgtgttaatgggcctaggcttgcacattgcatcgccgctaggctaagggttactgtcacacacctcatggtctacatatcgactacaatgaccttgcaacactggtgagtttcggtgcacatccatattaattttgatatgcctaatattggccaactgtcggttgttttttatgcggttatcatgtactgcttttaagttgcaaggggttcaagacattgagtcatttgcaattttaggttgagacattgagtcattgattcatttgcttttaagtcgagacattgagtcatttgcttttaagttgcaaggggttcaagacatctcaaggcaaagggctcgggggctactgtggattacataggacccagtatcatcataatgggccttgcaatatgggccaacaggaggtaaaccaggtagtagacccttgttgtcggttgtacacaaccaacttgtaactccagatatgggaagataagtggtaagatataattctatctatcccaggtaacatgtggagagagataacaaacgattcagttaagtttggtaagccagatcccttaaaatttggctctccatgtctgtctaaggggaatagaacacccctcgtgaggatagagataagcaccatgctaaaacacatgtgtgtgcttttaagagaaaatttaagaaataccattgacaaacaccaaattccaagaaatatcatcgacgagcgcgagttccataaaatgacatcgtacaagcgatgttgttctagaaataccatcatcgttaaggttactgatggaaccctaacaacgatggcatttctaggataaatagcttgtacaatgacattatatggaactcacacttggcgatgttatttcttggaatagagcgcttgtcaatgatattttttggatttttctctacttttaaataacaaaacatttcattgatttatgaaaaaaaatctagcccccccctctatatatacacactagaaaaaaaaatgtccgtgcgttgcaatgggtgaagactattttaatcttattattattattattatacagtttagttaaggtgaaattcactgcgggaattcgcttggatatatctctatattttttttagaaaatcatgagttgcagttaggaatccgattgtctcaagttaatatgcgagttttttaaaagagtttcttatacatctccttttatatttcccaaagcgaacaaacttaaaaatcaactcaaatacggagaaatgatcggaacgattgaggaaagaaagagaatggcggcccctttcctttcgcactcatatatggatgacgtaccaaagtaccagtaaaaacatcttcaactttataataagagataatatcaaccaggaatacaaaactaaaaagggaaaaaggaaagaaatgaaattgaaaaaaaatcctatacagattgacaaggtaaagcattgactactccaaacaaaaagaaacatggattaagtctataaaaatattcacaaaacaacaccttttaagagatcatcatttattttccggtgatcgaaattgacttggacgtgtattaaagtggggataggcttgactactcctcaattttcatcaatttccatttccgttagtatgttttttaaactgaaaatcagctcattttgctaaaaactatatatataaattactttaaaaatcaaataaatttatttttaattttttcaataattaatacctgactaatcatatgctaattatgtttatcattttacgtgtggctaatcaggattttcgatccctttagaacgtcaccataaggtcagtagccttagaaaacaaaaggatgtatcaaatccatacaaacaaaacatatatatatttacagagaatttaccgtgaaacaactttgtcctcaaacagatgccagttgccacccaccgaaagatacctgtacgtcgtatgtactactggtaaaatggcacctctctctctaaaaaaaggaaaaagaaaagataaagaacgaaagagatggaaagacggtaaagccgaggaagagacgacggaagagaggcatatgggtggtggacgtatgaaacgaaatcgtcgcgtaaggcgtagcgaccacaaggcgcgctatccacacttccacatggaccacaggcggcccaccctgccctgccaggtgccaaaaccaaccttcggcgttgcggcccaaacgttcgttttccttcgccagttcagctcgccatttcgccatggcccccgccgccgcatcatcgtccgcgctgctccccgcggggaccttctccaccgcccgccccgtcgcgggccggcccgccggccagcgccttcccacgagggtagccgccgcgagcaggacgacgacggcgcgttctcctgccgcctgcctctccgtcgggggcaggaggcggggagcggaggccgtccgcgcgtccgcggggggagcgccggccgcgtccctcccggcggcgctgctgttcgactgcgacggcgtgctggtggacacggagaaggacggccaccgcattccttcaacgagacgtttgccgaggtccggttccttcagccccggtctcgctaattttggtttgatgacgcgtttggcgattgctccgcaggtctaaagtgttggtgtcgcttatgtttggtaattactggaatcgacgtcttgttgttcacggattaatttgtttctgcggagtaacgaacctaaatcatgtgaaaatgttgagtagatgatcacctagtactagtaatattacttcaactcggatcattggaatgcctaattcaaattcattgattgcctaactgcactgcaatttacatttaggggctgtttgcttacctgcagcgcaatatacatttaggggttctttgggagaatgatttttatctctcgataagtagtgatcaattttaaaattgagaaattctacttctacaagttgtaacaaaaaggaaaaatcaagctgaaactattatacgtggattcacagttatatatgttacaacttgtaaaagttgaatttgattttcatgtttgtatagtgatatatcacatattaatatacattcaagaaatgaggggacatcgacacaaacttttccctgttgtttatccgattaccatattttaataaataaagtcaactatgttcaattgttctgtttatttcattggccatctctgtcgctaagtaaccccatttttctagcacacttccgaaatactcagtctcaccaaaccttgccatagctgcagtgagcggcttcttcaccacaagtgtgatttacctgatatattggtagaaataggttggttagtgtggccatcaactatggagcatatccagtgaaaacgggctgtgttgaagaaggtacattgtaatttcttccacctggacacctagttcaagccgttgttaatcttccttaggtggaaatgaaagagcgacctgggatacctgtacttacaatagaaaactgtaatacacttttcaactgcaactattgcgttaacacaaaaaacaataggcagttattaaaccttttttttcttctttatgatgaaccgtggatgaaaaacaactgtcaactgtaatacatatgattttatatcatttaaagggtacctactgactgaaatatcaaactgcgtgttttgttgtttacagagggaattaggtgtgagctgggatgttgagctatatggagaattgctcaagataggtggcggaaaggaaaggttaatcaacactttgctgctttctttcatttgttggcctgccaaaatcctagccattcatttgcattcttcaatacaaacaggcgtttcctcgaaacatgttttgaaaatgtagtttgtgcccatataggttatatctatactcctttaaaagaccccaatagtggtggtgagtggtgaatct

SEQ ID NO: 68910 - DNA, 639 bp, Oryza sativa
ccatctttgcactgccatcatcctcaaaacgcgctaccgccaccgcctctatcaccttctcacccgcttcatcaccattgcatccgccggcttgactgctagcccccggctagtcagccactgctctctgtcgctgctccaacactcctgagcacaccgccacccacgtcgtcagctccacctgctctgatcacgccatcgatgccagcgctacccttttcatcccctccagcaccatcattcgctaataccccgagggcaaattgaagatatcataatagcaaaagatatcttatgtagcatatgaaaataatttgcattaaaaacagcaacaaaaaaaacctattttatatggcatatgataagttatattttaaaaatataattaaaaaaacttgaaacttatatacgaatcttaagaatttgaatgttgtatacggaggccaactaaaaacttttatacttttttaaacctcgaatgagataaattaattggtacctttacgtccatcagagtattttagatattttaaaaaaagtatccaacccaatgagcaattaatacagttaccgatgtattatagaaatagataatgtcaatgacaaatcgttgagtgatgataaacttaatcgcataga

SEQ ID NO: 68911 - DNA, 645 bp, Oryza sativa
taatagtgagtcataagttatcccgatgatgtgctaatgtttctaagcagggctaagcaattatacctaatatctagctgaaccaatatataaagcccaactagtcaagttataataacccaaggtatcaaggaataaagtaatcaagaacaaaagggctataacaatgaataggttaattccacccaatgacattcgaaaataaatgcaatagttgaatagaaacaatagctttaaacgggatcaacattctcaaagggttgtttgggatctgtgtgcttgccttgctggccttggaactcttcaaactcttctccggcgaaaacggactctccggaaacgacgaaatctaagcagaaaagagcaaaatcaccaaaacagcacataaacaagcatgaacggtacatgtggatatttttaatatgtagatctcaattttagaaaaatttacagacttgaaccaactaaatccgagctaagatgaattagttatgaatttttgaagatttaatcggattaaaacacttatattgattttaattgaattatgacgcaataatgaattatttttgaaaaggaaaaagggatttattgcgtcagcgggctagggtttcggtggaccgggcgcacggcggcggttcacgc

SEQ ID NO: 68912 - DNA, 2055 bp, Oryza sativa
tcccccaaatagtgagataggtggacttttatcccatcccccaaccagaagccatcaaacaaggaaaatttattttaaagtgagatacaaaatgatgaaaaatatgattgaattatttacagtggatataattttattttaatttttgaggttttaaagtctttttttaattcccgttgcaacgcacgggcattcagctagttctgtatgaaatctgtagttatcaacctgaaactgtaagaaaaaaaatatgctgctccgttactgtgtcaatttacatatttacacttagtcactactgtgaacacataaatgataaaacaatagtgttaaatgcacaagaaaaaaattaagattttgcaatccatctccttaattatgttgtatacatctaaacagtttacgctttccactaattgttcacataacagatttgcaatttattattgattctgactattatcttgactggtaggggaaacattaaaatgcattttaccactggcatttactaaggatattaaacttcggtaatcagtgcaagaacttcactgtcctttgctaagtctattggcttatgttgatatgaaaggttaacaaatattgtctctggggcagggacatcaaaccatttgtttgttctaacacaaagaacaacatggactgttccgtttgtgtataaaggcatcataagtgtatgctttttcacggaaactaatagttattacctaaagaaaattcaaacaatctaattatcgccaagagcaatatcaagatgtccagggtgaaggatcatcaaatcgaattttgcttatccaattgaaactaaggacctaatcatcagcagtgtagagctgattatttagcattggaacttaatgatttaattgtccattagtgtcagatgttagaacatgctttttggcaatggtgatactaaaagagctacactaagaacaatgatttatagttttatgttggttccttttatgttttcctgtaaataaaattgaattttctggttgaatttaactctagcacctatttcaggatgacagcgtatttcagcaaaatggggtggccagctaaagcaccaaagactgacgacgaaagaaaggagtttattgcttcgctgcacaagaggaaaacagaattattcatggctctgattgagaagaagttgcttcccctccgtccaggtgttcaaaggtcatatattttacatgaatttggactttagcaacttaatgcacttcaaaagttctaacacttcgatatcctgctttgctactttaatacaagtcagttattatgtcttgtggatagccattagcaattgttcatctttaactctcatttgcattctgcaacatttcattattcttttgctctttctcaaactatgtataaactgcagttatattctagttgtagccaagctatttttctttgctggaaaactaaatgcatcttaattaatattgcttcttgtacttacaattataacatgaaatcatgacgataattgaaacaagctttacagaagtaatatcatgaacttcactgttttactttctgttgaggaagtctgcactacatgcattaggaagacataacaatccaatcccactatggaatgttgaatttactaacttcggaatatgttgaagtaaattagtatggggtaagttacctagatgttttaattacaatttacaggttaatagatgaagccctaggaaaaggagtgaaagttgcagtatgcagtacttcaaatgagaaagctgtgagtaacacaatatttccaccttaaatgtacttttatgaagttaattgttaggattggtaataacaattgttttcattttttatgaaatctttcttctgattttttcataaggaaatactccaatagtttcttataaaaacttaatatgtactatttttcacactttttaaatagtagtacatgttgatagtagctgtgaacttgtatgccagatagctcacatatttatgcttgactgaatgcaggtttcggcaatagtttcatgt

SEQ ID NO: 68913 - DNA, 7154 bp, Oryza sativa
attggagtgcgtcggatgtcgagcacctacttgatggtcggttgatgatagggcgctggcacaatggctgcgtgttgaaggagtgcggttggtggtagcttctatgtccagtagaagaatcgatacgggggtacaggaagattacggggcgaaagcctagcctctctaggctagcaacggtgacgcctggggtgccgttttcctcttggggcgttgttgggtgatctctcatgtcccctaatggattcctctaagtgaaaaccacgtcttgaatcccaggacgagcgacgacggtattctcagtgttgtacgcttcctgaaggcgtcatttagaagattcttttccttcgggatgtcgttttcatgtcttttagtagcgggcttctagttgtagatacgtgatgtggttgtaattttcttttcctgactatagccttccaaggctatagagttgtatttttttttctgttctattaatatgaaacgttgcactatcatgtacgtgttgtttaaagaaaagaattttgtagaattgaaactcctggtatctcatgtcttgtaacttaaaatcagctggggaggtgcctttgtatggcgtgattttttttttgttgaagaaattgcttctgaaagagagagggtatttattggacttcttataggagaaaaaatcactgcatggattgtaggagtttttttagctgtcgcttatatagctataagatatgtaaacctaaaaacaaaaaataattttacaacaaggttttacattataattctccatgattttgtcaaatcctattcttccaatcgaaagagtgtataacaatagaatccggtgctcataaatattacatgtacgtgggtgtaattagtataaatttatatacgtgatgctattattagtattagtgagtaatctatgccactggtctttgtttgacagcgtgttaagatggtgtactgtgtatatttttaatggtgtgtgtatgtatatattctgtgtaatagaaaaaaaaactctgtagtcctaaatcctaatacttggatcgaaatgatcaaacgaaaaaaatgtgggataagatttaaatcctacataaaatccttcattctctaaaatctatcaaaaaaataatcccccctctcccccgttagacctaagcatatatgagatgtgaagaacatcactcttctaatcaagcataatctcaaagtttaattatcaagtccttgttgtagaaaaaaaagtgttatgtttgttatgttgactatacgattgctacgcactgaaaatacacattagtgcactaatcgtgatcttatctcatgtttaccttgcagttgtagtgcatcaagatgttttatattttttatgctcgcacacattttttttaactttctacaccataagttttaaaaactactattaactcgaagttttaatattgaccatgccatccttgataataggggtggacaaaataaatcgagaaacccaagaaaacaataaaacaagatcgaatatgaaaaacttgaattcttagttgtcgattctttggttagtggtagcttcgtgaagatcaattttgccatagtctttttgctcaggtacctaaactactcaatctatctaaactcaccagtttcggcgatccttcgatatcactaatctagcattccaccaactcaaatctcttacttctaaccctagccgcctaacggcagtggctaccaacccatcagatctgctagtcacatcattgctccacttcaccatcttgtcatgtcttcctccacgcttctgcttgcacttatctctatgtcaagccgtcacattttccagactccacactgccaccttgtgcaactatcaacaccattgcctattgccgcaccacgctatctgtggctctatactatcatccgcgttatttcctgtgcataaatttagtttacttagttagacctcggttaaccaaacagctgatctacacatttttttgcaacaaagattggtttttctaattttaaaaaccaaaatttaaaatactaaaaaatattaatcacgcgcccatccataatttgtagctggcagaataatattattgtgtaagtttatagtgttgtggtaaataaagacttgtcattgtcacccatataaacaatgttaccatagagcacttattatttctagaatttttagttgaaaactaataataaggtttaaagattaaaaagaaatccccaagagttgaacaaatttgccctcttcatttttcctcgacggcccagctccctcgaccaaacagaccagtagggttttaggaggcaacacgccgccctgcgccgccgccgccgccgccgccaccgccaccgccaccgccagattctcctaagcggcgatggccatggcacggcgttccgcctcccgtctcctctcctcgttccgccccttctcgctcctcctccaaccgctcgatgacgccccttcgctctcggccgcggcggcagcagcgtcggcccgccgggggatgtcttcggcgtcggcgctgcgggcgcgggacgagaaggaggtggcgaggtggcgcgagtcgatggaccggatgcggaatatcggaatctccgcgcacatcgactccgggaagacgacgctgacggagcgcgtcctgtactacaccggccggatccacgagatccatgaggtgcgtggccgcgacggcgtgggcgcaaagatggactccatggacctcgagcgcgagaagggcatcaccatccagtccgctgcaacctactgcacctggaatggataccaggtccatcaaatttctgcccgtctcacttatctttctattcgattcgtatacatccgattgcctgctagatcaccatgttttggctatcgaaaggaaactttcaaatcgttcactagtgtgcttattactctctagcaaatttataacaaatagtattctcttgattgtttactcatgtgcttccttgtttagttgctgattctaattcctttttgataatcatatgctagtgaaagcattgttaaactaaatatgctggatttgactaatatgtggtgtatagtttatattgaagcaataattagacaatttatttgcgtttgaaataatataatagtaatatactataatttatgtttttaacttgttattgtctcccaatgtattagattttgtcttcatatccattttctgttagttccaggagtattttatggcaccttattcatttatcttccactctatgctgaacttttgtttgatattgctttaatatcttgataaattactaccatgccactatgtataaaaaatacttgaaaaggtacatgtataatgctctttggatcagtcttggattgctttttaggttttggtataagtatttgaaagtgaaacctcaagatacaattttatgcaggttaatatcatcgatactccaggtcatgtggatttcactattgaggttgaaagagcactccgtgttcttgatggtgctatacttgtgctatgtagtgttggtggtgtacaaagtcaatcaattactgtcgatcggcaaatgagaagatatgaaattccaagggttgcatttatcaacaagttggatcgcatgggagctgatccatggaaagttctcaaccaggtaaccatgaactctttatcctatgttttgctgacaaatgcttccattctggtgatacagaatttctcaagaacattgatacatcaatatgactagtacaacgaaaaattaagctgaatgttttttatttgatttactgggctgtcaaatgagtgatgatgggctgttctatcagattgtatcaggcgctgaaactcccgatacacagctgatggtatgtgagaactagggttctgaaaccagtttggctggaattaccagcctccatccagtaactggctggtacacgcccgatacctgattttacctaaaattcaaatccaaaatttggacttttccccagtaacctcaaactggtagaataattctaaatttaatttcatatccttctgtccaatagttgcccttataactgttccttggctctggaccagttactgggcagtaaacgccgttaattttaactattgtaaccctgaccagaactatcagacagatacaatggttcggaggagtttcagtgcctcatagtccatccatcttgatgcattctgatgccatccttagaatttttatgatttggaaaaaccattgtcctcggtgaacagaagtcaatcttgcattccattccatgtctgcagtgtgcattagttgatctgtacaatgctgcagccgtcaaccacacatcaacggaagaaatttgtctaaattactgtggtgaagcaggactggccaaaaatcatatgagggccaagaacacattacgtagaactttatcaaaggaggccagcatagcataataaaaaagtacaatttggtctttgtttaacaacctatcagtagatggaaggacaaggacaaagaccctctttggagtcaactagaccgctgccacttctctttcgttaccttttactgcaaaaaatagttgatacttgataacagaagtgatgttattgagttgtatttacttgtagctttgccttcttgttttgattttatttgctgatattattgaagatggtaatggagcaacctgtcggcctttactttctctcctgtataaccttattagtgtctagcacttgttttttagcacctataagatgctacatggaccatgattacactaacagtacagttctcgtggtgaaactactgcaaagcaccatttaccttattccatggatttttgtccctgatgttttgttccatcttattcctagttcctgtaattgatttgtttttggtcttaacattccttttatttctgatgaggcatttcacagtgatatgttgctatttccatagctgatagctttcattttctttctttcttttcttttttgctattgaaggcacgttccaaacttcggcaccacaatgcagctgtacaggtgccgataggattagaagaagagtttgaaggcctggtggatcttgtggagttgaaggcttataagttcgagggtggtagtgggtgcgtccctgttctttacaagttcttcaccctgaaggttatgtgcatttggatatttcaataacatacctagcctcatgtttaatgtgcagccagaatgttgttgcatctgatgttccatccaacatgcaagacttagtcatggagaagcggcgtgaacttattgaagttgtttctgaagtagatgatcagcttgctgaagcttttctcaatgatgaaccaatacaagctaatcaactcaaggttcgttaatcatacttcaattttttcgtatattataatcttactctgccatttaatattcatggaattattcatattaaacaatatttaaatgcctgtgtattgcaatggatctcaaatgcataatactataaaatgtaaactagaaataaatcgaagttccttatatagaaaaccattgaagaccaatcagttctccactctccaggctgcatccagatgtccaatattttactaaatcgaaaagaccataaaagaaccattatgcagaaatttttttatttaagtttatgccctcccattcatatttacatgacatttaggccactgcacaggaagtaaggtatcaactcatatgatcacactaccattgctaatttcttcaacagttcattgtgcatggttaaaagtcttttggaatagattagcaatacaccgcagagtgaaaagaggacctccccagatggcatgcatattgtctcaatagtcaatggaagtccgtaaagtatttaacatgagtaagggtaacagggcatgctctcaagcattctccttgaaaatgtagaacctcatattgttaagcaaaagaaaaaatacacttggcaatactttattgctgatctgaaggggtacaaaattcgcatcctaccatcaagccctagagagaatcatgtgaccagtcacatgcatatacacggtgatgtacccaccccacgggtcacacacatatggatatactatatttcgaggtgaggccactgtcattggttcaaacatttgtaggagtaaatatatactatgtccgttccaaaatatataagggattttggcgatgcatatatttcgggatggaggtagtaatagtatataagaagaaaattcatctgaaaagctgttccagcttaggggtgaatcatgacaccaatgatagacgaaatctaagtatttaaattcagtcttcaatcatgttgaaaacttgttattgttccgggcggagcctgacgttggtcaggcctagagctgagcaatgtgcccttggccagccatgaaaaatcgatcaactatgtgataaaacatatttagatactttgtaaccagatttccatgttgaacttttcaacattagtgatgatatgatattgtctagtaaatttactgacatggatttgtagaatatcgattactttatgatttagtcattaattaacttttgtgctacttttgtcttgatatcatatttcattttgaccaggcagctattcgaagagcaacagtagcacgcaagtttataccagtttacatgggaagtgcattcaaaaataaggtttttttctgttgttcctcatattttttatttaactattgttcatcctgccattgaaaatggaatattgtaataccttttgtagtaatagaagtcggttcttaagctgagttgaattcctaatgatgtttaaacataatataatagtgtgtacagcttcatattgcccagtgattttccaatgtaatagcaatcatgggaatgggaaaactaacaactgtgagattttctttaaattagttgctggatgtttcagaatttgcatgagcttacattctgactggtttcgcagggtgtccagccgcttcttgatggtgtgcttgactatttaccttgtccaatggaagttgaaagctacgcacttgatcaaaacaaatcagaagagaaggtagcacaaaatcaagatatatttaataggcaactgtggtgcaa

SEQ ID NO: 68914 - DNA, 12129 bp, Oryza sativa
attcctgcagcccatttattatagtctctctcaaaacatatctcagtagctattcttttctatttccattgcatttaaaggtgggtcgcatggcaatttaaactcatctttctcttgatttagtactcttcttaatccttgtgcccactcaaaatatgccttacattttgaaactgagggattacagttgccattatttgtaacaattaagttattcttttacacttaaagttacttttagctttcgcagtgaattattcttgtctcgatgtcaggtcttattggctggaactcctgctgagccacttgtggcattagcatttaagctggaggaaggtcggtttggtcaattgacatatctaaggtatctgacaactacagactaacctttttgcagtatcatgcgctttactctgaagtagagtacattgctttgactttatttctgaactaacctttccttcatgttgttgtcgttctagaatctatgatggggttataaggaagggtgatttcatttacaatgtgaatacagggaagaagattaaggtaagatttaattcttagctcaagcaaggcagttgaagcagttggttcaaattgtcgttagcagggatttttaataataaatcataccactatgtccaattttatttaggatctctaagcaactatagattgaatatgttgtgaagacaacaagagggatttattgtgatagaagagtaccaattactggtttaattatgtgccagagcatttttttctttataagagcaaagaatgcacacaatctattatagctatgattactatggaggtgactagcatagttctttgtgatgaatttcaaacaatataacagtatgttctgtttggccaactcaaatatctttttttttttttgttgggggggggtggggttgggtgggggttgacatggagaagaatggagttttatacctattttcaagtttgaattcctacgtattaggatgtctttttcagctatctaaacctaaaaaaatgatttggacatttatgtggtgcttatttagacattaatagcttaattggtgcttgtttgagttcaaatttgttgccttatgctttaaacttatgaacttgaaaatttgtttttacctttccaatgttggaatttaactttcgacttaatcttctagcctgctatgtaaaatatttacttgttcttttatattttattttataacaatttaaaactaatatatgaatgtttaaagttattgcttgtttttggtgattttgttgaaacattaatgctgatattttttaattaaattatatttttaatattgaaagcttgtaatttgtttgaaatgttcatggtaaataaaattttaaatatccattattgaaaattacctatttaggaaaattcttttttttttacttagaaatgtgagcatttatgttgattctagcttttctataaccctaatgttttatataactgtgtgatatgcatggcatttcaaataatatgaaatcattggtaaaacgtagcaattatgccaggaatacattagatgctcagttagagttaaaacttgtgccattatgtttttctaggttcctcgcttggtaaggatgcactccaatgagatggaggtaagttgcaccagatgttgtaaccaaaataattactaagtattagtttgatctgatcattggagttgattgtttcctttataagcaaatccacccctaggctaatatcttctttattctgtggtcaatataggatattcaagaagcacatgctggtcaaattgttgctgtctttggtgttgattgtgcgtcaggtaaatttttgagtgaagtgtagggccacaggctattcaagaagtacctctgtccactatactaccatgtgctcttcgattttctgttgacattttcggatttgttctgtgttggtctgattatttgttctcgcatcaataggtgatacatttacagatggatcagtgaaatataccatgacttccatgaatgtccctgaacctgtgatgtccttggctgtctcccctatatctaaagattctggaggacaagtatctacttttctattttcaagaatgctatattaactttaataccatacatgtgacaaataattaattaaaataacatttcagttttcaaaggctctgaatcgtttccagaaagaggatcctactttccgtgtaggtctggatccagaaagtggagaggtttgttttgttatctgttgtatttttctaaatctatcatttgtgaactttaaagtgtaaattttgatcgcagacaattatttctgggatgggtgagctgcatttggatatctatgttgaacgcatcaggagagagtacaaggtaatgtatacttaggtcaatggcatgattcgttcccctggctatatgtgcaatgcaatttaggattgatggatgtttattgtactaaaagcttgtctgtgtaaggctatattaccagtgtttgatgaaatcctccttttacagccaaactagtccattcttttgtgagataatatgtcaatatcatgcctaactggccgtggatttgccagttaaggaagcacatatcatgatatgccaattaaggaggtagataatctctgaccaacacaataggaagaatatgtaaaacagccatagttatcctgaccaatcacaaaagatcatttgctacctgtttggtgtgtttttgtgtgggggaatcatatagctacccagcaaacctattctcaaaatcaagagatctcagagctggatgttacattcaattgttaataatactatcgtattatttttggtttggtttatccctgtattgtcctagacatgaagttgcgttaatggttttattgaccttttccaatttttgaggtgctattttgattaataatttccaaacttaagtgcactgcaatacatggttgttaaggcggtaaggcgacctgaggcgacccacccacgccttaccgctatagcggtaaagcgctaaggcatggctactccttaatctacgtgattagcagcgattagaagagggagataaagaaaattagcctagcaggccagcccacaaaagctcattaaccttcataccatcccatggtgaaggaaacaaccctaatgcctgcagcaggtgtgtctctcctctcacagcgctgcctccaatgtcgcttcttcctcacgtggtcacgcctgtacatctcttcttcctcgtgctagctctgctctatatgtgctcctttctcccctgattcagaacgaatccaggtatgcttctatttgtatgtgccccttcccttgatagatctgacactgctcccttgagtcaaaatgaatctggcacaggagagagaggaagagagtggaaaccagagctgaggagtaagatggcaatgacatggagcagagaacagggaaaagggtatagttggtgctgccttcacctctctctttctctctctctgggttatggccttaagcccttaaggcggagggacaccttaacccctcggcacgccctagcgctatagggacgccatagcgacgctatagcaacaccttaacaaccatgctacaatattaatgaaactatagtctttcatgtggtgtatctagactatttacatactgttggtgaaattttaaaattgattacatggactacaaatcctttgagaaagaacagagggagcatttgaggtcccgtttgatttagattattgagtggattattgctgtggattatctacttgattatagggacaaattacatattgtaagcaataaacttaacagatatcttaaaacaagtggtctaagtagtacagcagaagaaagttttttgagaaaacatattttccgaagcttggagcaaataacccatttcaataatccggtgaataatctgaaaagatcagtagttggtccgcattttggttcacattaattattggcctgaattcttgataccgatgaggttccttgctcagatggccaatagggaactggcagtaggttaaatatacaaaatatattttacactagtttggtgaaatatcatggtgtttggtttgagttaacagatggaaagtggggcatcgttatccaatcctctttagtttaagtaatggtgcgagatggtaacatgaccaagccatccctcatggtgacaaggtaagaaactgaaaaactgggctatcctgccaaagctgtagggtgacctcaatatggaccaaatcatcttaggatgggttcactcatatgttcatttatctttgtgatactgtggagtgagcactaaatagcagaactcagataaatttctctgcactgcctgatgcctgattgagccactgttatatgattgtatgcctactgtttttatcaattgaaccacatccctatgttgaaagttaagatcatcttaaatcctgtatggctactgaaactttcaacaaatctaagtctccttctacatgtgtaggttgatgcaaaggtcggaaaacctcgtgtgaacttcagggaaactatcactcagcgtgctgaatttgattacttacacaaaaagcaatctggtggtcaaggtcaatatggacgagtttgcgggtgagctcttataaaccttgttactaataacaatttaattctcggtttaatttgtgggtgcatcttcaacttattcgcttcaaaaatattaactggcttctaatacatatataggttataatgttatatagggagatatgtatttcataaacatgataatttggaaatgtttagtgagaaaatctacttcttaccacttcatttgataaacactctctagctgagcagtttaccattcctatgattcccacttgtatgatgagtattgcatggtgaaaacagtacacatgaagtgcaccatggttggagcactgcacctaggcaatcaattacactgagcaaatgtcaaatgcattgcaaatccatctagattgtagtgttattattgccggattctgaaaaacagtaaaaaaaaatcattttagctgtcagctgcttatcgtagacggtatatttgatcaatggtttagtagtcacttaatttgattggaaggagtggacttaaattcataatttagcagtcacacttcaccaaaactgttgcaatgcccatatgtcacttatatttgattggaaggagtaaaatgtgtttttacttctgttagccattgttttgctgtcttgtatcatttggctgcaacttgtaaccatctacacatggttcatctgcacctggggttctttcaattgggctcctaggcaatccttttttctcatggtaatactcaatactggtttagttgcacatggccttggtttaatcttctatccatatgtgcttcattttcctttgagcacgtgactctttggttttattttattgagtgtttgaaatagcatctccgattttggttctgaccatgttcagtgcattgacttatatatgcttttattatttctttcattttctgctatgggtccatctttggtatcaatttctttatttttcaattcgtgcatgaaatcaaaagcctggattgggcatttcatatttgcgcataaccatataataggtgttagttgttccttatcatattaggcacttgatgatgccgcagtggacaaaatacaaatgcttgtgcccctagagttaattaaattggtgatggtacttcctttccttgcattacatgtttattttgttggtcataaatactaaaattttactttctctggaagggtatcatgatgtatgtgtaaaatacatcttacaaaagctatgtgcgtgtatcttgaatacactggtgcacgaaagaaggtttagatccgccaaactccgttagaaaatcaaaatcttctggtttactttagtccttttgcttatgccatgctatcctaagttcctaacagttgttatctggatacatttatcgattattctactgaagtttgttggagctatcaattgtcttcacaataagcaacaatatgcaggtacattgagcctcttccatcagaatctgatggtaaatttgagtttgataacatgatcattggacaagcaattccttcaaacttcataccagcaattgagaagggttttaaggaagcttgcaattcgtgagtccatgtctcccatcacgtgttaaaagtctattttgtttgcagagtgataacttgtgtttgtgtttccattctatgcactgcagtggttcgttgatagggcatcctgtggaaaatattcgaattgtgctgactgatggtgcttcacatgcagtggattccagcgaacttgcttttaagttagcttctatctatgcttttagacaggtgagacttgttatatttgtacaatcagcattctttcaagtaaacagtgacattagagtgatgaaaatacaaatcttataaattgatttgctccttttgtctctccttttgccagtgttatgctgctgctagacctgtaatattggaaccagtgatgaaagtggaactaaaagttcctacagagttccagggcacggtaaccggtgacatgaacaagtgagtgtttgatcgtaactttgcttctactgaaatgtatggttacacactcttaatcagtttcatgtgaagtgttccttttgggttcaagttaatattttcctgccattcactggaaagacagtctgttatagtgccattagctgtgatgctggcatgttgagcatagcaccgtatgcaattgacagtttgataccgatgatggtttttagcaaaatgttactttttcctcatctattatgaaaatttccttttagcaacttgtttgtcaagttataactatgcctactaagtctaagtctaatattgttttcttcatgtggaaaacaggagaaagggtatcattgttggaaatgatcaggaaggcgacgacacagttgtggtttgccatgtatgtaaaagccttggtccatatgatttaatcttgaaaatatagtgcttcatatgttatttgctagtaagatagaatgtctaggagtttcttatcgaattttatggttaacattcatcactagtaagatgataagccatattaacaacattagtggatcctacggctcttgaagagaaatacgtttcaaaatgtcatcctttgttttatatgctcaagatgtctgggaataatcctgcaactatttcaaaggtgttacatttcacaggtcacacctatttgtgttgaaaattgtccttttgtgattcctcgttctttatctagtacccggttgcaatttgtttgatatagtgtggtacttgttgtacaagtatcaaaattccttacaagatttattaacataaaaaaagttgggctgctaagaatgtggcacaaaccatagggcattatttgtcctgtatgaaaatttgcagcaagattgtccatggatagtcacctgtgccttgtaatgttgattgttataggtgatctttctatggcttgcgcaagatttgtaagaaaaacaattgaagaaatcagaataacattgcgccattgcagaactaaccacaacactacagaacttgaagtgcctttgtaatgggtaaatatggtgggctggtagcatagatattgtattaatctactcttaagaacggctagttttgcacaaaaaaagaggttcactttctacttcttcttttattgtgcaaaagtaacttcactagttcggtgatttgttcctattcaaccctacattatcacctgatgtgtacttatagacaaggaataaacgttttccatagtttgtaacatagttactgtgagaagtaccattctcattttttgttgagtttaataataaactaacgaatcacatctcgctctctttcaggttccactaaacaatatgtttggatattcaacagctcttcggtcaatgacacaggtcaaatgttattcttctatactttgtctatcttttattttattgacttatatatacccagaaaatgctctttgttttagtcagtcaaactactctgtgatagattgatagtcagcagaaatatccaattatcatctgggcagcaatggctatgattttcaaaaagagtgaaaaattgctaccagagtgaaaaattgtcccctgtatttaatagtagtgcatcattgctagtgcatcattgctgtactccaaaaataaatagacatactgcatgtgatatgttggccaaagtacatgctctgttgatgaatttctgctcttccatatagttattggtgttccaaagtacttataagtatgttcaaaagtatctactcttggtaacagaaacatgtcctgaactatgggcagttaaaactcaattcattatcgaacatataagttaggaactgatacatgaaaatagtttccttatattgaaaacatatcgttttggacataattctaagtcaaaatttgaaactttgaacatttataccttttgcacttttagttggattgaatggatgagaatcatatctatagatttgtttcggaaaaatactctcataatatttttatttcatcggattatgtgaatatgttgcaatagaaattagtggccaaagttgtattttgagaaccatgtcaaatgtttaaaacaacatgcttccaaagccagatattgtataagttatgaaaccatgtcaatgtttaaaacaacatgcttccaaaaccagatattgtataagttatgaaataatactttataatgctaaatctattctgattttattttaaataaatcaaggtagtggtttagatgacatacttttttttttactcgagagagtacgagtgcctgaaaatagggagaaccgatgagggatattttgcgtatttaatttattagttattgttgtgtcctgcaggggaaaagtgaattttcgatggagtatctggagcacaataccgtatcgcaggatgtacagatgcaactagtgaatacgtacaaggccagcaggggcacagagtaatacagaaaaaaaagaaacagtcacttagttaacgttgcattttgtggcccttaatgatgctaggacatcactagtagagtgattcttctagattacataaacaaattttggtttcactttgtatgttaacattgtattttacggccccccgttgtgatgagccatgacatcactaataggtttatacatgggtttctcgatacgacgatagaattgtgatacaataatctgcactccttatacgcaaacgtacgtgatgatcgaattagagcaagttctgtttggacaatgaaaatttcgttatttcttcaagaaatttctggttttgtgatttgttgtccagttttcttgtggttaccagggaagttgtctaactggccctggctccaaaaggtctttgccaatctaatcctgcttgcaaacaaccatgcgcatcatcaaagccaacagcttatggggtgtaggcggcatcatcaaagccaacagcttatggggtgtaggcgctgaagtattattatctgcgggaaaattcccgacgtgccctgtgtttttacctagagaaattcttttcatgtccttttgcctcatcacacacgtgtcactgagttttgattcactccgtactcattccacgtcttcgtttccttctgttggagggagattactagcagaggtgaaactagaaagtttattaatacatgattaattaaatatcaactattataaatttgagaaatagatttatttgaatttttgaaataacacttctactccctccgttacataatataagggattttagagagatgtgacatcatatttaaacgaatctagatagagagcatgtttagatacattgtactaggatatgtcacatctctctaaaatctcttatattataggacggagggagtatatagaagacttatgaaatagcttaccatttaactatttgaaaaatgtgctaaggaaaattgggaagttgaagtttggagttggaaaaaaaaacagggctgagcgtagagcaatttgacatatttggacatatgactatgagagtaaagctcacgaggggttgggtgaagatttgacgataattgtgacgagtggctttcaatgtgctccacacttttcgtcaccaggctcctatcctcattctttgatctcgtcttctcccttttttggccgtatctagtggcaattggagtgtagccatcacatctagcagtgccttacgatttgatggtggagacactatagcgacaacggtgattggcgctataggcggagcaagcgacgactacaaggtcaatgagacaccgtccgtttttttctctttccttttatttatttttttcttcatcgattattttcttcctataaagatttagagtgaatttcataaaactacagtactatgcaccatatatcacaaaactacatatttagtgtcttcgtttatcacaaaactacagtactttgcacaatatattacaaaactatagatttaaaatcttgtttcaaaaaactatagatttaatatcttcatttatcatactacagttttagtgtcctcattatcacaaaactacaggttttagcaatgttaaaatctgtagttttgtgataaatgaagatactaaggctccgttctaaagtgcagacttggctgggctgagctgaattggtagcagtctgaatagtaggtagtagcacattaacctgccactttagaacggggcctaaatgtgtagttctaggataaacgaatacactaaatttataggtttgtgaaacaaattcttaaatatgtagttttgtgatagattatataaagtatctatagttttgtgataaacgaagacactaaatctgtagttacatgaaacaatctcttaaatctatagttttgtgataaattatgctaaatacatgtagtttcgtgaaatttactcagatatttttgcaaggatatacatatccttgaatgtacacatgaaaataacctaggacacgtgaaaaatgaaaaaaaatcaagggtaaactggatcttcatttccaaaaaccaaagacaaaagaaaaattatgattcaagacggaggcaagaacataattgtccctcgataaataaatatatagtatttcgatcaatagtttctgggacaactaagccatctacacgtggcctctagagcatagtaaaaaaaccggaccggaggtcgacccgctctggtcgttgattcaccggtcgaaccgctgttttttatttattaatattatatttgatttgttttattttaaatattgaatcatcacaaattggtgaaaatatgcataaataaactagtatatctattattatatggccacaacataaaaaaaaaataaatgtagtgtggtaacataattaaaaaccggtttgattcttaaaaaccgctaccggttcactggttcacataaaaaccgtccggttcatggttttttaccggttcaattgtagggcggtctttttgttgaaccaagccgccaaggtcgctgtttccggtcttttctggatcaaccgccagcctggtctagtttttttgtactatgctacagagatgaagctcatgaaggtgaatgggccattagagtttccgttgtatcttacttctttcgtccaaaaaaaccaacatagtacttgaatgggacataatctattaatctggactagattatgtcccatccaaatactatgtttaaattttctttaggtccgagggattacactggaagcagacgtcagcaaccgactagccaccgcctatttaagctgtctcccctccctcctccctccgctgcccccctggtttccgtcccctcttcctcctactccacgaccacgcccaaacacacgcttttatcaaaccttctagatccgcgccttctgtaccactggaggtagatgtttctcctcaccttaatttcgagtttcacctctcctgcctgtgattcgagcgctcccatttcctgtctgcctatgagga

SEQ ID NO: 68915 - DNA, 1766 bp, Oryza sativa
aatttgacattactttgcattaatacaaatataaaattatatacataacacaaaataaaatatcaaagaaatgtgggggtaagataagatatgtggacattaaatagagtgataacttttgtgactgtatgtctgatgtactattaacaataaatatttgcatgccaaaagggatcaaatacactcaccacaatgcatcttatcaagaaacatgtgaagcaaattgctgtcacagtcccaacctgaaacaattaaacatacacagagttagcatgcacttgaacaaggtcagtcatacatctaaatctacaaacatttttctcatcagcattcattataatgtacaatgtttcagcattcaagttaaatgttgaagtttcacatggtttcagtgtttgtaaatgaaaaattctatgtttcagaattcaagtagaactaatctttcacgaacatagtacacaaagcaagagtacagaatctatcttcaacaacaactttaataaacaggagagcaaatgtgcatatattgcatgctaaaaataagtgtaacgacctcatagagcttctttctgcggccctttgattcaatcggaaaacgcctcagcatgaaaaatagcctaaacaaaagaaaaatatatacatatatcatcaaaatgaacaacttattgaaaggaaaaatgcaatatcaattgaacaaaataccttccaccataaattaagaatcccaaaagagctaagaatgagacaactgcaaatgaagaaagaataatcagcgagctatacagctgacaaaatgattagacaacttatcgaacagaggaaaggacagaacatacctgatataaaaattttgctcacaggctctagcagaggactatcatttgtcccaaggtatatccaaatacaaacctgcacaaatattccattagatatgttttacggttacagaatgatcaaccaagcaacaactcagatacattaaatacgcaggatacaagatgaatgcaattgactgtgcatattactttcatggttaacttagtagaacaattatcatggaaaaatcatatgaagaatataagtacctccgtccaaaataactgcagttttaggagtggggtaaattaagagggagggaaaatgacccaggtaccccctattgaatgggggatggttgggatttgggagtgaagagtagttgagggcaagatagagagaaatttgaatgagagatgactggtggaacaagtagtactatagaattgcgcttattgtgggacagaggtagtacaataatttgagtatgtaagcaccaacctggattacatatataacaccattaactgccatgtatataatccttagcttgtcagtgggaagattcttagcctattagatatataaacaaattaacaaataagtaaaaaaacacaatcatttcatggattaaaaattaaaaggaacatgaaactataaaagacatagttaaaacctgatggtatatttctgcccagaacagcacaagtagcgtgtatgtcgagaaaaatagaagaccaggaagatccaataacaccaaagtatacacctatttaaacataaagagttctgatgagcaatccagctagaacacaaacattaaaaattaggaaatccattgaaaagtccacaaacaaagctaggtgtcgtgagtagaaatataatttacacaagagtgttagtccaaaatcaattcatatactatatattataatagggctgcaggaatt

SEQ ID NO: 68916 - DNA, 2202 bp, Oryza sativa
ccatattttctcctcttaggtagacagaaaaaaaagataaaaattctaaggtagagaggagaaaatatgttttctacttatatttttttctatgtgactgacacgtgggtccaactaacacgtatgaactatcgtggcatgccacatcagcgcatggaaggggttggagctcatttgaacctatatgacaccccaaaacaagttcgaggacacgaaaatgcattttgagagtttagggacctagatgacacacccgcacaagtttagagaccgctcgtgcacttcactctttagaaaacattagtgcaaaaaaatgtaactataggaagatagcaatagcagtctcctcacttttcagtaagtgtaggatctctttgaaatgaaaaagccatctgcttagatcacatgaaatgtatactccacaagacagcataaacattttcattgaaccaactgaactcaaaaggattaagaaatggaaaaaccatctgcctttatctcacgaaacatatacatattcacttaaccaactattatctcacgaaacatatacatattcacctaaccaactaaagtcaaaggaaacttaatgtgtgaccgtgtgagaaaaagagtcctgcacaatgcagtgccatatgagcttcttggactaaaacacgagtgcataacaataccaaagcagtattccctcctagagaagaacaagaataatccaagtcagtggagcgcgcacagtattatgcagcatgaaatgcaaaacataacaacagcaaaacataaaatcccattaatattttcagctggagattaatttattttgcgcccccccacccctccccaaccaaaaaaaaactaataataaactgtttcaagccaacacaatttggccttttgtattttttttttcatttggatgacaaacaacatgaagctgtggtcatgtcacaatactacaaagggacacatagttcatacctcttttcccctcatcttggaattaacatggcaataagtcagttttttttcttggcaattgtcctccaagatctttatttgtattgattaactatttcttttagatacttctaatcaaagaaaaggaaaggttgtgtgcctatggtagcttgaatgtacataaaacatgtttctccacgttattccccaacattcaagtggcatgtgatttaaaacgaaggaggtggaagggcatacaaatgtaagacactatgcacatgtaaaatttgtatgcattgtatccatagcaaaggatttttacagttaattgaaggaatccataaacctttaggttttataaatgatgcttatgcagttgcagtcgaaatgctcaatcaaaacaataggaaactaccatgattccaccattcactaactagaatcacatgctagtgtgaacatacgcataatcgggaggaatattgaactagttccaatctgcaataaggtatatatggtatagcaatataagcttggtgagaaacggccacacacaaacacgaaacgcagtgtaggaaagcaactgtgaatgcatcagaatctaatgacacagataccgcccaaataattaaccaaacgggcatccctacccgtaacctgacacatcaaatgtccagatcaagcagtcaaacttatccacaagccccgccatgagatggggattaggcgattcgcccccccgggggggggggggggtagggttacacgaggggggttaccagcgcgacggcggagacgagcgcgtaggcggcggagagggagaagaaggcgccgtcctgccacgccggcgacccgttcacctcctcccaccaaccccgcagcgccagcgccagcgccacggcagccatctccggcgtacccgcgagcgccgtcgccgtcggcagggacggcgaggggaccagcttcctcatctccgatctcccacctctgtctctatcgccgtgtcgtggtgcgggcgtcagcgagagaggcgatagctcctcttcctcctccctcctccgcctcctgggaaggaaagatcgagtcgaggagattaggcaggcggcgtctccgtctcgaaaggcccaatcaactcgctcgcttcttcacttttgctgcctgagagttgagatgtggacgcgctgagacgtggacatgtggggctccgccgcgaccatggcccacatgtccgcggcttattcgcttacc

SEQ ID NO: 68917 - DNA, 1812 bp, Oryza sativa
tctaccacaacctccactcccacgcggatcgtgatctcctctgtgtctctctcccatcgctaatcgcacaccttcccttatctctcttagccaccaagtgttccccttactcttgtccataccaccctcaatctccacctatgcactcgtcttcgcgtcgcccctaatacgcgctgttgcaacacctaaatctgtggcgccgctctcttttgtgccgccctgatccgcgttgctagatcactatcgctgtggccatcgtcgcttgcctcttcgatctcctcggcaccatcataactccgttggtcaacctcgccaatttcctccgcgccgctgacgtcggatcgtcgccattgccatgcctcattgatcccctccgacaacgcgatgtcactgccgcctcctctgtctcaagcgccatcgacgccgatccgtactcacgccaccgcccacggttcaccaccgtcacccacaaatcgctgtcgaaaaaaccttgacatcgtctcaggctccggcaccaccattctcgattgagggccatgtacaagttcatcttcccttcttcctcagccgctcggccccctcccctctaccacgccccgatttcttccgtgtcgaagacagtggtccagtgctcgctctatgtcgatgttgacggtcgttacagaccaacttcaaccatcaatattcctaaaaatgataaagaaccggcactactcgcatgcatatttatttagaaataatctagttccacatgtacttggcaaaaaatttgaatacaatagattaccttataaataaaggagaaatggtggaaaatacaagttcaaccaatcagaggtcgacacatggcatacagatggatggaagggcccacaaacccaattaaacacatgtaaatgggcccaaccactatgtcactggaccaaggacccaccaagaagagccccggatgaaggactaggccagggggaccagccaggggtcgccgagacccagggctagcccacctggccctcaattttcatgtgctggtagttaccaaccttccaaggcggttgtgaccgtttctaccataagaaatcgccatagaagggacacttggtagctcaagagagaagatgctcctttggatgcttagaatctctactccccaagtcttgtccaccactatataaagggcactcttcctctcctccaacacacaccaagaaggaatcaagaagaagaagctctccttagctatttacactttgttctagtgctagtggagttagaattagaatagtttcctagttcttcaagtttttcggagaattcggatattgttctagtagcttatattcctcttgtaagactttattctataatgaaactttcttctttatatagtcttggtcctttacttcatttgcacaattatttgagtaccaactctagtctaggcttgtcttgtattaattatatggctagcttaccagagatatgcaatggtattggcttagtgttcgttcgtatgattgctctatgtcatctgcagagatgtagagtaatatttagtaatgtaagcgcgatgcttagattattgaatatcattaagtggtgctatatgccacggaactgtagaggtaggctgctgatggtgacagctcagtacagatattcctccagtgcgtatatagggctaagaaaggttcatgatgcgagtactcctccatatctataaccaattggatggccatgatagattatcgtaaggaactcggtaatcaggggtggtttctcgatataccaggagagcatagccaggggatt

SEQ ID NO: 68918 - DNA, 728 bp, Oryza sativa
atttgtttggaaacggggggccaaatttccaacccctaaaaaaggggttgtcgggccacccccccagttgcctttgtccacaaaaatacttaattttgggggaaaaaaaggaaaaattttaggaaatatagaaaattatgttggaaaagataggataaattttagggatatatgaaggaattcgggaaaattgagaaaattacattgaaaaagtatatgggctggctaggccaaacccgtgccgccctacaagataaggtgttgccccaagaagaagatgcaaacagactgggcaggcacggcccactggttgcggatcgatatgtgcatactacttaacggagtatatatttgtacttacggttaaaacagcttgcagatagaaattacgtgcatatgtttgtaaagtgatatcgcatagatcataatctattctgttaaattttattacattcgatctttcataactgattgaccgagttacgtacaagaaacgacggaacatttttcgacagaagacacatgcaactttcacatatatatatgaagttgtacatagtaggggcatacatccaccatatgcaagcacaagcgcgcatgcagctagcattcgcttatttatctacatggagccatagcaacaagcttctaattcagggggagaattcgcatataatatttggttcagctgttgacgcagttggagcggcagtaggagccgcagtagt

SEQ ID NO: 68919 - DNA, 1226 bp, Oryza sativa
gaggaggacgctgggtcagtgcaggcgccgctgcagccacccatcccaccggcgcacgacgagttgcagtactggtcacacttgctgcagatcatatgcaccaccgcgggctctggtaacaatacagcactaccagcacaacgcacacgacgggtacaacgactacatcaacagggaagacaaccatcatatgggctttgtaacgttatttggataatggcaagaacaggaattaagatgtgagatgtcataggcaaaatatcaggcaattccgctatttatagctaggcgactgatgctcaagcttgctaatatatgcacttgtatatatctgtgtgtatcgatcactggatattgcgtgcaggtaacatgcactgaatacgtcgtttatcatatctctgtattgacttcaaagatggagggtggtatgacataatatattagttcattcaaactatgtgccgttattcctcttgtgcttgtaaggtcaaatatagcttctgatttagttaaacacacacatatataaatcacctgagacaacgtcattaaataattttctccatgcagtttgtacgtaccaaattaagtaaaatggcccagcaactagcttagccagcagtgcagcacaaggattttaattaatcatatccatgatgcatgtgatatatattctccttgcattgcaagtctaaatgcaatgagtcaagtcaactccgatacattcatgttgatctccattacaataacagatatacgattacagtcagggtttcaaaaaccgctgggggcccggttaccgccacccggcggtacggcggtaaccgcggtaaccgcgcaaaaccgcgacaaatttacaaatcgaaatttgaattcaaaaattcgggcaaaccgcgcggtttggcgcggttaccgcgcggtttgacgcgggaaccacgcggtttggcgcggttaccgcgcgatgtgtaatgggttgcacagtaacgggccggcccatttttttttttttttcaaattttcaaatttatttctcgttttgctctcaaatttgaataaaaattacttttttttgagaaaatttcttaccataaaacacttttaaatcaagcacttaccttcactatttttttttgaattttattctttttttttaaaatttttgaatttggaccaattttatttaaaccgtaccgggcggtacgggtaaccggacccccggggtacgg

SEQ ID NO: 68920 - DNA, 516 bp, Oryza sativa
caccccggccaatataagataactcgggcctctgttgcgaagcactaccgtacttccacatgtctagtgggtaaggcttagtttgtggctcagtctggttataaacaaaggtacacggatggagatggacgaagtcggggctcgatggacatctctaggacaaatgaaggctacacgagctacggcccggtagtcgagatgtcatggcacagggctggtgtccaactgctaggggctcaatcctgcctgcctatcccagaagttccggccgtaagtggggttgggtcggtactcttgtttatggctaggatgggttgggaactatgtcacgtctttcgtccgtatgccgtggtggtatgtggcacgtggttactcgtgaggaagatgtgtcttgaaggtaaagatgtacacctctgatcagagtaaatctattcgaatagccgcgcccccggttatgggcaagcctaacaatgtacccaagttagtggtttacttcttaaaatttgcttaacaact

SEQ ID NO: 68921 - DNA, 716 bp, Oryza sativa
cctgcagccctttgtccagagtatacaaatacgtaagcagcataattgcttaaagcaacaaacctgattaattattattgattaaagactggacatatttgtgtccaatcatacatttatcatttttttgtttttgcttgtttcacgaggatttggatgtggtgagcattatatgtacgctgatatgtactttcagaacttctgcagatatgtacgcggccatttaaaaagtacatggtgtcagggtatagcacgtatatttcagttggcacaatgcatatatacgattagatcaacagctagcaacggttttgtatcactaccagaaactccattagccctgacgggccaaaatttttctgacgtgtatctattaggctgtcaggagtaaacaatttttttctgacgtgctttcggtaccgtcacgatatcatgaatttcgctggcgtggtttgcctgtcagaaaaaaattttaggttcagatggttctcctacagagaccacatacgttttcatacataaagactgaccggcctggttataagaaactatagcatatattattattattattattattattattattcaacatgcatgctatgatgcatgacctatgatgcacacatccattacatgattaaatcaccaaatgcaaagcatgcacttactacaaggaaagttctgaaaggccgaaaaaaggcatgataaagaaa

SEQ ID NO: 68922 - DNA, 1668 bp, Oryza sativa
ctctttctattatgggtatatatacagagagggcttgagaggttggttgatgtatccacatatgagaaagcaataaagctgtgatgcctctccctatatctgtgttcattgtttatctattgtgtgcatgagatcgtcgtcttctactctggatcagcgaacaggccactagttatccaacacgttatcagcacgagttctcgctcgttccgctgatccgggtaagcgtttttaatagatcaatttgtttcgttactaatcagattgatatattgtgtttatgcatgtgtctgccgttggccgagaggatcgcctccgcacgtagccgcgcaccgaggcaaaccgtcgggtgacgcgcgtgcgtgtcgcactccacacacagagcagcagcaccgccggtcgtccgcactgaggccgaccacgccgcaaaacttcctgacacgatatacgtcgatctgcatcaacctgaccggtggcacatgcatataaatgtatgactgatcttgcatgtgtatggatctacaccaggcatgtactacctccgtcccaaaataagtgtagttttacactattcatgttcaacgtttaaccgtccgtcttatttgaaaattttttatgattagtatttttattgctattagatgataaaacatgaatagtactttatgtgtgactaaatgtttttaattttttcacaaatttttcaaataagacggacggtcaaacgttgaacgtgaatagtgcaaaactgtacttattttgggacggaggtagtacgtagtaagtactgatctccatcaaacaaaacctgcacacatgtatatgtgtgcgatccgatctgcatacacgcatatggagattgtcgaaactagatttcggcaataataaaagggggtggctatcaagctagaaaagtgtatgggtttggagacaaaggatttatacaggttcaggccttcttatataagaagtaataccctactcctgtccggggatgaatccgccgagtgtattattgattgtatgattcgggaaaaatcagcatatgcccctagaggcgcccggaccccccttatatatgggaaggagtccgggttacaaaagataatctatattcctaacggaatatgaagatacaggtaaaatacagtcgtaaccgactaagtttcagggtatttccttgatacacaagttaagaaactaacccaagatacagataagatattctatctacattaggtatcctgtacccagttcgaataccatcgccgtgtagatatgggatacccataatctccacagtagcccccgagtcctttgcagtcgaccatcgtagccttctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcacacgcggcgcctaaataggcatgctagccgactgctttttagccacaataaaaaaaatccgagtggtttacactctaaaaggttcacgaatgaacacactcgacaggcatccgaatataaaaa

SEQ ID NO: 68923 - DNA, 7133 bp, Oryza sativa
ttagcagaacctaaccgtgaaccactatgcagagaatgcatcttcgcaatgaggccaaaaccgcaactttagaaaggctggttcctcatttgggaactcttgaagcggttagggaccagctacatgaggccaaggagcacgccaagaagacggagaaggagttaagggaccgaatcgctcagctccaggattcaaactatgagctgagtggttcatcaaaaggtaatccctagatccgtttcatcggtttaaactggcataactgtatcctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcagcttcggtttccccactttttgaaatcttggcagcgggcacttctccttcgctcaccatggttgcagccagtcagatttcctctcgggcagacgccatctcgcgggtttgggccatgtcgcaactctccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagagtgatctggccgagtggagttgcggataatcctggaattactccatgaaaaggcgcattgcttgattttaactcggagcgagggatctgcatatcatccaaagtcttggcgaagaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcataagccatggggccgccgaaaatatggttgagctccttgcggtggtcttgaaatccagccggggtgtcgccgtcgtccttcttccttgacgtgctttgtccctcgtcggagttcttccgagtaggcttggtgtactgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgtgcagaatccgctaaagccactggtaaatagttcgccatggccttgttgtcacctcctgctgcgcggattgcgagaccgtagacggtaagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgtatgattgtgtcgcgaagatcgatggggtggcgacgaggcggtgaacgtggccgttctactcggcgctccccacggtagtcgggaggcgagtgcacggaccgctcgtcgcgacccctgctcctgcgattggatcctgcgccggtgatgctgaggcttggatgacggtagtcctgagatcggaagtgtggaactcggctaccagtcggcgtgtggacgctttcggagttaactggaaccgaggccgcaatcatggtcttggtctggttcaagatgttgacgacatgatcagattggttgtgctcgttttccttgaggagggtgtcgaggagggtgatcgcggcaaccgcattctgctgaggggtacggaaaaccggtatcccttcaacatcttgctggccgatgagatcacgcgctcggcgcccagcttccagggttcgctgctgtcggtgttcagcctccttcgcgttccgctcatgctcctgctgctcccgccgtagccgctcttgctcttgtgcttggcgctcctgctccagtcggcggcgctcgatctcgcaacgtgcttcggcttcccgggcttggcgctgctcctccgtttcattgtcggccataaagacgccgaagaaaagaggagtgtagttgtcttctaggcttccgtcgaagtcgtcaagatccgcgtcgtcgtggtagcgagaaccaaactcatcgtattccacgatttcggtgggacgtgagtcgacggtgggagagctgtagtagccatccagttggtccgtcgaaaccgtgccgagtggttggaggatgacgccgacttccctgaagctaggcgaaatcggtgttaagaccgacttccgcctaggcctacgggatggagacggcgtggcggtggagacggttgccgaatcgtcagggagctgtatcaagatcgatgggtaaggctcatcatcttgatctggcgttgttgaagtagatgcgatctcggccgagtggtttgaagccgactcggttgagatggtcttgaagtaactttcagccgcgtttgggagtccaaacgggaccgaaatccggttctctcccgactggtctgattccgagtcgaggagagaaatcttgccgaagttgttggtgacgaagtcgaggctgccgaaccgaaacgtctgcccgggtgggaagacgaggtcgtcgatgccggagatgggacccattgcactgatcggcgaaaagcttgacgctacccctacctggcgcgccaactgtcgaaactagatttcggcaataataaaagggggtggctatcaagctagaaaagtgtatgggtttggagacaaaggatttatacaggttcaggccttcttatataagaagtaataccctactcctgtccggggatgaatccgccgagtgtattattgattgtatgattcgggaaaaatcagcatatgcccctagaggcgcccggaccccccttatatatgggaaggagtccgggttacaaaagataatctatattcctaacagaatatgaagatacaggtaaaatacagtcgtaaccgactaagtttcagggtatttccttgatacacaagttaagaaactaacccaagatacagataagatattctatctacattaggtatcctgtacccagttcgaataccatcgccgtgtagatatgggatacccataatctccacagagatcttccacaagcccgtcaccctgccagtgctggtatacgctatgcagatgcatatgcggaccggcttactttacatgggtcaaataagataagttattgatttcatctattctaatactttgcagtagcgagagtaatatgctagatcatgcctctagtcgttttattttctcgcatgaatagatgtatttgtccggcctttgtgccgactcttctcttgttatatcaccgaccacgaagtttgacaccacgcgcctgaacgcgcttaccgtgtacacaagaaggtgcacatacataatccgttgaattgaacgacggagtgatgtcccgaacgacgacacctcacactcggtaacatacgacatcacctagaagttgtcgtctatctggctaacacagtcgttgatctatgaatatattaacacactcgtcatcgccgatcttatggatcagcacgcttgggacactgttgattgtaacttgtatgttaataatccgtcatattgctatctgtatgaagtagatggtaacaaatccgagtcatcggcacctgcatgcgccgccgccgccgcctgcacgtagcgacacccagatgccaccgcatgacgtcttcccctttgtcaatggttgccgaatcaatccagagactttcactcatcgatacgccatctgaaacgccgactcgacggcctttcgaggccatctgcaacgcaattgacggccgtcgcccgtagcgatgccgaggagcttacgcctgcctcccctcgccgccggtacgcacggcatgcctcccgcgctaccgcacgcggccgggacgagggtcgaagccgccgtgagcgcccgccgccgatagccgtccgccatgccggcctgtatgccgagccgagtttcgtcgacacgtaacatggagctatgattgtcggacgccggtcacggcctgatgccaacgaatgccggtgtcggtgctactagatgttgcaccgccgctccgcctctgaccatggcaacttgccatagtcgtccatctctaccgagggctcactagcacgtttgccattggttccatccgtcgtctccattgaaggatggcaactggatcatacctcacccacttcttgtgggagaaggtcgtaatagcccattgggcaacatatgagatgggttggccagattttcaagctagctagtataaggaggtgggccaagtagaaattggcctattaaaaggagtcgggcacgaaccgtgattttggtccgaaaacggcattttatttcaacagtccttggtttccaaggcattatgcggaactcggaaattatgcggaaaagtcctatgggacattagaaactacggggaatatacattcgccatttatactttgaacattcatgaattgggtttacgccaaatagagaagtattaaggatttataccttagtcccgtatttctaattagttgctttaactatttagttagtttcttgaataaccataatcaatcctagaaacattgtttttaggaaaaagagcttccatgaacttgtaaaacctttgttttagcacccttttggaagcatcatattttatggtttatttcctggcaattgtttgtttggggtaattgattgttctgtgggttagtagttctgtaaattacacatacctttgaatagcagaaaatcatgttaattgctaggattgtaataaaaggtgtgtatagaaaaccattatttactattttgtactcgttttgtgcactttacttactagaagtaaaccggtagaaagttgcataaaaggacatcatgtaagtagttgcatgtagcaaatacatttattgggcaaatgagtaatagaatattcatatatcttctctttgtctaattgtcgccacatttgtagaaggcacaattatatattctctgtatagaataaatgtatacactcatcatgaagagagtatattattgacttagagatatatattagtgcaggactatcatagaagataagctacagctaatttatattaattgtgtccaagtagatgcaatgtcatcgaatttgcgaatatctagacgagaagtctatatgccaatatgccctgcaccaaaattatctatcaaaaagactatatacctatgcagtgtctatagttcatttgattgataatgttatgtccatcttccacgtataaatgactttacaaatgaagtattgtttttatggatgtatgtaaattattttgagtaaattggtcatttgcatttgaagcaattttggcctagatgcaacatgtttagttgttagaattgatacacaagaagttgtattactatcaacatgtgcatttgcacgcacatatatgacttatactattaatatgttcatgaagaacatgcatactcaaaatttgtggaaggaaaggaatttggtgtatttgaatttgatgttcaactcagggggagacgaatagtcatgacagtaatcttgcattcgttcttttgagatagtattttacaatacacgagttacattatagtttagattaagttcaatataaaaaacatggttaagctcatgcagagcatctttatcttttgctttaggcatagaagcttctacataagattactaaatattttttttatataggtcatctcaccttaactatattgttttttttttacctgtagtaattctttaaccttttatggaataaaattgtgaattgtatgtctaacattgaatgtatttttattatccactaagcctcaatcaaccatgtaggttgatatttctaagtgcattgacgccatattggcatacatgtaaagttgtttacttatgcacatgaacaattagaatatttatgtttaagcattgaagcttaaatatatccacctacaaccacattatttcttttagaaaagttgtaccatgaagttataacaaatatgtgggtttcacgacaactattttgtaaattttcttatgattggcatgaaaagggggaggaatatgtgtattttgcaaattaatttcagaatatttgcaataaataagcataagaaattgtggatatgtggcaggcaaattgatgtgttataggtcaaatgctagaagcaaaatagcccaaactattatcgaatcttatttgggataattataattattgtcacacaacgaagtgtgttatttattagccattgaaaattgcatattcatcaaggaagtatgaaattgcatatagctatctaaaagctattggtttacttgtagtaaacaatatcctaaataattaatgacctttgagattcaattggggtgcaggaa

SEQ ID NO: 68924 - DNA, 668 bp, Oryza sativa
agaaagaagaatggatcccctctcccttgcactagcctgccaacatggccatcttgtggcagcacaagaggactagcgtctcgattaggacccgttgtaggcctacaacacccacctcgcggtgccaccgtcgtcgccgcctaagccaggctacccacgtcgccataagccgcctgtccgcatcaccgccgcatcatccgtcttgctgccaccaaagctctagccagcacgccatgccatggcacggatgccatcccccgcatcagcctccacgccgtcagttgagctaacctccttgacgttgcccgcaccgaccactcgcaactctgattgctcatcgtgctagcctcccacagttccgccgccatcaggcttgccaccgtacacagcgtcaccctacccgcgtagctgcgcgcctctgcgatgcgccagccctcagccggaagcagccaagtcggcagaaaaccgtcgccactatgctcccagctcctcccatcctgtcgccacctccatcttcctcatctttgtcggtaccatgcgggcatgcctgccttcaacaccgcacccttcctacctcaccccatcgccatgcagccgcaccacgccgccttgttaccgctgcctactcgggagccggcctcctatgccggggaggtcagatacggacg

SEQ ID NO: 68925 - DNA, 641 bp, Oryza sativa
aatatacctatatatatatatatatatatatatatatatatatatataacgtgccatttaactaaatggcactcctcacaccacccaaccacacccactatttgcatggataaaatttttacccctacactaactctcccactcacacatcctgctcatcttcctataagtaatgtttttaatgatacacgtctatttatattagttgctagtgctgatcaatcattccctattctctctctcattcctcatcctaatttttcggatctagcaatttgcatccacggcagcgatgagaggagcgacaccattgacatcgacaaggaggcctccagtgagcaggcaacgacggctgacggaaacctccaatatgcaggcggcgagccggcgatcgatggcgcatccgggcactagacggggactggctggcgtggagcaggcagtgctcacggaatctgaccggcagtggcctccggctactccgctttccgcctaaaccgccggtgttctacgggcctgtttggcacagctctagctccagctccacccctcctagagctagagctcagccaaacagttacagctccaccaaaactaggagtggagttggatgaagctctctcacaaaatatactggagtt

SEQ ID NO: 68926 - DNA, 2325 bp, Oryza sativa
cctttccttgtttgttttttcgtttcaggaggtccaactgatgaggttcgatggtgaatgtggggaacatagatcggttgtactgatatcttcctaacgtcggcgctgatccttcaatttacatgtactggtgagattaagaaaatatgtaaatgatccatctagggatggcaatttccccattggggccagggatccggcagggacccgcccccacgggggcgggggagaattctcacccatgggtgagtggggacggggccccgcaaacttccggggatgggggcggggatcggaattaacccgcaggtgacccggaggggccccggaggtgagttacttctctaaaagtagctcattgcaataatataaacccaacaaacccattcaaaattgacatataaaagctcaacaccctagttcccctcaaccataatccttcaaccaacccacacaaccgggggctattgaaattttatcataatattatttagtgtattgcaatatttttatgaagtattagctccatccggtgatgcggggccccggtcacccgccgggtcccatgtggggatggggacgggtgatgttttcacccgacttcctttgcggggccagggccagggatacccgcataagggcggggacgggggcattccgatccaacccggccctgccccgccctgttgccaccgctagatccatcgaataagcgatgttgattagaaggtcatttgttgagagtgagaagatctatactggccaaatgtctaggttttatggctcaaataatgcatgtatatatatatatatatatatatatatatatatatatatatatatatatatatatatatataactggtgctacatagagtatgggctccaagattcaaattgagtatatatccaatttgaatgagtatgaattttttttaaatgtttagatatgaacgttaacttctttactaacaagttcaaacaagtttgaactgagtttgaactttttttttgttagattttggttctaggtatataacatccaaacatataattcgttaggtatgcaataatgaattatgaaataaagttgagtttgagttgttttgttgttaggtatttgtatgaatcaaattcatatacctagatatctacttacaatttgtaaatttttaaaaatttgagagaatttgtgtgttttataccttggagcccgggcaccatggagtgccatatgggtatcctatatatatatatatatatatatatatatatatatatatacacccggggtgtagaatagctattctataccccctccttaccaaggcccaaaacccacctcccacctcggtcaaaggcccctcccaccggtgaaacccgcctactaactccccccaccacccacctcttctcagctctcgtctcaggacgatgcagtaacacgacgaccactgtgcaataacactgtgtcttacgtgtagtaacagcgttaaaatatagttgaaatacagtcatgacgtatctacttttgataagctctttttttctagcatcatggtacaaacggttttaaaaaacgttacatcacttgggagatattgttcttcaaagcttgacttttttgcaatttgtctccacaagtagtaatactatactattactattacttgttactacttgtctgttgtacgttaccacaatcgcatcatgatgttactacactgtgttttactatattttttgagtagtgttactgcataaacacgtggtagcgtgtaccttccgtgcagtaacacttttacttttatgcagtaacaagtatatggttatcatatgagacttttaacctatatatttttgtttaaattcatgatttactgtaattcaccacaatattactgtcaaaagtgcagtaacgtcatatacatgcagtaacactatattggagggaggagaccgattttcttgaaagagggaggaagaacggtttcttgaagaggggagtatatagatgcattttgaagtttaaccctccacatgcagtaacactatagcatcatggtgggaacgattttaaaaaataatacatatcttgtgagatgttgcttttcaaatattggcattttgaactttaaccctccacatgcagtaacagaatgtgtaacttgcagtaacaaaggcatacacatgcagtaccatggttttaccaaatgtataaaattgtttaaacaactcctacatcaatcagacctcgctcaaagccacctacagactttacctgtagcccacctattcgatcttcatctcgtaaaaatgacatag

SEQ ID NO: 68927 - DNA, 12905 bp, Oryza sativa
tcgctccaggctcatggctagagaggagacttgcttagtccaacctgtcccattcactctccaatctcaatccttttttttccggatctaggggcagccggcagcctcatcggccaccggggcgacaacgtctccctacaccggcgacgtggcttgctccgagagagtgagcctaggcggcagctcgtgaacggagacggcgcaccgccggatctgactcctcacccgtgttgcgatgggcgacgccggcatcaacagaatgcgcagaggaagcctatcctgatcgtcggcgtcaccttcctccgacgcagccccgcacggtcgtcggcgtgcacatccgcgcattgcccctccaaatgggacaagtcccccaccgagccctgctcttgattggacgccgacaactgctcatggctgagctgggattggagctcctaccgcctctgtctctagtctccgccgccaggacccatccagtccatgcccgccttcatctgtgccatccacatccacctcctcgccaccggcgttgtttcctgcttgggagagaaaggggcatctggtctgctcgcagcgctggagcgatagggatgctcacggtgctgagaccggcgccgtcgcctcctcgctcatcaccgcgttgactaggtctgccttgctcatcttcttctctgtttgggaacagaggaagacagctccacagccgctggttttgctttctcgatctgaacgccactgagagccatctatgccttcgttcttcccgtgtgtatacatgtgattcaacacagtggagtaaaaaattttattacgtgtaaccctttttatacatgtgatgtgattcactatacatgtagactgaaaaatatgtaatgcaaaccacatatacaataaaagcctggaaactgttattgaatcgaaaaatagatatatgagattcgtccacgtcactatgagtaaaagtttaactgccaataaaaattttactcatgagtaaatttgcgagtaaaatttttactcatgataacatagacaaatcttaaatgtctatttttcaagctaatagtagtttttagatttccactacacatataatttacaccacatattttccctcctataacagttgacagtggagtaaaaacataactactgtttttaatggttcaattctatcatactacgtcgtggtcaatagacctctctgtactcatgtctatcagtaaaaaaataactattgatatttcatctgtgtaagtttttgacccggtgagattttgatttttaatagtaataaagtccgtggtaaaaaaaaactgctatccacgtattgcaataattgaaattttatatacatatattcacttgtatatataatcatgggatatgtgtattttttctcctccttgtatgttatgtagtttcttacccgggagattttttttaatgattgatatggatgagtgaatgtaaaaataatatgcatcataatcttgattgtatgtgttaatatgcacgtaaaaggaacatgatactcgtattttaatgactgaacatttttacacacatttttcaatatggaatgattaagcaaatttattactaacaaaaataactacaaaaattgatgtaataaaaatattactgcaaacaaattgagagtaatgcaaaagatttacaggagtgaaaaatttactatactcctactattatcgagccctgactttgctcagtaattacgggagtaaaaattttactccatgcaaagatagacatgatttttttactctagtaacttttttactcagtaattttttttacttatggtgggaaccgatattgaaggccacgtggagacaagaagaaggaagtactttggcacgtcagcgaggaaaaaccaaaaaaaccggaaatgcggtgctctgtgaggtagccggtaattttttaactcgagataggagaggggtgggaacaaaacagaggaaagagataggaggtggactagtagaaaacgcaaaaccaagaggaggagcgctactaattccgtagcgcgtctgtggcgctgtgtgtgtgtgtatagatagatagatagacagacagacagacagacacatatatacacacacacatatatatatatatatatatatatatatatatatatatatatatatatatatatatatatatatatatatatatcatgatatttgatgtactagtatacattaacatactcactccgtcccataatatatatttcacatccctccaaaatctcttatattatgggacggagggagtatatatgatgcatttatgtcttgtcaagctgataaatcaatcctatcctctgttttaaggacgaacgaatctcaaattaaattgatactaagaaaatacttttattttggaaagaagtctatttgaagtcaagtttattataacacttaattttaaagtgctctaactaatactacatccgtcccaaaatataagcattttctagctatgaatctgaacaactatgtgtctagattcataactaaaagttgctatattttgggacggatgtagtattagttagagcacttaagttagttacatttatttaaggaaaaatagcagccagcaggagcaatatcgagaataccacaacaatatcatctgtcatgtaatcattaaatagagaatttgctatgcctcagcaatttctctcttcatgcacaaaatggcaaaacaagaacttggtaattaaaatggatccattatccatagtgttcagtcatgtcttgctaaaaaaattagaaaggaaagaaatatattactgggactgactactgagtgctagctgcagtttcttcattactggccttccacaggctatttaattatgatcccattttcactagcaagactgctacagcctattataactgtacaaataatatcaggagttcaaaagtacgaccatcactgaagttatacatcaagttttgaagggttcctatccctcaattgttccttcagatgtttgattactctttccaactcaaccttttgggcttctcgagctgcaaacgatttctcaatcatttccctcgtcccaacttccctccttggctggtaaactccatgatctctattcatgtcacttgcatctctttcatgagcatttttcagcaaccaaattttagtaagatagtacagcgtttttgtagaaacttttgtcctgaccaattcagtacttgcatttacaagaatatcagaagaaatgccattgtttcctacaagaaagagataacagggatgcattagcttctgctcaaaaaaacagggatgcattagcaaatatcgtgtaatgtcgtgtaatactggtaactcttctttcatcttaatgaaatttggtcggcgtcattccgccgacccggcaaaaaatagcaaatatcaacttgtatcctgtttgcgttactatacatggtaacacagattaagatatccaaactgttattggaattattatacctgagttctttctgctgatttctatgcaatcttctataagagaacctgctgttgcttgatttgatgttgaatcatcttcattttctttttcagtacctttcaaagatgctaattcatccttgtctgtcttggctctattatctctctctaatgcaaacatgcatgttcccatatcttcagttgattgctgttggggagcagcacccagcaggacagcatcaagctcataaccacaattgcgttccatcataacttcatcacttgtcactagaatgtcttcaggtgttggcagcatgccagctgttgttgcagcttcaatggcttcattactgccagtactagctgcactctcaacgccatgatgtatcattacttgtccagagttgaaattgtttgcctcataggcactggcatggtcttgtgctttctgtttactttgtaggagagatatgtgttgttccattttggtgactgacccacaaaatgattcatcagctgaactatccaagactctcattgaatcagataagtattgctcagcatcttgttgcacaatcatactgttatccttccctctgatgaactctgggacagaatacttcacaacgtctgcgatttgctcttgcctagcacattgtaccataattatattgtttagcctctcaatcagaggaatctcatccagtggatcctccatggtaccaggtaaaggcacactggtgtcaacatgctgctttttgcaagaattagccccagaaagctcttcagtgtttcttttcattggaataaaaagggaatggggttctcttgtgtttgcatagttagaaacatcagtagagcaagccaacgaatatggctcccaccatcgcgcatactccagtgtcaccccaagcttatagtgtggaacaaccaatgcaaactttcgatagccaaacgtatatgttctccatgccaccttccagtttgagttagcgcgagcaatcgtcccaggcacatcctgatcaaagccaaactgccttgcaacacgatgcggatgtattgctcaatgcagcccatgccgacgagctcacattggcgcaaacatcgcgtaaaggataacagcgtattacttgtcattacatcctggacaacccaagtgccagccttagcttccttgggtggcagagcaatgctgcgactcccgtatggcctccactcaaacttgtccggtgacatgaacacgccatgaacaaactgggggtccagcgccttgtggacgccgtgccaccgagcagccattggcacacggcaagcatcagtggttgcagggatggtggtggtcgccatggcagggcggagctgagggaagcgctcccagacccagaggtggagaatgtgcatcggcgccgtcacctggagcgcctcctcctccctgtcgcgcaagtccaagaagcgcttgagcgcggagaggtcgccgtagatgccggcgagcgcggcgggcgcgagcgccacgcggatgccccgcgctagcagggcggcgatggggaacacctgaggcccaaccacgtcgaacggcggtgccgcgaagacgaagagcgacagccacatggccagaaacgccccgtgctcgatcaggtcggcgccggcgctggcggccgtctcgtcgtcctcctcctcctggcgcttaagaaagtactgcacccacccaggataggagggcttcttgtacttgctccggtgcagggcgctccgaacggccatgagcgcgtccacgtccccgacaagagcgtccggcaggcgcgcccgcacgggcttgccaaagagcggcaggccggcgagcacggtcatgtcctccagcgtcaccgtggcctcgccccacgggaacatgaacgtgttggtgtctgcggaccagaacgcggcgagctggagcagcgtgccctcgtcgcggcgtacccggtaagccgtggcgagaatggcatccaagatgccaacactccgccacaggggctcgtggcgcgggcggagcctgtcgacccactgcctccacaggccaggggagccagcccagcccttgaactccaccacccggaggaggccgtggtggtcaggaacggggccgccactgcagagcggggaggagggcaggggcgggggccggccaccggcggccgcgcgggggaggaggaagtgggccgatcggacggcggggcgggaagggtcgccgtcggagacgatcgggacggtggattcttggaccaggagctcttcggtgccggccattgcggctgcggaaaattggtttggttggggttttggtgaagtgtgaggaggaaggaaccgaggaggaggaaaggaaaatggggggcggatgtgtgtgactgtgtgagtggggactactgctagtactcctgtcctagtgtggacaagtgcgagattgtaggtacttcgtctcaactctcaagccattattgatgtgagcttccttaaatgggtattgctagtaacaaaaattactttatatatttgagtggtacttgttgccttgtactcctagggcttttctgttccgtatgagaaaagacatttatcgaatagccagctgtcgggtccaaaacatctagtcaatttaatagccaattcatacaatagttacctataaacatatactacacaattaatatctggtcttacctgtcacacatatatcttaaaatccgtgctgcagctggctacaaatatgtagcctgttgcttttctctctcatcttttatcttctcgaaatatgtttatagctagcttatattccgctattgtacctgctctgatatttgtggtcaaagcgtgggtctataccacgtgagactcaacaagagacgttgctggcttgctccttccgttccaaaataatttattttttactcttttcacacatagtaataaaaaaagatagatctgaatcacaccccctaaactattaggtgagtatgaattacccctaaaatccaaaaaccaaatatatttcgccctcaactatcaatacgtggcactctagtcagcattttttttaaaaaagaaggaaaaagtatgaattaccccccttaactataaaagtcgatcgaattacacccttaaaccacaaaaccagacattttcaccccaaactatacaaaccggacaaataacccaccgactcaatccgcggtggttttgatcctacgtagcagtccagtcagcattttttaaaaaatggtgggccccacatgtcagttttcaccctctctgtctctctcttctctctctttccaaatctatctctcttctccctcccctcccctccatccccaccggcagcggcaagctgaggatggcggcacgcagggggcagagccagttgggggtggcaaaggggggccgagggcggcggtggtcggcgacggaggcgaaggccaatcgggagcgcggtgggcggcaagcagcaagctgatggtggcttggctgcgtgcgggcgggtggcgaaatctcgcgcaatcccgtcacaccgtctgggagccgcatgagccggtgagcgccatcgctcgctcgagagcgtcgttgtcttcgagcttctaccgcgcggcgctgtcgcgggctcctcctcctcatcatcaccgccgcaatcggcactgcctcctggttgtgatggaccgcgcgatcaccgcacgccgctgtccaccgcacgtccctatgctcctctacccatcactcgtccccgcgcttcgaccgccagtctttccccgcccgtccccgtgcgccaccgcccaccgcctgtacgccaccacctgcccaagtgcttgcacgagagagagagagagcaactgggaagagagagaccgaggaccgattctccctccctgccgttcccgccaccgctcgcctagctgcgcccgtcgccgctcccgccaccactcgcctagcgcgcccactgccgctcgccgccgaccagttccaatccttgctgcgctgccgccgctcgcccagctgctcatgtccaagttccaacgccaacagcacacacagatagaagtgacttgtgggccctatatttttttttttttgctgattggatttccacgttggtgccacatgtatgccacgttggatcaaaaccgctccagattgagtcagggggggtaatttgtctggtttcaatagtttgaggtttaatatgtctagttttgtggttggggagggggtaatttgtacgatcgcaatagttcggggggtaattcgtattttttccaaaaaagaatcgatgagcctcacctgatagtttcaccctctctcgagcaaaaaaatgtacaactcacactccaactccgatgtgtcttggatcctttgaaaatttttccacccccactttctccctagtcccctctctctctctttctccccttacctccatctctctctttcactaagagggggaacgccaaagagggagtcggacgagcagaggcaatccacggccgccggcgtgcggcttgtcctcggcctccgccgcgagacgacgcagccgctggcgcacctcctctacggtggttgacggggggtggggcggaggcagtcaaggcggtggagggggagctgccatcggcgtcgagggcataggtagtcggggtgacggatggggagctgccgtcatcggcgagggtggaggcaattagggtggcggagggggaggcggcaggcagatgcagaggggggagggcagctttaggcgcagaaggggtagtcgacgacggtggctgacgggggaggggtagaggtagttggtgcggtggagagggagccaccgtcattggcaggggtggaggcagtcgggatgcgaagccggagccgaggacagtgaccaatgggccggggcggtggcagaggcaatcggggcggtggagggggagccaagggcagcggtcgacgggggcgggggtggaggcaactcggggctgccggcacgcggctcttcctcggcctccgcaacgagatgcatgcacccgctggcgtgcctcctccacggcatctgatgagagagagagaggtgtgagaggggaaatagatagtgagaagagaagtatgacaggtggccggtcccattgatttttaataaaagaattgctgactggactgccacataggatcaaaaccgcttgcaaagctgctattgttttcgggtttagggggggtaattcgtactcaccaaaaagtgtaggggctgtaattcggacttttcccataaaaagagaaggaaaagtacgaattcccttgaactatcgtggtcgatcgaattacccctggaactcaaaaaacaaacatttgacacccttagctatacaaactagacaaattaccccctagcactattgtaggcggttttgggatagacttgctggcgtggcatttcagcgtggaaaaaatattttaaaaagtaatgaacccatatgtcagtctttatatctcctctcttttttttgtacctccttcctccatctctatctacagcggcggcggcggcggagagaagccaagggcgggccggccggcgctgtccgcaggggaggtcgagcgccacttctcctcctcctctttatcctcgccgtcctcatcacaccacctgcgcatccgcctctagatctccttgcccccattgtgatcggaggtccacgtcgtctgcgagggggacgtggatgtgttctatgggaggtggtcacgccgtgaccgtccacggcggcgcgcaaatggtgggagcagtgaactccgagagggagccggaatgaggcggagacgaaggatgccgagagggagtgggtggtggtggagggagttggaggaggcggagacggaaacgaaggaggaggggatggaggcaggagggagggaggaggtgcataaggtggcgcgcggggtggtagaggggatgggggagggggagggggagtggaggtggatggggaaggggaggagatggaggcggacaaaaagaagtcgtctgggaggatgatgcggtggcgatggaaggggtggcggcgtcaccatgggggttggagggaagggagatcagacgggggcagctcccacctatgggctgtcggcaacgccgtctggccttcgctccgcctccgggccccccactctggctccctcctggagttcgccgctcccacctccgcgtctcgcgccgccacccaccgcgtgcccgcctttgcccgccgctcgacttgcggtcatgctcgacgacacgagagaaagagagggaagagaagctatgacatgtgggtcccaccactttttttttaaaaaaagaaaatgctaactggattgccatgcacatgccacctgttgacggtggttatcgatcagtttcgaccgtcaatattaccaaaatagaggagaactagtaatgcttgcaatgcatatacatgttagaataataatattccactagtattaggttcactaaccttttgcagagaataaccataaagtggaggagaatcgacatcaactcaaacgataaatcaatcggacgatgtcgagaatcagtcttatgcatgaatgggccaagaactcagaattgacatgatgaattgggccaaaattcacaagtctgtgaaagagagcaaaggaggaggccacctgccgattttgggccaggtcgacccagcccatggtttggccaaaccccccgcagcgccactcgatccagggttctcctggatggctgagatgactccccaatgatggttggtgggtattaccgacctttccaaccgtcgcaaccgtcattctcaagttataaaaagagctctcatcctcacttcactcacacacctcaagcaaagctctctcatattctctcaagtttagtttagtagtattaagctagtggaataggaatagagtagaaatcatgagtccggaagtcttcggaagagttcgggtatggatcttgtcggagatatgggcatgggggtatgtgaagtagaggggaattactttccctccggtcacatgactctgcaggttggccccgctcgcgcgtcacgcgagtcgtggaagcgccggggggggggggggggctcggggcatgacgtcacccctcaggctcttccgcggcttcgccccgaggccctcacccggtcaccacgtggcagagggagagagcaagaggggagcacaggctgaacagccataaatgtgcgatgccccaactgtccctcaccgcatttaatgcggtaagggcagacgtgcggcgtgccttacgaacccttgtccatcggatgtgaccggtctgtgaccggcccgtctccgtcacatccgatggatagggcaatcatgtcctcacgtcgcccttgtccccagtggagtgggggtgggtatgacccgtcacatccgagcgccgctcgaggaagggctgttgcgtgtcattgttcatttatgagggaatgacagggctatcccccgcgtcaggcaggggacggcgccgggttccactcgagaatcggttattgcttagcttcgggagaaggcccggtttaaagcccaaaaagtggagtggggttcccccccggtggagggtaggtagaggcggcacatgtggtatccccttaagctataaaaggaggaccctgcccattgagatagggggacgactcccagaaaacctgagctcgagaggagaaggagcaggtgcgctctctggggggaagaaacccttgtaaaactcatcaataatcccaaacacaggagtagggtgttacgctctatagcggcccaaacctgtataatcccactacgtgcaagcttgccggtaatcttagggacgagcgagtgatttccgagaggcgggcctccgcccccggccgaactcacgaaagggggggtctcacgacctcccgctatcggggggccatccctcgacagctggcgcaccaggtagggggcggttgcgcgttccgagaggaagttgttttcttccgtcccaagtttctccaggccttagccgaccatggtcaaggtcctggaagtagaggaggaggcggtggcatttacccccaccccgtccaggagtggggattccggcgagagccgaggtcctcgtcaccgtcgccatggttctcgaacccctccccgccgcgaaccttcgcggagggaggatcccactcgttcgggtggttcggctctctctccgccccctggcggagggagaccgcgacgcgtcagggcacgccgccgactcgactatggagacggcggttcaccccaaggcgcgcttcaggcagcaggcacccttctacggcatcccccggtaaacccggagccggagactcctgttcagcgctggctggacgacgtggccaacttggtcactgctgcccagcggtagttggctacgggtggccgatccactgccactggtacatcacgtacctcggtcaccctctcctcgtcggcgaggagaagggctcgtcgatcggccacgatctcgaggcggtccacggttccaacatcgtcgggggcctcgggaagccgaaggcatcatgacggcctctacgggacgcaggacgctcgagtaaacatcgagcgacgccgggacgagcgccgagctgcccgtatgggggaaggcgcctcctcatctggagcgccacgctcctcttcacgaggcggccctcctcccacactcacccctggggggacgggttgtagggccttcgtggcgagtctccggaatgtccggtggcccccgaagtttcgccccaaccttacggagaagtatgatggtagcatcaatccctccgagttcctccagatctacaccacggttatcatggcggcagggggtgacgaccgggtcatggcgaattactttcccatggccctcaagggtcaggtgcgtggctgattgatgacccagcccccgactccattcactcctgggaggacctatgccagcagttcatcacgaacttctagggcacgtatccccgcccgggggaagaggcggacctacacgctatacggcggaaggatgacgagtccctccattcgtacatacaatgcttctgtcaggtccgcaacactattccgtgcattccagcccacgcggttgtatatgcattctggaacagcgtgcgacataatcgtatgctggagaagatcgcctccaaggagcccgagaccactgccgagcttttcgggctggcagacaaggtggcccggaaggaggaggcgtgggcctggaactctcccagcaccggtgcggcggccgcggctacccccgagtctgccccccgctctaagcggcgagataggagaggcaaaaggaaaccagcccgctccgatgacgagggccatgtccttgcagcaga

SEQ ID NO: 68928 - DNA, 38132 bp, Oryza sativa
  unsure (1)..(38132): unsure at all n locations
gagtctgccccccgctctaagcggcgagataggagaggcaaaaggaaaccagcccgctccgatgacgagggccatgtccttgcagcagacgggctcacgcaggccccgcgcaaaggaaaggccaccggcgataagccgagcctcaccgttccctatggcgagggccggttggcggacaagtggtgttcggtacacaacacctaccgccacagtctcgccgactgccgctcggtcaggaatttggccgagtggtttcgaaaggctgatgaggagaagcggcagggtcgacgggagggcaaagcccccgcgacctcgaccggcgaccggtgagaggaggccaagaacaaggcccccgccgatgatggcggagacagtgaggatctggatttctagatacctcaggggaccgtcgccacgctcgacgggggggcttgcactcacacctctcgccgaagcttcaaggccatgagacgagagcttctggccactgttcccacgcatgaggtggtccggaaggcgcgctggtcagaggtgaagctcacattcgaccagagcgaccatccgacgatgctcgctcgggggggaaagttggccctggtggtctccccgaccatctacaacgtcaagatgaagcgtgtgctggtggatggcggggccagtctgagcatcatctccccggctgcctttgacgtgctcaaagccccggggatgaagctccagccgtcgctcctaatcattggcgttactccggggcacacatggccgcttggccacgtagagcttccggtgaccttcggtgactccaccaacttccgcaccgagcggattgacttcgatgtggcggatctcaatctgccctacaacgcggttctaggcagacccgcgttggtgaagttcatggccgccacccattacgcctacctccagatgaagatgccgggtcctgctggtcccatcaccatttttggtgatgtcaaggttgccctcgcctgcgcggagcagcgtgcagacaacctggcggtggccacggagccacaggcccccgaggcctctgcgtcccgcgcttccaagaagcacctcacctcggctgacgaggtgcccgtcaaggaaatgccccttggcgacgatccgtccaagaccgccaagattggcggaaccttggacgccaaataggaaggcgcgctcgtctccttcccgcgggcaaattctgacgttttcgcatggaagccgtcagatatgcccggggtccccagggaggtgtcgcgaccgagaaaaatacattttcccgaacgctagtgtattaatccctgtcccaggaaaagccggggtacaccacacaaacatgatataaaagacacatctttattatatcgataatatttgcattattacaaaggcacttaaggcctgacaatcaaaaataaatagcagcggactagcgggcctacgactccatcttcacaggcgctcaactggggtataagccaggactccacctaagacttcttctccaaagcttctcttactgaaggggggggggaagattgagcaagaatgagtacaaccacagtactcagcaagccacaccggcagatgcatgattaatgcaagggggtacaaggggtaataaataggggttaagttttgcagaaaacagcatttaaaagtcacttagttgcccaaatccattttataaagacgatcctagagttacacagtgttatttaatcaaggccgtgaaccctcacgaacctgccttaacccaaggcctacgatgattcagaccgaactgacaacccgaccctaggtcccagctcgtcccaagccaacccaggccaaccattccacattttagttgttaggcaggttttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtaggactaacaaaacccaaccacgcacctcgagcccagcctaaaaccattttaggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataataaggtcataacaaaggtaaataggcatggctaaataaaacagtgataacgtaggaatttaaataacgtgataatgcattaatttaaatcaaaataattttataaactgggattcaatatgctcaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacagggttctttaggttataacaaacattaggagacttgaacggatcgattcggagctcgtatgaccaagatatgatcatccgaagtttaatgctgttacatggagatttgcgtattattgtaattaggttttacaactataaaacatgtgtaagcgctagcctggaaaagacaggaaggctgcgctgttgacatgcggactccacatgccaacctaagggaccacggtggaccgggtacacagagacggtccacgggtcgatggaagcagatcccgtgtgtcaaccaaggcgagtggccgacaaacggactccactagacaccacacgggctgcacacgtggaaaccacgcagctaccgagcgggcacactaacacggtcaccacacgcacaagcgaacgactaccgacaccggtacaggggtaccggggtcgacaaccgcacaacgggcacgggcgacaccgaaaggacgaggacggggcagcgagaggagagatccttaccaccatgcgatgaggcgagggaacgacaacgacgaacgggcgcggcggagacggccgggaacgacggagacgaaaggcgaggggacgacttcggcggcgatccttggacgaaggcgagacgcggccggcacaaggcttgacgacgcggaggcgaggacgaagacgacgacggggctgcagcggcacacttgacggacgcggacgacggacgagaacggcttgacggagggacgaacgccacgacgaccaggaacgacgggaggacgacgacgacgacgacgacgaccggggccggcgaggaggcgacgagggacagctagtagcagctgcacggagacgaggacggcatggaacacaccgctgcgaatccgacgatggaggcggcgccgcgagacgacgagccggcgaggaggaacgatgacgacgacgacgaacaccggcggggttcggtcgaaggggaggcgaggccaagggcgaccttgccactgcgatgccggaggaggagatggcgacgttggccggcgcacgggcacgacggaaggggttgccgaaggaactccggcgaggcggagggcgagaccgacgcgggcgacggcgttccggcgaaaccaagggtaggccggggtggaggtcgacgcggcgacgccgagggaggagacggcgcagccggcccgcacctgagcggtgcggcaggggcggctggaggcagtacagtggcggcaacgccactgttttgccggcgaggacgcgtctccggtgatttccccgcgaaacggaggtctgaccgggggagaggaggcagctgcgaggccgagggcggcgacggcgcgaccggacggcgctcgggcgaggagggagaggcggctggaggccgaccggcgccggagagagaaaaggagaaggcggggagaggtggtgcggccacgggggagctcgggaaggggctaaaacaagagaacgcacggagggggttccattttataggtgaggggagggagccgggcatgggagagggcggaacggcgacgggaaacacggccggcggccatggaaggcggccgggaatggcgcggccgttccgggcgattgggggcgccattcaagggggaaaacgggggaaatcaaagaggaatcaatggggattaattacccctatttaattttggaatcccatgattaaatcgcacggatttgagggaggaaaggagctagggttcacgggagagggaggaggccgtgcgggaggaggaagacgaccggcgcgtgggccccacaaggtcagcgcgcgtgcaacgcgcgtgcggcgcgcgtgagggggggcggctcgggaggctggggcagctgggtggcgtggcttgggccgggcggccggcccaggaggagaagagggagtggcggcctggggaagagagggaggaggagggagctgggccgaggggaaggagaggaggcccaagagaaggagggagaggaggagagggagagaaagagagggaggaagagaggactttggccgtgggccgagagagagagagaactttgggccagaaagggaggaaggaggattatttttagcttttctttttagtaaactttgatcatagttgttgttgcttaataaatatttccggtgctctgaaaattcatgtaaaatttgagggctctttttagaccaaggagaatttaacaaaaattctctggaccacattcgaatttttctggcacgtattttagtgtttgccaatttcttttcgaattttaattaattctattattctttttagaggatgatttttatttcgggatgaatttatcaggacgtgacaggaggtgatcgagcactgccttgccgtgcggccggatgcgcaacctgtccggcagaaggtgcggcatcaagccccggagcggcaggccttcatcagggaggaagtggcgcggctcctggaggctgatttcattcgcgaggtaatccatccggagtggctggcaaacccggtggtcgtcccgaaggccaacggcaagctacggatgtgcatggactacaccgacctcaacaaggcatgccccaaagatcccttccctctgccacgcatagatcaaatagttgactccactgcggggtgcgaacttttgtgttttctagatgcatactctgggtaccatcagattcgtatggctagggaagatgaggaaaaaaccgcctttattactcctgtgggcaccttttgttgcacaactatgccttttgggttgaagaatgcaggccctacttttcagcgcatgactcgtattactttaagtaatcagatagggcgcaatgtagaggcgtatgtcgatgatctagtggtaaagacgcgccaccaggacacgttgctacaagacctggccgaaactttcgatagtcttaggtccacgcgcgtaaagctgaaccccgataagtgtgtgttcggtgtgccggcgggcaaacttctcagttttctagtctcttcccgaggcatagaagcaaatcctgagaagatacgtgcgatagagaggatgcaccccccctagcaagcttagggatgtgcagtgcgtcgctggatgcatggccgccctgagtcgatttatatcgaggctgggtgagagggcgctgcccctattcaagctcctcaagcgctccgggccatttatatggacggaggaagctgagcaagctctcaatcagctgaaagcttacctcacttccccccccatcttggtagccccgtgaccagaggaaccattgctactctacttggccgcgaccccccatatggtgagtgccgccctagtagttgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtattttaaataaatggaattgcatttcatgaataatttaaattgaaaaaggtttttaaaatcctcttttggccttgggccgaaagtcggcccaaaaccttctctctctcttcccggcccaagccggcccagtccgcccgcagcagccgcatgcgcgcgccctcagacgctgacaggtggggcccgcctgtcaggtcttcgtcttcctctggccgcccgccgcccgagccctagcgccgcgccgccgccgtctccttccaaatccggccgcccctttccgtttccgatgaaattaatagaggggaaatgatacccgggatcccctctatcttttctcttatggaatcgtcggctaattcggtttgtaaatccgtggattcgagttcgattcggatcgatctctctcctccgaaccctagaccttccttcgcgtcgccggtcgccgtgggccttcgccgtcgcctccttgcccctagaaaaggacccccaagcccgccgctacccgccgccaccctcgccttcgcctctcgtcgccggtagagccctagcaccgtgcagccgtgcgccgccgtcgctccggtcgtcgtcgctgctcggggaggtcaccgtcgtggtcaccaagtcgtcgccgacctcgtccgccccaccgccgtcgctgtcgaccgccggaacatcgccgtcgtcgtcaagccgaaggtcgccgccgcttcttcctcgacgctgtcaccgtccgttgatcttccgccgttgttttggtcaccggtgagttcgccacgtcgccctctacgtgttggtgtcctccgttcgcgtcgtcgcgccgtcgttcgccagcgagcttgcgcgcccgagccgccgccggtgatgacgtcatcgccgacgtcatcgttgccgtccgttgtagaccggtcgtagaccgttagatcttggccgttcgttgtggataggatcgatctcggccgttcgtttccgtgagccgccgccgtgcacccggtccaccgcgaaccctagccgctgacgcaataaacccctttttccttttaaaaataattcattattacgtcataattcaattaaaatctaaataaataatttaatccgatttaatctttgaaaattcgtaactaattcatcttagctcggatttagttggttcaagtctctaaatttttctaaaattgagatctacatgttaaaaatatccacatgtactgttcatgcttgtttatgtgctgttttggtgttttgcttctttctgtttagattccgacgtttccggagagtccgttttcgtaggagaagaatttgaagagttccaaggccagcaaggcaagtcacatagatcccaaacaaccctttgagcatgttgatcccgtttaaagactattgtttctattcaactattgcatttattttcgaatgtcatggggtggaattaacctattgtttgttatagcccttttgttcttgattactttattccttgatatcttgggttattataaattgactagttgagctttatatattggttcagctagatattagatatgattgcttagccatgcatagaaacattagcacactattgggataacttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcacgagtttcggttgtgaaacattaatcgtgccaaccacaagccagcgtgggcaacggctttaccttttgtatagcatggttcattgcggagcaccagactgagaagtggcggagataagcccacgagggtcgctggggagtccatgccttgtttataagggggtgattatgatccaggaacggtgcactgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattactacttaactattttattaaattctgaaatgtttattaaatgttgtttatgcaaatgaaaccctactatgccatcctttgttatcctatgcacttgcatatttgctgcgtggcttgctgagtatgtcatatactcaccttgcaatcattcattagaggaggagttctacagtgatgctgatggtgtggaggattaggtgtagccctggtcaagctgcctgtggagtggagtcgtctgcgccgtttatcttatttttttttcactgcttagatctttattgattgagaggaactatctgcctatgtaatgacattttattcacttattaattagagtaataattgtactctattatcaatttgttattgtgtgcctcggctgattcctggacgagggttcacacacatgtaagcgtttggaattttggatagaaattccgggcgtgacagtagttgagtgtgaggaaggcgaacaagagggccctccggctcgcgatggcccctcatcccccgaaggtctagcgcccaaagcttccagcccccgggagggccccgaggcccccaagggaggagcgaaggctttggcaagtggccctgagcttgatgatcccgaggcagtccgggatccccccgggaccaccgaacaggtgcgccccgagtcaccagcccctgacagcacgaatcggccccgccgaaaggtgcagcggcccgtctacttcgtcagcgaggcactccgagatgcgaaaacccggtatccgcaggcccagaaaatgctttatgccgtcttgatggcctcgaggaagttgcgtcattacttccaagcgcatcgggtttccgtagtgacgtcataccctcttggccaaattttgtacaaccgagagggtactggacgggtggtaaaatgggccatcgagctggctgagttcgatctgcacttcgaaccgcggcatgcgatcaagagtcaaatcctggctgacttcatcgcggaatggaccccggtggatgaacctgttccatccgatgtccccttctcccctggagaataagaggatccaaacgccgacattcgcggcgggcactggattatgcatttcgacggctccctcaaccttcaaggtgcaggtgccggagtcacgttgacctcgccaaacgaggatgtccttaaatacgttgttcgtctcgacttccaggccacgaacaacatggcagaatatgaagggctcctcgcgggattgagggcggcagccagaatgggcatccgccatctcctggtcttaggtgactctcagttggtcgtaaatcaagtacccaaagaatatcagtgcaccgaccagcaaatggaagcatacgtccgcgaggtacggcgcatggaacgcaacttcgacggacttgagctccggcacgtgccccaacgcgacaacacggttgctgacgagttgtcgcgtgttgcgtcggcacgagccccactccccccggggactttcgaagaaaggcttgcgcaaccatcggcgcgaccgagccctttgagggaccccaacgacgcgcccttcggcccaacccctggcgacccgcgcccctcggggcccgaggaggtcaaccccgacccctctcgtcaggttgtgtggatgaccgacatccgggcgtatctcgacgggaatactcttcctgaggaacgcgcggaagctgaaaagctcgcacgcatctccaagcggtacatcctcgtagagggggccctctaccggcgtgccgcgaacgggatactcttgaagtgcatttctcgggagcagggcatcgagctcatagccgacgcccatcagggtgagtacagagcccattcggcctcacgaactttggtcggaaaagccttccggcaaggtttttattggccgactgcattacaagatgcccaagaatgggtccagcggtgcagggcatgccagttccacgccaagcagacccaccagccggcccaagcattacaagtcattccactatcttggcttttcgcagtctgggggctagacatccttggaccgttcaaggcggctcgaggcgggtatcagcacttgtacgtcgccatcgacaaattcaccaagtggcccgaggcctacccagtcgtcaaaatcgacaagcattctgctcttaagttcatcaggggcatcacgtctcgattcagagtgcccaatcgtgtcattacagacaatggcacccagttcaccagtgagctgtttggcgattactgtgacgacatgggtatcaaattgtgctttgcctcacccgcccaccccaagagcaacggccaagtcgagcgagccaacgccgaaatcctcaaaggactcaagaccaagacgtacaatgtcctgaagaagcacggggattcatggcttgaggagttgcccgccgtgttgtgggcaaatcggaccactccaagccgcgccacgggggaaacaccatttttcttggtgtactgcgccgaagcggtcctaccctccgagctttccctgggttcgcctcgtgtcgcactgtacaacgaggccaaccaagatgaccttcgccgcgacgatctcaattatcttgcagaacggagaaggtgagcggccttccgcgccgcgcgctaccaacaaagcctgcgacgctaccatcaacgccacgtccgggcccgatcactacaagttagcgacctcgtcctacgccacgttcagtcgcgcctagggctgagcaagctctcgccaatgtgggaaggaccatacaaagtgatcggagcgccccggccaggctccgttcggttaaccacggaggacggcacagagctgcccaacccctggaatatcgagcacctccgtcgtttctatccataaaatcgagattttttgctttcctagcgctcaggccagcacccgcacaacccctcggtttgtgcgggactggccgggggctaccactatatatccttttttcctttcacaagcaatgatttttttctacttcttcgcgaaggccgttttttctccccttcctctagcttgtcccgactcaaggaataatccgcgtttattctaaaaccctaagtgctgtaaagcggcctgaaaaccgccgaaagggagcatgaacgcgggccgcgccccgggttgtgccgaaccccgggggatcggaagggcctacacacggtcgtccccgacccctggtcgtcgcagcctcggcctggccagtcccactgggcggctcccttggggcgatggtcttgcctatcaccacttaggttccgtggaccgaacgcgggtttaccttctcgctagaacaagcctgaggggggggaatggggccaaaacggcatatcaatcgcaggctgtctaattatccatttctgccttggttttttcttctctctatgtcacaggcatccgatagaaaaagcaaaagagttaaagggttttcagttgcagaacaagacaggatggcacgatggcctaaatacaaaaagtgcctgctacgggcacacagcaaaagggaataaaaagcgtgagcggtcacggagtgcccggccccccgagaccggcgccactaacgatgtcgtcccagtcgtcgtcgccgtcgtcgcccccgcttccgctctcctcgtctgaggtaagcccggaggtgaaccggggggccgacccctcgaagctcgagacgatcgcgtcggccgcctcccggacttgcacccgggcccttgcttcggtccatgggggaaaatcttcaagcgcacgccacggctcgaagtcggggtcgcgcgcttggtggctcgtaaggaccagctccaccgcagcccgcgccaaagaagccgacgaacactttatggttttgccgacctcctcctccagcctctccaggtccgccgccagcccgtccagccgaagcgcgagtgccggctgtgtgggcggaagcttgctatcccggcgcgcggagatgccgactcgacgccccgcgcgctccagccggttgactgcgttggagagctgcccgggcccgagcttgttggtgaggcggagggccgcaatctccccatcctcatcctgcaccaggcgctccaggtcggcgagggtactctgagccgtggcaagctggctcgccaactccgcgccgccggacggcccgctcactgtcaagtccttctcccgggcctccagctcggaggccttcaccgctatcgccgcgcgctcagcgcgggtgctctccagatgacgagcctcgcgcccggcgacagcctcctcgcgtctcgcgagttgctcgctcagccggcgcgaggctacctcgcggcggcccacctcggcttcgcgcttggcaagtgcagcatcccgttccctgcatgcctcttcccgcagccgtagctcttccgcgcggtgatccggtcacgctcggccgcggcctcttcacggaggcgaagggaagcctccacctccgccgccgttctctcgtgagtggccaaggtggactcccgctgatctagcaggcgcgctcgctcctccagctcctgggcccgccgcgcctgttcttcactgcgcgcgttttgctcgcgctggttccgatcgaggacttcgatccgccgacggatcgtggcttcaaactcctgtgcggagcgagcacggtcatccaaggccttgcgctcagcctcgagtgccgtcatccgagcccgcagagaggcgttggcctccgatgcccgccgctcatgggcagcggctgcgtcgaggatgccgcgtgcatccctgaccctcttcgccaagtcctcgacgtgagcctcatactggaggcggatgtcgcccagcgcttcgtccagggcgcttgaggcaatcagcgctgcctgcagctcctcctctgtctcccgcatgacggagtccagcgcctcctcgcgcgcctggatttcggctagttgggtttggcgcattttgcgccccaccctcaccatgtcatccacggtgcgacgcccctcttcgactcgcgcacggtctacggcgagcggtgcctattctgcatccagggccgtccgctcttccgccagggcttgaatttgggtgttcagccctcttgtacggtggagtcggcggcggcgagcacctgcagaagtggctccatgctcgccggagtcagggaggaaaaggccgcggtccgtccccgggacaatggggtactgctggatccaccgcgagactgggggctgctctcggctccccttctacgagacaagcctcgagggcgccgcaagcgcaagagggaacggctgtctctctcaccccccacttcgggtcctcgggtggattcagcctcggcctcaacctcgggctcgggaccgccctcagcctcggcctcgacctcaggctcgggaccggcctcggcctcaacctccgcctcgggctcgggaccgccctcggcctcagcctttgcctcgggctcggggccacctctggcttcggctcccgggccgcgtcttccttcaccccccgatcctgggtggtgctccgcgtgggccctggtcctggagctgccctcgagacgagcgtcgccactcctgtcgcccgcggtgggtcggattcctcctaagggtcgctcgggatcgggcccggtgtgtgacctctgggccccgccgcgaggctgcgaaaaccccgcggccttggattggctgggcccagattaccccgaccgttcggactttttcccacacgaggggcctgaccctgagattccctgagaaggaatctcgctacaagggaacccagatcatgttaacaaaagaaaatgaagggacaagagaacgggttgagtaagagcaccgaagtgagcgccaacaatcgtacctacggggagggcggttgaaggtccacttcgggggctcgatgaagctcccccggcatggctccgtttgccctatcttccggagccgcttccttttccgcctagtctcgggctcggctggtcgtttgtggcccactagcgaacgatctgttgcgcgctcggcaccccctacacgcgggggagagggtggtcgggaataggtcaccttccgtttcccctttgggtcaccggcggaatcgcctccgggtccgcggctcgatccgggcgcccttgagccgccgccgcctggaccgccggcacggcttccgccagcagtcgcaccaccgccgcccccgccgacggcgctaccgctggcgccgcctcggctggaccggctcctgccggcgccgacggctaacatcacggccaggatgctctcccggtcgcggtcgcagcagaggggaagaatcccatcggggattagtgttggctcggcggagtctaggcccaacacccaccgaatcaccctcttcgcgtcctcctcaccccagtcccagggctcgcccacatgcgtccacatggggtcgttgggaccagtgtattcccacactccacgggatcgttcctggagaggtgcgatgtggcggcggaagtaatcgccaaagaccatcgcccccatgaggcccaggctccacaagcccctgaggcgatcccacaccacgtcgtattcctcacccaactccgacgtcgccaaccatgcggcagacctttcgggagggccagcgggaatttgaagtcgcggatggtccggcaacgtagtgtagaaccagtccttcttccagtcctcccatttcttgtggagctagctctcgatgtactggcccgctgtgcccggtcggggctggaagtagcatcccccaccaactgcgccttgcagcagctgcgggatgaagaaggcctggaacaaccgcatcgtcggtcgcaccccaatgaacatctcgcacaaatgcgcgaagatggccagcgtcatcacggcattaggtgcgagatgcaaggcgtgaatttcgtacaaatccagaacttcatgtaagaatctggagaacggcgggatcaagcccgccatggcgaaggacaagaggtgcacggatcactccagatatcgcggccacagcctcgactctcccgcccgcacgacggcaccatccggcatgatcttgcgaggaaggctaaggtgcctgtctgccgtgatgcgggaggaagggagcactgtgtcgccggcgtcttgggccatggcaaccggcggagaggtgatggagagcgtggagcacgagacagtgtggggtggcgaaaatgttagggttcgagaagcgaaaggacgagtgggcggttggcgaaaggaagaaggcagagtctccttctccgcccccttttatccttgcctcatccgcgctcgcctcctcgtttcgcgcccccataactgcccttacgatcctcgcgcccgcatttgtctcttcgcatcccgcgcccaatcatcacgtcgcccgttgtatccgcttccgcctttagtgtgcccgtcagtggcacactcgaggtggagtgtgccacggccatgagcgcaagttgggcaaactgtcaccactaccgctgtaggagtagcgggcgagagaatcgaggcgtggtctaactgaccccccggttatcgcgcctcaagtgtcttcatcatgagcgcaatcagaggcggtcaaaccgctgttgtggttagtacgccaacctggccacgcggtgatatccttttggattccctgccgggcccacaaccccagctcgaggagtcgtgaggcgccatgtcagaacgatcccaggaaatcgatatctgatatagcgccgggggctactgtcggagatatgggcccgggggtatgtgaagtagaggggaattactttccctccggtcacatgactctgcaggttggccccgctcgcgcgtcacgcgagtcgtggaagcggcgggggggggggctcggggcatgacgtcacccccttgggctctcccgcggcttcgccccgaggccctcaccctgtcaccacgcggcagagggagagagcaagaggggagcacaagctgaacagccataaatgtgcgacgcccaaactgtctctcaccgcatttaatgcggtaagggcagacgtgcggcgtggctagtgaacccctgtccatcggatgtgaccggtctgtgaccggcccgtctccgtcacatccgatggatagggcaatcatgtcctcacgtcgcccttgtccccggcggaatgggggtgggtatgacccgtcacatccgagcgccgctcgaggaagggctattgcgtgtcatcgttcatttatgagggaatgacagggctatcccctgcgtcaggcgaggggcggcgccgggttccactcgagaatcggttattgcttagcttccgggagaaggcccggtttaaagcccaaaaagtggagtggggtccccccccctcccgatggagggtaggtagaggcggcacatgtggtatccccttaagctataaaaggaggaccctgtccactgagatagggggacgactcccagaaaacctgagctcgagaggagaaggagcaggtgcgctctctgggggaagaaacccttgtaaaactcatccataatcccaaacacaggagtagggtgttacgctctatagcggcccgaacatgtataatccgactacgtgcaagcttgccggtaatcttagggacaagcgagtgatttccaataggcgggcctccgccccatgccaaactcacgaaaggggggggtctcacgacctcccgctatcagggggccatccctcgacagctctagtagttttcctttcctcttttgtaagctttacttttattagaatactcttctatatacatttatggtattgaaatactttccgagtatatgaatgcttactttacattatgttcatgttatactaaatatactgctagcttatctgggagatgctttggtgcgggtataatgtttgcttatgcaattactctatgtcatgacgatgatattggagtagtatctgatagtttagacgtggtgtctagattacgggatatcattatttggggttatatgctgcggatgaaaggtgggccgctgatggtgacaactcagtacgggtattcctccgtgcttatatataattctaagttaattccctggggagggtactcctccgtatttagccccggttgtatggtcatgacgggctgtcgtaaggaactcgggcagtcaggggtggcttctcgaagtaccaggagggcatcggatagagagtattagttagtatatcagatgactagaatgtatgtatactatgaatattagaagtataggaatagattatctttttcttttctttccacttagcttagatattttagtatgagaatgagtagctgatgcttgtgtgtcactctacccttggattatcttaacccctgcttagactttgattatcacaagtaacatataaattattaatcaagttctctctacatgatctttccacgggataaaataaatacgatacccttggaatactctcgggtgaaatgctacaatggtatatccgtgtgcttgcagatgaactctgtaaccataatataccaggagtatttctgcgtcgttgttgggaattatatttctagtattgtcgttaagaaataccaacaccacctaggacaaaaccactctgaattgggtcgaggggggtaattcgtctggtattgaaagttcaggctgagcgatgtttggtttttgggttggggggtaattcttaatttttccaaaaaagaataacctcattttatcaaattccagtgcaattattaatcactctatttactccaaatgtatttattcctactttcgtaagctctgatgcagtaattacttaatatttttttcttttgggacaaatagaggaactaaaaatcaacttattctaaggatggatggagtatgtctgacttaataataaaataagtcctcttttctaacataagttaactttttatagaatagagggataggaataaaccattttatttaccttcttatttaatgaaaaaattctactacatgtacaacaggagttaatttctagtgtttaaaatatgtcaaacaaaacaagttgaatttgaatttcgtacatactctcagccaaaactattaaatgagttttatttgttgtacccttactgaactacctgacaatattgtttttacagtttagtctttttcccctcgtcactaattttttatatagaaccgcaccaaaaaaagaagtattttataacaagaaaggtataatacatgaacatcatgtgatgttgtcctttattcagagagaactactacgttttactatactccctccgttaaaaaaaatgcaaactctatcaatgtatttagacatgatgtatgtccagatacatagctagctaaattttgcctattcttgggatggagggagtattaagcaatgttcaagtgagcaacatagtgtgaaaatttcactttttctatgcgcatatttcctaaactgctaaatggtatttttctttttgaaaaaataatctatagggaagtttttttaaaaaatagattaatttatttttaagtttaaaataattaatacttaattaatcatgtgctaatgacccacttcgttatgtgtatcttaacaatcttttccgatccgctcctttaaatacaatccgtctattctgcttgaacaacttaggcccctaaactaactactccctctatcccaaatattatcccaaatataataacttgtattcaaaatataacaagttctctacgtatattatcttcttaaccaataaaaatataagaacttgagtgaaaaatataacaagttctctacgtatataatgatccttaaccaatcatatgcttccaccattcaaattctccatctgcttacatataccatgtatggaacctaggtattatgacactcatatttaccaggtctaataccattattccaaggcatcacgcccattgatgccgtaacgacaggtgcaaatacatcctggagccttttactggctgcacgcgttaacacgatgtgataccaaccgatatcagcgttggtacttatgaatattagcatgataccgggtttcgactaataccaattggtattagatcccgtaccaatggtatcgtatggtaccgatatacttcctccgtttcagattataaaatattttaactttggtcaaagtcaaactatttcaaatttaactaattttatagacaaatatagtaatatttataatactaaattagtttcattaaatcaataattgaatatattttcataataaatttgtttgaaaatgttattattattttcttcaaacttagtcaaacttaaaacagtttgattttgaccaaaaccaaaacgtcttataccaggtctagtaccttggtatcatacctggtacgtatagcttggtacaagtcggtaccacatactagtgaacaacaaataatggaacacacatctataggtaccgcccaattatcacaagtgccaatcctcttaagcaaatacaagagccatggatacgtactactccctgaatgaaaatcaaactcgatagcttttgactaattatcatacttactatatctatactaattagtattatgcatgttatatcactatattcatattttgaagtacttttcatatgatgctaattttatatttgttgggatcatagaatgaaataaaatattggtcaaagtatattattgaagattatgtaaaaaaatataggttttataatttagtacagagggagtattaggactagaatttatgtggtgttgcattgctgcatcgctacatgagaccagccacgtcacatgcatacattcaactagcaacacagccatgccatgagtagatctgtagaacactgccacatgatgatcgaattaccgacatgcatgcaatagtcattcagacgatgattatatataccttccttcatcgagatggccggcggcggcaagccggcagcggcgaggtactgtggctgtacatgacggtaatgtattgttgcagggaaaggaacaaatggacgaactcgatgtgagcgacatccgatcgaagtggcggccgacgcacgccaatcaggaagagtcgcgcgcatggctacacgacctgttggaagcttgcgtgtgggggtggggtgcgcaacttcggggatatatgtacgtgggagtaattcgacggtgggctgttgccccgagcgaagcaaaggaccatgggatcatgttcccatggtcctcaataaattattttcattcattaaattagatctatgacagtaatccctctgtcctacgaaccgtctaatccctccctatatacacacacaactcctatgtacgtacatacttacgctagagatatagaaagaaaataatagagtttgtatatgatctttcccatttggtagtttacttttctttctagctctatggttttttcccaaattaagcatatacatagcgaccactcctatcgaggtggtaaaagaagcgacaccacgatgtcatctcacgtcacccgttgttccatccttttctcgtcaattccttaaaaagtttttttttattaacgatgtaaaaggcaatcctaggagctgatataaattcatccagatgcacactaggaatacatatatgtacaccctctctatatgatagataaatattcgtctaaaaaaagaaaaacatacgtccataccagatactactattcggaaaaaaaacatatgtttaattacattttatcccttttacgttgttttcatccaaagtgttgagaattagcacaaatatttttgacaaattccatcgaatattaatccccacgaacatatatgtgaattagatgtataatacaatattaaaaaaaatcaaaatccatattaacttgaggatcatagtttgagcaaatacttttttacatggtcctcgccactttttagctattagatttttaagtaaactcgaatgatcaatcctactaatttttaaatgagaaaattatttatgtaccactaaaatcaattagtattgattaacatcataaacaaattatatctactctatataataaatcgaatccagacataaaaaactactttcgtcacctccatcttctttcactcattccctaaagggcgccaaacatgaatctcaactagctacgttgtagtaacttggcaagagtatgcatcattgagttgagatggtccgagtaagaggttaccgttaaaatagagctcaactggcctacttaccgatacaatcctatataaaattatgctccatgcttgtcttgaggagcacaagtatatcaatgtaggagccatgaatcaaggatcgaagaaaaaaaccttagtggctacagtcggcttcacccagatgttagtggggtcggcttcacccagctgtaagtggggctacagtctgcttcacccggtttattttttgggtacatatgtaattctatctattaaaaagacatccatatttcaagataatgataataaatagtagtgataggtgacgacaaaaagttcttttcttggatatgatagacattctgattatttttgagtgtaggtttaaaaaaaatntttattggggtcttttgtttttttttataaataaaatgctcgcgtatctgcgcgagttttctttttagttatattaaaatttaaaattgttacatagtgagaaaataattactactagacccaatccaaaaggtcgatattacaacttggtatttactaattccgaattcaaaatttattccggacctgaaaaattgcagaaataactcaaccacttgctaacgaacaagcgcgctaaaaacaccaccaccattagatcatcacagccgccggagcaggagcggcgactgcgcgggccggcgagctccggaggacggcagccggcgacggcctcccgcgccccatggtgaaccctcgcgttccgtcgggcatcctcggcccctgcggcgcgtggcgggggctcatcatcatcagggagtccaaatgcccggccgcggcggcggcggcttgcggcgccccgccggcggcagcgtgcggcctgcttccccgccctctcccccacgacttcttaccgtgctgatcttcctgctgccaatcgaggatccagctgggtcaggtgttggtccgcaacaggtaagaaggctcagctggttgcgttgcttacgtgatggtcaggcaagtggtccgccattggcgaatccgacgacgcctgggattgcggcgagtgatcgtcgtcggagatcatgaggtggtcgaagtccggccgcttcaatcgcatcgctgatttgggctacgaacacaagaatcaagtgactattcccattttgtggatgcattgccttctacaacattaatctcaagtgcatagtcttattaaaaaaattagtataaatttgtaaaattataaattaagactagagtttcttctatgagaaataattcacaacaaaataaataatatttataatttttaaaataaaataaatgttcaaacgttataaaaaaagtcaacaacgtaatacattttaagatagggagtagtttgcatgggcgtagaggaagaatttcagattaattaccgatcgacgtagcaccgggcgaacgcggagcccctttctccagttgcgctcgtcgttgagcttatcaacctgtcaaaacacagttacattccttcagtccagaagaagaatagtagtactgaaacgatagtaaattcagggaacttactgcccgatcagcttgctgcgaggtctcatactctataagcgcgtgcaactttggaaccgggaatcaaacataatacaagatcaagatcagtgtcagcaacatgctcaatacatgatacacattttttttgcgtattgccaaaaaaaagaaagaaaaaaaactgaaaattaatgtaagtaccttgttactgattagcgcgtcagacttggaagatctcgcggagctaggctcttgcgggtggcatatcctgatgttcttcacgctgttcaattacggaacggaactccacacaagttaatggacatgccacaagttacacatcaacagttaaaccgatctgtcggtctgaccttcctatgatgccgaagatcttctcgaggctgttcctggttgaatcctcaggcaaattctccgcgatgaccattcgagactgtgaaattaatgggagttaattggccatggatggttcacaatgctaaacttgtaataagcatctgaatttcgcataaggaataaaatcttgccgctgacctgcaattcttctttgtgtcgctcggtgaatggctgtgctcgtcgcaccttcttaccgtcgtcactcacaacctccagagaaggaaatcatgaatcttaggattcaggcaataataagaagagattacagttagcaacggcgacttacgagctttgaggatgttcttagagcattcactagcagttggttggtcacccccatagccttgattttcttccaggatgaaatgacagacataggaactgtccagcacatggaaaggaacataaatttctgttaagattttttcctcggcgatcaattacctcatgtcattttttttcttatagacaatagttgtctgatctcaaaatagttcatcagtgtagtggtgtgtaaaactaatggacggcactatgcttcggacgcctgatgaaaaggcaaaaaaatcggacgctcaacttgtgcccgttgtcccattgcatggatgtgcacgcaaactgttgtatgcagatgtacgcatagggtgtgtttagttcacgccaaaattgaaagtttgattgaaattggaacgatgtgacggaaaagttggaagcttgtgtgtgtaggaaaattttggggtgtgtttagttcacgctaaaattggaagtttgattgaaattgcaacgatgtgaaggaaaaattggaagtttgtgtgtaggaaagttttgatgtgatggaaaaattggaagtttgaagaaaaagttagaaactaaactaagccttgatgtgatagaaaagttggaagtttaaagaaaaagttgggaactaaatcgggccatagtatgaatctggctctagtacatgctttcagtagtgtatcttttcacttttattttctttactttcttgtaaatctttaaactgaatttttctctaaattatttatccgatctgtaatctaattacaccattgtatctgttgcaatttaatatttacaacaagatctcacataactatatttctttaaaaagaataaatcttataattattgaaacataaaaaatacttactgaaacattcaaagacaaccatgtgaaacatttacatataagctaatgaaatatcacaaaatacttagtcaaacatcgaactagcaccatgtgcaacattgacaaataaactagtgaaacatcaaaaatacttagtaaaacatacaaataacattatgtgcaacattaaaaaaatccattgtaatatagtgcaacatagttgaatcctagttgaaacatcttattctgataaatgaatcacaaaatcttaacggttgaaacatatatatatattaattaaaatatagtcatatgtgatcttgttgcaaagatttaattatacgaatataatggtgtaataaaatcataaattggatcaataatttaaaagaaaaaatcgtttgaagtttgttaaaatgtggttaagacgagtagagaaagcaattcaaactacgtaaagtaggagagtgaattgaagaaccacgcatgtaacgtaagagtaggaataattgcattcagaagcacacatgcacccattgcatgcagcgtcagatttatttgataaaatcggttgaccgatatagagtattatccaaaactaatggttgttttctattaccatagcactcaggatccttgttcatgatcttcatcaagaaatcgtttgcgaccaaattcgtgtcactgaattggtactcgacctgattccaagaaacagagggaggaaacattgttgaattcaaagagagcactcaaatcagtaaaataataataaaaaaagataacgctcaatccaacccaaaatggcatcatgttgaaatgtaaacctgcttgatgatcttctgtgcaatgtcggccggacttgcccccttgggctgcccattgccgccgccgatcttggcgtgtccaaagtccggcaggaagaaggtcggatctgggtcggcgaagatgctccagtccgcgccgagcccaatgctgctgcccggcagctgcaagaacggcgagtagtagccggcggcggccgcggccatcgggctggcggccggcgacctcggcacgaactcgggagcgtggacgtttagcctgaagggcggcgtcgagcactcgccgctgctgctcgcccccgcagccgtcaccgtcaccgtcaccggcgccttgccggagctgccgcggctctcctgtggcatggcgaccggttcgatcgatcggagtggcaaggggcacagagatgtgtcgagatccaaaatgtgtgtgtgaattggtgtacaagagcgcgccgagtgtgttggtactctcacttttatgcgcgcggcgcctcgggaggctttgaccacttcttcgtgggcacttttgtgaggtgagagtgtttcttgggcagcttttttcgcgcatgtgtggggcttccagccttccatagtacgtaccgctactgtaggagcgaggccgctgaccaacggggggcagagttagaaagcgggaagcacctaatctttccgtgtacacattgtatacatctatatctatatctatatctactagcaaaatgtctgtgtgttacactgggtaatgtcatattgaataaattttagctgaacaattttttaagcagtatagtatgacaatcataattacaaattattccacgtgtacgtatatgatatgaactatgttcccgacacgttattttcacgcaaacgattgtaccataggaggaacaaacggtgaatggcttaggttactttcacgcaagagcatattgatgaaaatttgtgtgaataacaaaaagaaaatctgtatttaaaataggtaagtttatcataaaacaaatgataatcaggacagataaaaaatacttttgcatatttactcatagtctcgtagtggtgacgcgtgctttctcaatctgtaaactcgttcaatcagacacccgcatagaacaaatcttttgcaaggaaaaaaatttcctaggttggatagattaatctctatatataaataatacaacttaatagaaaatagtcctattttttttattttttaatacaattaaaaaaagaactgacattcggaattaaaaaataaggaatattgaaagatgagtttagagtccaaatagaaatactattagaaagaatgaaattcggaatttaaaaataggaatactaagaaggatctatatatagtccatatagaacatgaaatgacaattaacgcgcataatttcataagaaatagaaatactattaaaaagaatgaaattcgaatttaaaaataggagtactggaagaataatctatagtccatatataacatgaaatgacaattaacgtgcataatttcataagatatcaatttatctcaccatagggtaagaaatgaggctaagtgtccatatgtcaccaaaattaatatgagcattaaattgtacttcataataccattaggccaaaatgaatcaaaattgacattagtacccgaataatgaaaaaaaaaatcctaaatcgtaacttccgttgggccaaaatgataaaggcaatagcttaaatattttagccaaatttctcgttcattccatttagctagacatgattttatttgcataagaaaatttataatgcaattttatgggatcaaataatggcttaaactgattaaatttatttatgtaaatatgaaaacattaattcgggcaaaatttgatcaaaacctcttttaggctcgagagctggccgcggcccagaaggcatgcaccggcccattcacgcgtgcggaagcgcacccggccagtgagaagagtgttgacagctgttaaatacaaaatttaagccatcaatacctacataaaaccataaatataaaacatccaacatagtggtagggtttatttctaacaatttacacgagtgttggtgtatattcgtatgcaggtgacaaactacctaaattgagaaaaaaaatacatgaaggaggaggagaatcaaacgcgtatccgaatatatggagttttggacccagagacccaattaaacacctccaaataggccttccatccataccaatgaatgaagggcccaaaatgagtatccaggccgaaaaccggagcgaaaggagccgtccattacggaggccgctggcccaggcccaagttcagttcggtagtgctccgctctccctatgatggttatggcgttaaaaccggtagaaaccgtcattagaagggacacttggcatgagaggagtaaaaaagtcggaggaattctgaagttgtcggtaatcctcttcatatttcattctgctctatttattactttgattataattgaaatatcttttgagtaatttagttttgctcagtgagaattatttcttggttagttcctattcagagtacgggatcatcgttcactacaatcaactataatatggtgattgctttagtgagttataaacactaaagtagtaattaactgcgtagacgtggtgtctaggtagttgatttccagtgtttgctccgcatcccacagtaggtgtgaggtgggtgtagaggtggtgacagccctcaagacactgaagttctccctgtccgggtgcgcagtagagcgatatctgggagcagcgagctggctagtgcccgaagtacctcattagaattaaagttaagcttttcgtagacactgttcttcaccggtgaaactcctctatcctttgcctatccatagcttcgtgtccttggatgaacctgaaccggagttagcacacatattccctgtggaaaatcgatacctgagaatactctcgggtgaagtactacatcggtatattccgtgcacttgcggatttatctgtgatcgtaagaaataccaataagcatttctggcgccgttgccggggaacggttgttgtttatctccgaaccttgttcatcctcgtatcctttttatttttctttcttctaccttcacccctgctatcctcgagaagcattccagtaaaacattctcaatcgatggagccacaatctattttccaattgtctgctcctcggggtgaaatttaagagccacctccttcatcggagcctatttcaacacttggctatgaaattcgtcacgaattcattagtatggttagggagaaatctttctctggtttaggccaggaaaacccctaccatcatctgcgggaattcgagcagctttgctcgggccttaagattcgaggcatgaagcaagagactgtttggtggaaattgtttccgttctctcttcatgagagagcgaaacaatggtacacatgtaccgttgggtgtgtaaacggtgacagggagaaattgcaagacaggttctgcctcgcatttttcccaataacccgtattactactcttcgtgcagaaattctgagtttccaacagataaataaagaatcgattagtgcagcctggtccagataaactaatttagttcagtctggcccaaccctatctatacccgattacgtgctattgcagcattttcatgcgggtttagatagggagtctgcattctaccttgacataactgctggagggtcattcatgcacaaaactcccaccgaaggcaaggaaattctcgatcgcatatcaaaaaatacctcctttgtcgggcagtgtgttgaaccccatccagaggcatttgtgtcaggaagggaggacgaagggagtatgctttacaaaatgttgagatgagtatgtactagcactatttttttaaaaaaaaattgagaatatatgttttaataatttacgtttatttatatgcatgcatgggaagaattagcataaatatacccctataggggaacgcataacggggacgaggggagcgctacgtaatcgaggcttggatgtgggaccgccagctgggtcgttatatttagtatctttacctattactagtaagtgtgcacgtggaatccacgttgctaataaaataaataaaacacaggacggccttcctctggagagcccccaacggcgcgccactcctctcctctcccccgccgccgtgccgcacgccgttcctctcccctctaccgtgctgcgcgccgttcctctccaccaccgagctcgtcgtcgcgactgccgtgtctctccgcctctcccgctgctgccgcccctactccgcgcgccgttcctctctgccgccgagctcaccgtcacgccggccgcctctcccgctgccgccgcccttgctccattgaccgcctcacgccgagtttgctgccgcgcctgctcgagagaaggagagaagagaagagaaaaagaacagaaagggtggggcctataccattttctatcacttacatatggggctcacatatttattatattttatttttactgactaggatgccacatcagtgaaaccgagtgtctatagtgccttggtatgttttcttgaatggttttacgtagttcagggtatacatttcttgtattgcggttaggggacctcaggcagactcagcgtaaaattgagggacgtcaggtgaacttattcccaagatgaatgacctctgatgtactttttcccaaaaaatcactgcacatgggccatgcccgccttgagcccaaggctgtggtctagactaacgagcaaaacagcgaaaaccccaagcgccaccgcttcactccccgtcggcgaccagccgactttccccaatgccggcgccgcccgccgcttcctggcgccggcacgctgctgccgccgccgcctcctcctccacgcgcaaaaccctcctcctcctcctccccgtcttcctcctcctcctcctcttcgtcctctccagggctcctgatctcaccctctcccccgcggccgcctcctcccgccacctctccgccggggttcgcccgttcgattgctacgcgtcgcagcaggcctcgccggtcttcgccagcctggtggagggcgtgccccaccccttcttctactccctcgccgacatgggggctcttcccgaccacccccacaagaacatcgctcgcatcctcaagggcaagcgcttccgcaagcccgacatctccgagacaatccagcagctgctcggggggaaggtggggatcggatcccgtggtgtggtggtcgacgtgggtgccaatgttgggatggcgtcgttcgccgcggccgtgatggggttccgggtggtggccttcgagcccgtcttggagaatctgcagaggatttgcgatggggtgtatctcaacagggtgcaggaccaggttgtggtgtaccatgccgcggcttctgatcgagttgggaacatcacaatgcataaggtaatagatgagtactttacattgctgcctgtagttttgatgttcacatgtctattatttttttaaaaaaatactttgtgtgcaatggctgccttctatgttataaaattaacaaggtttttactgattgggagttcattgtacaaagttaatcattagaggtgataccagaaacaacaacaaaaaaaaggaaaaaaaaaaacaatgtgtaagctagtatggcaagctctcattatgcaaaaaatgaacctttgaagtattcttgggcatgtctcgagttttatcgggatccgggaactcattttcgttactaatggaaagaacagtcttcttacagagatgcatgaatgagtaagttgcaaactagaacaaacccagtatatgtttccatgcagatgtgattgtttcatttctgcattgtctctaaaaggatcatgaacattcctatgactttagttggtcctttcaatttcatagggaaagttttcaagattgtggtgctcatctgcagaaatgtttgaagctatatatgcataagtctgaaatgtttccttttcctttaacattttaactcactgttgggattcggtgtttatctattttctattattgctataatttctaaatgatttagaaatgccacaactttatacataaaagtcatttttgtaataatgtgctctaatgttatcaatgcaactcattgaccatttcattagagactaactttctcaaagaaatacataccatattgtatagttatttaatggtccagttgatagttcattaaatgcatgctggatggcgtaactaatgctttagataaattgccttgcattatactaaatgccttcattagctagttatgtttgaaaatcattgtggacaaggttctaatttcttgtttaccttagaacttcagattatgtctatagagtttttttactccccctgattcgaaatgtaagttgttttacaatttttagtcacttttcatctccttgttcgccattgctgaataattcttcttctctcacaagtcacaaataaatgacacttctttccctataacaaatgaacggtagcaaagtcatttgtgctgctttcttagttctcgtgcacaagtccaaattacttacattttcaatctgaaagagtatcgctgtgaaacaataatttcattgtgcaatcatacatgtgcaaacatattggaatcagtatgtaacttaaatgattcaaacatgtttcattttgccattattctgacttgtgcttccactggaaagtactctaattctttgaattctccaattgcactctgtatccagatactcgatatttttttaatttattcgacagcttataaataattattttggttacctaggtgattggacgactcgacaacagtgctatatctgcaaccggtgcaaaattggcttttaaagcaaatgaagaaattgctgttgaggttgctacaataccactggatgaagtcattctagatgcagagcgagtggttttgatcaaaattgatgttcaggggtgggaataccatgttctgagaggtgcatcaaagttgctttcaaggaggaaaggtgatgctccctaccttatatatgaagaagatgaacgcctactgcaggcaagcaacagtagtgcacgagagataagggcatttcttagtagtgttggttacaatcactgtacacgtcatggcacagatgctcactgcacgaaaaactaggcatgtgctttttattcatgtaagttgatgatcatctatgaacagagaaacattcatatatgatgtgctgatctgtagaaaagcattttccctctcaggcagcactttcatgaataaaaatagttagtcaacttttaattcatggcttctttcttttgggttagattgttgatggtcgagttttagtatcatgttgatttctctgatgttatgacgatgtagctatgcctgttaacttttgttgcatgttttgactctgttgtaaatattagtggatgtagtcaggcagtaacgattttcttattgtgattatgcttatatttttatcatgttgagaatttattccaaatcagttatgtttggtatatgcctgatgccacaatgacccccccccccccctctcctttcttttccttttttaggagtgcagtacagttgattgaaagaaaaggggtgactagattctgttgtttccaatatggtttagcttgtctatgctattacggaactaaactaatcttgtataatttttctatagtatttggttggcgtccaaattggaccaagtttcagagtgagcaaatgcaaatatactgcttgttcccttgcaatcactgcagaatttcaccatctatctcaacccaagggatatgcgcaatctttggccagtcaatgccacattcttttctgagtctatccttgagcactgggttacagagtgcgacttcaagctttctaagagacagtggcagctgctcgtctgggagtaattccaactcagggcaattccacaagattaatttatccagggactccaggctggacaatgaggaaggcagcgattgtagattgttgcagccacttatgcagaggctttgtagtgatcttagatgtaggaagacatcctcattgtctgcagtgaaggtggtgatctctgagcaatcttggatgtctaggttctcaatgtgctcaagcctttcccttaaaagagggcatgtgagtattctcatatgatcaacgataaggcttctaagtgactgaaagcttgctacaactccattggtcactggcgaggaaaatctggcaagtagcttggggcaattgaatatgcagagagatgagacagtggtgacagtggtcaattgtgtcatcttcacatcatgatggtatggaacccagaaccctttttttgcaattgtcagctctgtaaggcttggaggtagtggaggcagctctttgagcttttggcagtccttaatcacaatattgcggagattcatcatttcctggcctgtccatgaccactcatttagttcttgcatgtcatcaagaactagctcctctaatgactggaaagccacatgtgaacttctattgccatatacctctaggcctatttgcctcactgttttcaaacgctgcaaccaaatagtcctgacagatggaagctgaccaagtggtggaagctgctcccaagcattgcaaccactgaggaagatgagctcaagattgattagccatttgctttcaagccaactgggggctttgactcccatccaaccgatgatgtccagcctcttcagatttgggtgtggctggagatactctaacacctctgcttccttatctgagtttaccaaatctcgagcaggtgcccacatcagctgcagcattgtcaggtttactttcttacacaacatggcttcctttgcctcatcaggagcatcaatgttctcaaggttcctaatgtggagggatccacgaagctcttgtagataaccaagctgaattatgctgtttgtttcctcactggtgaccttgaaaatgggcaatctctgaaggtatcttaggcttcctatgtctgttatagtggaaagaatctggttagctgctgtcagatgccgtaaactgaccaggttgtttatgcttgaaggtaacttttcaagcctgcagcctgataagtttagaacttgcaagtggtaaagtttacccaagtattctggtaacatgttgatggcagttgatgagatatttaggtatcggagatgcacacactgtcgtatactgtcaggaagtctgtcaatcttgcaaggtgataaatccaagacacgaaggctttgaaggttatcaagaactacttgtgggatggaaatgttgattggagccaccattctgctcgtaaagaaaatgagagtgcgcaggttcatgtatggtattgtctcgtcaagcattgaaaggctatctagatggattgatagatggcgtacagaggatgggatccttctctgttcatcacctcctattcggaaacattcttcggctgaaactgatttggcaagtttgtgaataacgggaggcatcacataatagctgacaaattgtttcttctgaatggcaaaaaatgaccgactacataactcatcaacatattgcttcccaatgtcttccattctcctgcaaccatctgggtatacataaccttgtgccatccacatgaggatcaactgctcagcttcaaattcccagtccttggggaagatactgcaatatgcaaggcattgttgaaggtgcactgggagattctcatagctatgctgaaaaattggcatgatttcatcccatactgcatttctctgtaagacttgtttccactcatctgtggtgtgtttacatttcagctgtctagcgaccacctttgcggcaagaggtagaccattaagtgtcttagcaatctcgctcccaatattcgccaactgtgaatttataagatggttcgtatcatcaaacacaatcatttttatcagggaccagcaatccttatctgacaagcactccaggttagttatatgggctgactgtagcatctccgccaccatactggatcgggtggtcagaagtatcttgctcccatttgctgcagcctttaggggagaaagaagcttctgccagttctcgtgctctatcgccagagttatcttgtcattgctccagacatcatctaagacaagcagaaaccgtttggatacgagccttgctcgcagtgccacctgaagcctgttgaaatttgttatgctgtcatgcctaaatcgactgctggaaactgactctagcatctctcttgtgatcctggactcatcaaaggcatcagtaacacagatccacattctcatgtcaaagtactgtgctactctagtgttgttgtacacatgctgtgctagagcagtcttgccaacgccaccaactccaacaatggaggcaaccgagactggattatcaccatcaacctgagagcttaaaagagtacttaccaactgttggatttctgattctcgcccgaagatttccccatgggcaactgagcttgtcatgatgctgtatctgctgtgcctgggcttccttggtagactgagtgcttcactgactccactagcaacctgctcaaggcgctccaacagatttaccatctgattcttgaccctggttgatctatcccagtgtggctctagaccagaagcttgggccccttgattgcgaaacctggaatgcataaaggcgctgattgggctactgttgctctctgttgaacttgattcctgcatttgatgatggaggcggttgtactcaagcttgtctaggaggtcctctgcatggtacatgacatcccggagctcccgcatccatgggagggagccgtaagacagtgaaggtgttacctctgccccatggaggacagactgcgtgcgaagcagcgcgacacgaagtctgttcatctcatggctgatgccgcagtcggccgcccagctctgaagctggtaggacagatacttgtcaaaaatgacctggatgaaccagccacctacagctaggtaactggacatgtccatgcttctcttttcttgaactttgttatctccggcaaggactaagaatcccttgaatattttccaaactagctaagtccatcttcaattctaatgggaatcccctggacacctaagccaagtcttcggccaagtatttgcaaagacttcttcaacttgaatgttggaggttctggacattttgaaagggacacattttgaggacacattttgagctctgaattacaaggaacatttccgaaccttactatcttccttttagatatgttgaacatctgtttcgacgtgaactttccaagattcccaaaggtgtaaaatcgcacgctgaattttacaaaggtgtaaaatcgcacgctgactcctgagacgttccaagcgtcccgaaagtgtataatcgcacgctgaattttacatttttggtgtcttgatttcttgatgaatttcggtctaatatattcagagagatttacaagtagggcaatttgatggatatactgccaacgttgctttcatatagtgaagaaaagacaaggttatatagaaatttcttgtaaactatatatggtttatagtagagaagtgtgtttccgaaaacgagggaatagctaagtctattgacggaatcgaaaggcaaaaacagtcgtcgtccattcgtaatcgttggctgacgaatgaactcattgcattgtttaatagcttggcttcggtgcaactacatgcgtcagttgattttttttttccttctagcatcaatgcctgtattgtgatggaatcgattctaagcacagcacttctaacatcagtgaaatgcagcactagactagctaggctaggctaacgccgtaggatgataatgtggatttgggtttggtctgaatctggataggctgttcgacgcagctcaatatcgtaatggatggatgggagaggaatgcatcgtatggtagttgaatccatctttgaagcataaaaacacaagaatgaggtggaactggcttcaaggaatctttgcttctccctctattccaaactataataacttctagagttcaaactttataccaaatatagcaacacaatacttgtaaaaggtgattttaaccattaaattacccataat

SEQ ID NO: 68929 - DNA, 4059 bp, Oryza sativa
ccgtcctgttgaacaacggcgccagccactctggcgccccaaaaaggaccatttttgggataagtttttctaggggtctacttgcgaaataagttttttaaaaggaccaaaatgtgaaaaatccagccctttttaatgtactgttgtctctcggagcctatattcactgtagctttttataaaattttaaaagataagcattattggctccctctaataataaataaaatttattgattccgcctccgctagtatccttaaacacccaaaccgcatatattgatttccaggcttccagcatgacataattgctactccctctaggttataagatgttttcacttaggtcaaagtcatataaggtggacacgaagctctccaaagatataagcactatcagatcatcatatcaatatacatccggtggatacaatccttaaacatgagtatggtattacctctcattgagaggacctcaacctgtctaaatccttgttttcgcatccatccaattttacatcttgtgtgctacccttttttattattgtcgatttccagaatcaataatatgcttcagtggggaggcagcccatgcatattttcactaactagccaccaatctgtgttgagttgcctcgacacagttagcgaaccaaatttggatatgcatgtatagatggccaaatagaccgcttggctcggcacaacccaagtacgaccgggcccgggtctaggtcagtcgggctagcaaggccccacctacacgacgggccaggaagtgcctaccactggctgcaccaatgacccaggcacggctcaataagacttgggacgtgctgggccggcccgaaggcacaatagcccgttgtgcttctctgtataataattttatttttccttcctcatatctttgggttgtgtctaacatagcaagaataagtctattttgcatccttgtctttgggacatgcctcatatgcctaaattaagtatattttggatccctcaattatttttctttgaccgtgtcgtgccaggccagtccactctgccaaggcatcggcccagtgtcacgcccagaaatttagtcctaaatttccagactattttgtgtattaaatccctgtccaggactagccagggtacacaaaacgacaagtaataaacagatccaaacgtaaataaagcgtaaaatactcacagaagaggcacttagtcctcacatcgaaagagaacgacagcagcggaaaaagacgatcctagcgaggcttcagctccactccacaggcaaaactcaactggggtatgagccttggtcctctaacttcgtcttcagctcagaagcactacacttctgaaaagggggaataatagcaaggctgagtacaaccaccatactcagcaagccacaccaatgatgcagacgtgcaaggggaacacaaggacagtttgtggctatttgcataaaggtggttgtaaaacattttattaagcaaaacagtaaaacagttgagtgattaaagtaacattaaatctccactgatcaacgctacactacgttgaacatgcccaaccaacccacctgaactacagtgcattgagtcgatttattaagggtgagactaatcacggtgaatctggtcgatcgcccataaccgcggacacggctattcgaatagttttactttggccagaggtgcacaactgtacccacaagacataatccaccggcatgtcaccgcgtcatcatgcgcccatgatgaacacatcaccatgtcgagtgattttgacaagacccttcatataaccctcccctaactatccacaccacgctaaggtttcaccctcactcctcgcaaggcagcgggcagtcccctcgtgcgccgcggtgaatccggcagctggacaaccggacaccccggccgacccaactccatcacacccaccctcgccaccggtgcctaggaaagggtcgagctatactttagatcaagcagttacccactcccgcttgtggcaagcgctgtatgttttccagggtttcccatgaaccggtccttaattgccatgggtgtaaccagcaaaaccatacacccacagcccaccattcagtcacattttagttggataattacgcccaatgaaacatagtcgggtgtctcgagcacacagctcgttctgatactaaaaaggtctaatactgcaattatcccatcaactgagctagtggtaattaagcatggctaagcatatagttctagctaggtcacataagtaacacaagctagtcgatttgttacccaaggttgacaaaagacatatatcaagtaaacatggcacaagagagcagatcggtaaaccctgatcccatgtaattagcaaaacatgcatatttatttacaaacggtaaaacatttataaattgggatcaacatgctcaaggggaatgtgtgacttgccttgcttcttcacttggatcttctgaactcttttcctcgtgaccgcagacttccgaaacggcggaaactacacgctggcacgcaaaacgaggaaaacactaataaaaccaaggaaacagtacataacaaacatgtagatcttaaatttagatgaattttgcaagttgaatggcccaattcagagttcgaatgaattagataggaattttagaaattttgagccatttatatgaatttctagaattattactgatttatcgtgcaattattaattattttcttgaaggaaaagattaagcgctgacgtcatcaaagaggccggcgccgacaggcgggccccacacgtcagcgagacaaggaggtggtccaccgtggaccgggaccacaaggacggtccaccgccggtccacgggttggacggcctagatcggccaagccgatcgggtggctaagagggaggcagccggctggcacatgaccaccggctggcagcagccggcgacggcgcggggagcagcggcgcacgcgggcggtggcggcgcacgtgagggaacggcggcgcggcgcggcaaggggaggcggcagccggctgcctggcacagccggcagcggcacgggcgcggagcacggcagtggcgactcggcagcgacggcgcgtcgcgaggcggccagcgaaggagagatagagggagagggagggatgctcaccgagctcatgcaacggcgagaaggtgacgggaaggcggccgacggcgaggaacagcgacagcaggctccttgggagggcggcgcggtggagcttcggcaaccaccggcgaacgtggaggggtggccgggcttgctcgagacctgctgaaagtggaggagggggagatatggcctgaggcggcgggaatcaccggccggagaaggtagagatggagaagctcaccggtgctctggattccgacggcgaggagtggcggccgagggtctcctcatccttgcgaagtcgagggaggcgacggcacagtgcggggtcggccagagaggcggtgcggtgtggctgtagttggcgacgagggcggagagagatggtgaacgtggcggcggcgtttcggcaatagattggggaagaggagcgatagacggggtgcggtgaggcgtggcggcgctgtgggtggcggcggcatggccgggcaaagcgacgctcgccggcgggaggcagctggaggcggcagtggctcgggtcggcggtggaagcggcgctacggcgaggcttcggggaggacgaatggatgccagggtgcagtgcggcgtgacgaagctagtggtggcagcggagcagtgcggcgacagcgggaacggcgggaagcggtggctagaggcacggcggcgagcggcggagcgcaggcttgagcggggagcacgggagagggtgcgaggagctcggggaggagggggaaacggaagacgagagcacgagggtgctttatatagggctcggggatggagatcgtggctgggagagacgggatcggccggcgacgtgaggaggcgaagtggagctcgtggggaggtcaaaccggcgccgtttcttgcggagtgagtgggggaaata

SEQ ID NO: 68930 - DNA, 7795 bp, Oryza sativa
cctgtctcaactctcaagattggtggtcgaatgagtgtctctttacttgattagatgctgatttgcccaacaagtttggatttttttttttcttttctcactgttttgtcagctcgattcgtgcaggtagctaagcttttctcgtttcttgagcaatggctgttggaagcagttcagtactagtttcctatggttgatttgtactgttattttccccccttctgaatttgatctgggtaaagtagtagtaaagtgagtagaatagttcctttctctctctctctctagttaccagttgcttcccttttggatgcttttttatgtgattctgaaaacaaaaaagcttggaatctttgatgtgctctcaagctctttgcccaaatgatggctgctagagcttgcagtggcaacatagcttttgctttgtttgcttcccctcacttcccgttacagttcttgtcagctttttccccttccttgagagttgaacatttaagcaaattattcttcctttctcatgctagtataatttgctggtcaaaacattgttggttctttgataatgtttttcagatgaacacctcttaatggtttttaaaaaatatttcttatttacacctttttttcttggggtttttttaaatgttcatgtctaaccattaagcagcacaatatttgagttacgcagtggcttcgtcttaacctgctatacttcttgattatcatttctgccgggctgtaatggaatagatgcttgttctgttgacagtgtattgggacttcagattttgagtgacatgagtgtatttacggttttctatctggctatagtttgctaaattattttcacaaaacaaaaaagaggtgtgttcgcaaggttagcatactatactatatctctgtcacatcataatcttgaataaatccaattgtcttctagtggcatgttccaatcgtcatagttatttagcgatcttatgctgctcaatttcttctattaaaatttctagtcttttgtttgtgaatgcatatatagtcgattagagacaacacttttttccatttagcaagcttattatctttataaaaaaaaaccatgcatattgaagcacctctctgttgctggacaaatgttttaagctcttttactacaactagtgcagatatcttttattaaaaaaaaatgccaacaagatattgaacattgtgtttccagactcaagaggtacactgtttttctaagcagagagaagcaccttgctgtgtagcgttttacttatttagtctatgtttcatcttgttgaaaattttcaggtttaacattttgttagatagcaataagctgttgtctttatcaacatatagcggtgtacacaagttattacatgttagggctaatatagatcagttgagattgaccgtatacatcatgcttaggtttcaaatatctgttctgatgaagaaaactctgacaaatgattctgaaggataaatgatggaggatatttggtagtcaaagtattcaatgcagatgtttttttttctttgccataagcccataacaagaaaatacactaaatatatgaccttccttcttacttgtaaagaattagaagctgaatcatgtttgtttattgatgtttccgaatcaattggacattgccttctggggtgccaagttgaaagttcatctcttcacgtacttcttacatagggatgctcagttggaataatagctggcattcaagttcaacagaaaatagaacaatggagagggaaattgtggcctcatatgaacccaagaagaataacgaaatcaggatgtttgagagttcagacgagatggcaacagatctggctgagtatatttcacaagtttcagaaatttctattaaggaaagaggttactttgctattgccctgtctggagggcctcttatcagttttatgcggtaacactgcttccattagcttcactaactaatatttcagttcgcgttttccagtatgtgtgccttcaagattctgtacctaaattgctttttttttccttcaaacaggaaactttgtgaagcaccatacaacaaaaccctggattggtctaaatggtacatcttctgggctgatgaacgtgcggtggctaagaaccatgtggatagctactataaatcaacaaaagaagattttctctccaaggtatatcagcttaagaagtactccatatgctaaagtaatctagggtgcttgtatagtccatccttttgtttatcggtttctttgtttcaccaatctgagttaattattgtgcgtgtgtactgatacacatgccactataacaagaaaaacaaaggatttttagatgagaatctgtggaagtttatatctgttaatctgaactatgcttgtcccctggttcaaaactctgtgcagttgaggccggagatgtaatccatttccattatctaaaaaaattgcagttgcatcaaatacattttgataagcaataatgaaaccaatacatgtgctctgatctggtaatctggtactgcaatctgatcggaaaacatagatgcaatattatttaatccaaaagtaaatgctttgtttacacaatggtttccgagcaatattttttgtttgacttgggatgtggtctggtctgtgcagatcatgcaaaatccttttctcaataattaacccgcattaaggctacattcggcctaccaacagttgtagttcttccaactactctgggggtgccagctgcatgcctaccacatatttgcttatcttctcattactatatccagcagatgttatccgattgaagagcttatccaaatgagtgtgcattattggtacaggaaaatatcttgtcagttgaaccacactggtatataccagttatatggttcttggtttggaaatcttacactcatagtgaagtttaaagagcttacaacacagttttagatttcatatctatactgtatctgcttgccatcctgtcatattgttaaaagtttatctacctgaacttttaacaaaggatcatttgctcaattgcacatcaaagccttagataagttggcgcatttgttggttttgtcataattaatgtaaaaaagaaggatgttgcaaggtctctctatgttttggttctacaaatcactggtggcattaacattaggttttatgttaagtattttacttcacaaacttacagctttgttggaagtacgatgtagctgtgacttgttaattaatataaggcactccaaggtttcttttgagtgaaccatgaatttgttacatctgaattgggttttgtaggtgcctattcttaatggtcacgtctactccatcaatgacaatgtgacggtggaggatgcagcgacggactacgaattcgtcatccgtcagctggtcaagattcgcacagtcggagtttcagagagcaacgactgccccaagtttgatctgatcctccttagcatcggctctgatggtcatgtagcctcattgttccccaaccatcctgcacttgagctcaaggacgactgggtcacctacatcaccgactctccggtgccgccaccggagaggatcaccttcacccttcccgtgataaactcggcatcgaacatcgccgtagtggccaccggagaagacaaggcaaaggctgtgtattttgccatctctgacggtacagagggtcctgatgctccatcaattcctgcaagaatggttcagccaacggacggtaagttggtttggtttttggacaaggcgagtgcctcgtttcttgaggccaagaccaagaacgatgggtatgagcatccaaagtattagcgacttggcattccctttttgctgcctatgaagagttgagttgatcatgtagtagttgatggtttttgatggaagatgctttcctccattaccttggtagtaagcagttcaggtgctcgttttgaaggtacttggatctgagaatatgaaaatatccgtgtctttttggagttgaccatggcgcatgggtaatagagatgtaatctgtactttattttgagaactcacagaagttactgagagtagctaagttcaaatattggccgaatatgttagcgatgcttggtgtgcactctattatatgtgagtttaagttgcattcttttgctctgattgttcttttgcatggcagaactagcaatgttcatcagagcatatttggattggctgaactctggcgataactcagattaagctgctcgttgtctctatgtttcctcaatgaggaaaaggaaattaagtgtatttaaaaaaaacagtgtacgttgtagtatcttttaggaaatagcacaatacatacttttttgcttaactaaaaaccggtggtggaaagaaaagttaaggcctgtacttgaatgctgtttgctgtattacactgatgttacagtaagaaattaaaatgtgtcgggcacctctagatttaaggctgggtttatgaggtgggacctccccgcacggaaaatggtgttacttattaatatgtgattaattaagtgttagtttagaaaaacttgataaatgaattaatataatttttaaagcgacttttctataaaaaaaatctaaaaaaatacaccataatagtttaaaaagtgtgcgtgtagaaaaagaaaaggaaaaagtgcaccaaaggtctctcaacttgtcatcggaataaaaaacgttctcaaaccacaaaaccagatacgcggggtcccttaactatacaaaaccggtcacccgaggtccttcggtggttttgaccccggttttggtctacgtggcggctgagtgagcgtgggaccctgcataggacccatgtgtcggcgtgccacgtcatctctgtctttccctttcttttttctcaactttttttacttctctttgcgagcgcgcggcggccggcgggcatggtggtcgtcggcgtcctcctcggctcctcctcctccacggccggatccagccgcggcgcggtgtccggcgtcctcctcctcctccgccgccggatcgacggtgtgccccgcttctccctgcctcgccatccgccgggacgacgccacgacgggatgacccgcaacctccacggccacctcttgcgcggccgcgacctccgtgtcggcctcgccgaccaccccagcaacaggcccctggaggacggggtggcggaaggggcggcgctggaggaggagccggagccgatggagacgacgaggaggtcgtcgacgccggcggcgagggggaactcctacttgttgtggaggacttgggtgatggcggcggcggtggggttgcccatggccgccaccccggccgacgccgcggcgatggccgtgcgcccgtcgacggagcggacggctgtggcggtggccccgccggcgcacgtcgcggcgcagacgtcgcggaggcggaaggcgaagcagcggcgcgacggtgtcacgcagcgtggcgtcgccgaacacccgctgcagcgacgacctctccaccgacccacgccggaacagcgccgccacccacctcccccctccaccgccgcgccaccctcccttcccgaggctcgccgccacgaacgccagtgcgactgccgccgtgtacctcggctgcccattgcccccttcaagtccgggttgcctctgctctgcgccatctcggccatgtcgccgccagtccccacgccaccgtgccctatgtcggccccgatccgccgcctcttgtagggatcggacccaatgttgccggccgcggccagctcctccttcttggcgagcatggcgcgcagcacgacgcccgggttggcgaggttggcggcgacggcgacggcgacggcggagccactggaggatccgccggggacactgccgggggcgcatgggttggtcggcgtgccgtcgcgcgcgttctccccatagatgctgcgttgttgcggccaagaaatagtggtgccgaggctgtggggccggcggcgagcgcagcgaggacgacgggggaagtggcggcggcgggcgcgtgggtcctcgcccagtccgggttgccgaacccggtgacgcggccggcgatgtcgaagctgcgaaacaaaaccaaatcaaagagtcagtcgtcgtcttcactgccgtgtgcttcattttgggggcagcgagagcgagcaagcatgagtaacatgtccttgatggcgaaggtgaggccgtgcagggggagttgctgcgacgacggcgattgcggcggcggcggcggcggcggcggcagcagcacgaacctctcactcggcggctaccgcttcgatcaccgctcgccgccgcccgtttcttgctactcccatgccgcaaagagaagtaaaaaaagaagagaaaaacgaaaggggaaagagagggatgacgtggcatgctgacatgtggggcccacgtgctttccacgctgactcagctgccacgtagtctaaaatcgaggtcaaaaccaccgaaggacctcgggtgaccggttttgtatagttaagagaccccgcgtatctggttttacggttcgaggacgttttttatcccgatgacaagttaagggaccttcggtgcactttttccagaaaaaaatggaagtgagttgggaaagaaggggaaagaacacaacgggcttgtttggtttggaaccaatttttgccctactaaaatcttagtagtgccaaaaccttggcaagttttggcactaccaaattgggtagtattgaatttaaactattgcgggcaaaatttggtagcaaaccaaacattcacttgctactattgaagttaccaaaattttagtaaggtaataagttggtatcaaaccaaacaagcccaacatcaaagcctgccaacggtttgaagtccagcccattcccagcccaaaccgcattagctatgtataataccacaaggcccaaatcatcccaatccattgagccggtgcctaacccagttttcaccactgtagatgcaaaataatttcacctcaactctaatatctgtctaaaccccaataaatagttatatttacagacaaagagagtactaactactctatttgtatttactgctgttgcattgcttggtatgatatttcccaatatgatcgggaatggcaaaggcaatatttcccaatcggatcgggaatggcaaagttttcactgtatattcactgtattattagcttctcttgtcagatcgggaatggtaaaggcaatttttgcatggtggtaaaatctcaaataatccatctttggagcttgttccccatggggaatggagggcgaggccttgacgataattttgccttttcaatacacccaagtcccgactatccatcctgaacatgcctatttccggcacaaatgacaaatgatgatctacattattaaactagtcaaataacttgcttatgtaatcacctcatctttccatttttccttctttttattgaagaaagtaaagaggaaagagaaaactgcattgtaagcctataaaatgatgaaatgaaatgaaaatcagtgtgccctttttacctggatttttcacattttggtccttttaaaaaacttatttcgcaaatagacccctgaaaaaacttatcccagaaatggtcctttttggggcgccagagtggctggcgccgtcatccaatgtctggcgccgtcctcctgccaccgtggcgcacgtgaaccgacgtggcaggaggagggcgccagactttggattgacggcgccagccactctggcgcccc

SEQ ID NO: 68931 - DNA, 6628 bp, Oryza sativa
gaggaacatattttaaagatattttttttaaaaaaaataaataattgagttaggttctatgaaaatcctgtaaaatctctatgttcaaaacaagactttagagattgatagaatgctattcatttatcaaagatgttagcctatgttttttttaaagataagttaggcatagattaaatgtctctaacatacatatttctttatctttacagtagaagttatcttctctataaaaaaaaaatctaccatagaagttcaagaaaactaaacaaacaccactgaagacaccaaataatgtctactataatattactcagctcatgacttcccacaaaagaatggaatttcagtacaaccaataatccaagccactggtacacaatggcaccaatccgtacacaaattctcctatacaaatcaaaacaacagcacatacacagatacactcaaacacgccacaaaaattatagcaaaataacacaaactaatttaatcgattggtcaatcaaccaacagccaaatgaataatctgatgatgagaagttgaggctttcagaacagcatggcagctagcagcagcagaaacgcaggaaaaccggcattggtggcgaccctccgtgcagagctgggcaccacctgcggcctcgtctgcgtctggctcgtcgccggcggcgtggccgtcgccgtcggcgatccggcaccggccgtcgactccggcggacttggcgctgtaaatttgacaaaataaagaaaatgatagatagtttagttcccatcaccagtaaaaattctgacaaattttgggctgtttggcatgtgttgcagatgaagttagagcggattcaggctaaatatttcttacgcagtggtggcatggccggagaaactgcaacgggtactcctgcagctggaatctgagctgatgtatctgaaaataaaaacaatattgataaattaaccgtatcttataaaccatttaaaagacacaaatattagagaatgacctaatatcaaataattagaaggggtgaggcttcaaacccaggtcatctagccgatcaccttgtggagctagctggaagactcctgagcgtttctctatcctataaacttttaaaatacacatctggctcgtttggaacatagggttctataagataacctttctcgcgcaaaacaacaatttgttttcttttaaatgccacattttaaatttaacctttctcgcgcatatattattacttatatactatctttgtcattaatcttttgcctaaatttttttgttctaacaacaaatatgaaaaaccggagatgaagtttattacctttgcattggaggggaacagacatggagttgcaggctttaggcaatgtaacggctagcgtccggttgatggggatgccgaggggcacgttgccggtgaggacgaggcaggcgcagctggcgctcgtgttgatcatcgccgccaccgactggcagcactccgccgtcggcgcgccgccgccggcggccgtgccgttgccgccgccgccgccgctgctgctggtgatgaagttgaagcacggcgtgaagctggtgatcagcgacgccgtgcacgacgccgccaccgcctgccccgacgccggcgccgccaccattgccaccacggcgaccatcgccgccgccgccacggccaccgccttgttgagctccatgtcactgttttgcggtgtaattgattgcaccgtaaatcgtccggtgatcttgcgttgataaaaaaaaaacgtcaacagtcacgtctcactctaactcgaaattgttactgtttgatgatgaagattgtaatgcgctatgaattcgtttatataggggggatgggagaatggttgacgtgtcgaattgaattggtagatcagaagttggtcatggcagcgtaaccaccgtaaccaattaatcctttttaagatgtttgtgtcaaagtgttaagagtgtttgaggtcaccttggttaggaagggttcgtcaccaaatgcctttgctctagccggaaaatatgctgatgtgtcattttcaccttgtaactaatttagcttccgtaatcttaatctgatcgaatagtgacattattgttgtaacaacctaatttgaccggccataatccatatgacaatgctaaattgaggaatttccgtactcacatttctattccttcaaaaattctttcccaaacgactcatttatatataaaattaattaagaatttgtttggaatgctaatggagaatttgtagtatttcttgtacaactgaaccagctctcgtggtatgcaccgtcggatgttgatctaacagtcagaaaatgctcacaaggggattcggagatttcttctccgatcccattttaccccactattaatatacaactttctctgggtcctttctgctaatttccctattgttacatcgatacatcttctcgggcctccatctgggccgcgagtgttggatcggacggcggctattgattcctactacgattttcgggtgggacccacttgtcagtgacgaggaggaggtggtcgccgtccctgacgagccgcgcgtcgtcgacgtcggcgccgccgctcgtcaccaccctcgtcggcgacaccccgaacctcgccgcgccgagctcgaggagaccacgcagcgtctccggcatgaacaccagcttgctgctgtgatccttcccgcctcgcgactccgggcaggagatggccaccctcaccagcggcggcgagctcgacgacctctccctctcggcggcggcgccgccgcctccgccgccgcccctgtatccgccttcgtgatggaacgcgtgtgacgaggagatgacgccgaagagggagttgcggaagttggccatccgctgcggcgtgctgcgcgcggaggcggcggaggtggaggacgtgcgccctcgccgagacgacgacgacggcgaggagtccacgccgtcgcggagcggcaccggcacgatcgccgacgccggcggtggcggccgagccttgcgcggctcgtggcgcgtcgccgacgcgaacgcgagctgcatgtcggcgtggccgccctgctcggcgacggcgcgaggggtgaggccgttgacgtcctcggcgtcggcgtcggcgccgtgctcgagcaggagcctcgccatctgcacgttgccgtcgaggacggcgcggtgcagcgcggtggtgccgtcgccggagcacgcgccggacacgtccccgccgtgccggacgatctccccgagcagcgcggcgtcgttctgctcgacggcgacgcgcgcgtacggcgccgcgtcgccgccggacaggtcggcgccggcgtccaccagcagctgcaccacggtctggtgcctcctgcacagcgcctcccacagtggcactctcccttctggatctgcacatcacttgatcaaattttcatcagaattttctttttcaaattacaatttgaactgagcatgaaaatagtataaacaattggagtatgcattcttgatttgaatttgaaaagcatatacctctcgaatttgaatcagctccattctccaacagaagcctgacacactgctcattcccattagaagctgctatatgctgtcaaattcagtaacaatacactctgtcaatttcagattaatttcacacacaaaacatacaagcttaaaacaaatgttgcatctaaagtttgaattaacaagaaatcattagtgtaccagagctgtgcggccataatgatcagattcattagggtctaatccacgcttcagaagctgatgcaacaagaagctatcccctttggaagctgcaaagcagagtgtgattgggaaatccatttggcccctggccaacatgtcatcgatctcctttgcgacagcaacaatggaggcaatttctttcttctctctcagatactaaacatcacaaggaagaagaagaagaagaagcatctgaatagatcagaattttcccctttctcgatgccgggagcggttttcgttgtcggaaaattttgcttacctgaataagattgttcatgacaattgtcccatctgcaatgttggactggatgatcctgaggaatgcggcccggtccaagcgaagaagctggcacagtgatcttgttcttgctgtgaagagctgaggcctgtagcacaggaccccgatctcgccgacgacatctcctgacttggccatccctgctagctgcagatcattcaaagaaaaaaaatgtgaattagcatttggtatttttgatgcatttgttcatgaactgattttgaattatggaaggtacagttaatacacttgcctgctctataccattatgaagctctatcaactcctgtaaattgcatcacttacattcatcagcaacaaccactttgccatttattttttgttacaagatcatcgcttagattttgaaaatggacaatgataaaacaagttatagggagtgattttaccatactaccagagactatgatgtagaaatccgcaggcgcttcattctgcagtatgatatcctctcgcggcgcaaagtactcagcattcatctctgaaaccttcactcagattacaatcacagaaaatatcaacaactcatgaacatccaacaagaattgaaacaataaacaaaactcacataatcacactgagatcaattaccagctgaaagatgagatcgtttgagacaccctcgaagaggtagacattctggacaaggccaaagaagagatggtgtgagatgcttgacttgatggccttgggcaacgcctcgaatgtctcctgctgatggagcccttctgaattcgtcctgaacttgaggctcagatgtgacaccatctgctcctgcagcctcgccggcagctgatgccgctgcgcgaagctcgtcgccgcttggatcatgtccctcttaattcacacaccaaaaaccacccaaaattcagacaagatcaaaaccaagaacacaccaagaaattaaccatcatgtgatgtgagtactagagtatactgaaccaagaaacaccaaagaattgctgctgatcaagaacagcaagggatcgatcaaagaaaatgagtgactactgacgaatttatgtctctcttaattcacacaccaaaaaccacccaaaattcagacaagatcaaaaccaagaacactccaagaaaccatcatgtgattcgagtactagagtatactgaaccaagaacaccaaagaatcgctactcttcaaggtcagcaatggatcgatcaaagaaagtgagtgactactgacgaatttcctggtgcggctggtgccgtgaacgacgaggttggtcatgttgccgatgatgtaggcggtgaggccgaggttgaagagcatgtaggtggtggtgaagaccatctcgccggtgttctcggcgtgcatgtcgccgtagccgacggtggagagggtggtgatggaccagtacatggaggcgacgtagcggctccagatgctggccttgtggaagttgggcatgtaggcgctgatccaggtgttcgtcgggtcagggtacctgtcggcgaggaggtagtagaagcaagccgagcagtgcaccgcgaacagcgtcacctgcgccacgacacgaggaagaagacgacgtacgagtacgacgacggtgacaatttttttctgaagattgaaatgttgaggattcttcagattctgaacctggcgtaacttacgcaaacgagcttcacgcatcgaacccagaagtagctgaacttcctgtccttctcgagactgaattcagatggaaagaaattcaagttacaataaattttgtaaaacaccgccaattataatcaaagttgcagaaaaccataggaatgtttgcacgtgacatataatgcaagtattatagttttaaagtttcataaagtcacatcgttaacgaatttgatatatacagatgtaacatttaaataatgaataaataactcataatatgattgtaaaactcaaaattataatagattaaagccaaaatgatctaacattgtgattttataaaattttacgtgtgaaaatctctatgattttgtataacttagagcataatactcgtggttagatgaaatttactcataatacttgttgttgcctcctagctggtctgccctctcccaccccgtggcagctggttccaggactggtgaccgtcctccagggcctgcttacctgagcacctccgcgacagcttcaactccctggtgctcctggtctcttagtgtctgtgggaggagcggaactctagggttttcgactccgctcactcttcggtctcagtggttctggagtccgtccatgtagaggaccatctgtagtctttagctggcgtcgccacttttagggatttgttgggagtctggcttggccccttcccactgcttggagtctgtttttagccgccatagtttctctaagctttagtttttccttcttttgctttttcttccttcccctaacataagccagtctagctgattgcgtcatgtaactaaaactctttttcttctaatatattgacgtgcaatccttttgcgcgttcgcgaaaaaaagaaatttactcataagatta

SEQ ID NO: 68932 - DNA, 5482 bp, Oryza sativa
cgcccctggagcccagcgacggcagcacgccgctcgagaagctgaaccgcgggctcgcctgcgtcgacgacagctgacgcgtcagctccgccgatcccccgccgccggcggcgccgctcaccagcgggacggcgcacttggtggtcggcattatctgatcgtcttcggtcgtcgtcgccggcgccggcgacctccgatgtctcgcgcgcgcgtcgatctctctgagcctctgatatctgcttccctctatccgaccgaacttgcaattgcatgcggcctcgcttaatttaggcgcgcgcgccgcgggagtggcgggagttgttaatttgttgtttgttttttaattaccggtaaattaattaagaggactgctacaaaacggatcccgttgtaacatgataggcatattaactattctcttacacgagtatcataggtatcagatttaggtatcacaggtgctgggtaacagatatcacagatatcgggtaccatgcagctggtactataataggtatcatgtataagatattgtcttgtctaggttttctattaatgataatagctgcaaggataattcatattttgatgatacaaatgggccgacttgggcctggtttacactgattcatcagattgggctgggcttttgacactgacacttcgctttatcttttcgtttaaacaagcattatgtgcttgctttgactaacatactcacgtaatgtattctccatagagatggattttcaggtataaaaaaaatgtacttctcccttctaaagtgtcaacaaaatatataaggaaaatttagaaaacaaataaacagccttggtacgataattaagttacagccatgcatcttgtagaaattagaaatgtagtgataatttgatgtaaagatcaatgaaagaaggagcaaatctggtagtgataatgactacaccctccgtttcaggttataatacgttttgactttgcttaaaattaaattgctttaagttcgactaagtttatagaaaaaaactagcaatattttcaacccaagataaatttattataaaaatatatttaattattgatttgatgaaactaatttagtattataaatattactatatttgcctataaatttagttaaacttaaaataaattgactttgaccaaagtctacgtctcttataacatcaaacgaagggagtaccatttttttttgcaagaatagtgacttaatttctggtgttatatgtgaatgcatttgggatatataattgagctctttcttatctccttgctaagctaattaatttgtgttatctaaaaatcattaatccaagcataaacatttctatctaaaacatgacttaaatatacattcagtagacaaactatctagaaagtacaaatatatatggtgataagagatcttgaaccaaaatttgtgccttaatatacctgaatgtataatatagtagtacctactaccttttcccctacacctgttccatcaaatgaagtccttttgcgctcatcaagaacagtggcatattcccacagcatacaccccactagtctccaacatcaatgacatgcatgattttaattggagcttttgccccacaaaacctctagtttacctaaaagtattttgatccactaaatccaatgctcatatcatagttgatcaggtttctcaagcaaactgaatgggatagtactcctttttggattcttgctctctttctttaaccaacatcagtactagctatatttatttgcctgtcaacttcatgaagagctcacgcaagaaggaaaataaatgtgaaaagtatctagaaaattctaaaaataaaagatttatagttagaaaataattgagaaatataaggatacagaattgagtcatcggtctttaagaaatgatcccacgcaggttatttgatagggtagaaaaaaaaagaaaggaagtagagaaaaggatgtggtttgttaaacgccggacaattcaatggacaacctattaaattattaatcttatgaatatattgtacgaaattaaataggtaaccgaattatttgtatatcatgtgaatatgacatggaaagttcatgcaatgatgcaagtatgtatcagtcgtttaatccattgacaaaagcaatttatatttaaaattcgagggattaattattagtttttaatcaaactgtgattttgtaacactaatagaaaaataattttttatgacgttggcctattattttcgctggcggccatacgcgaaaaccgccagaaaaaacatatcgaggggtgggaggccatggactgccagcgaaaaccgatttttgctggcggccaagctaagaggtccgccataaaaaaaactctatttttttaggcggacctcttaagtgtccgccagcgaatggcggtaggtaagaaagaccgctacaaaaaaaatttgaggcgaataaaatccactacgcgcccaccgcccagtccgtccttatcccttttccattctcccttcccaccgcccagtccgcctctctcccttctgcacctctcctccctcccttctccaccgccgccagctcgtcgcctctccaccaccgccggctgccgtcggcatagctccggccaccgccgcatacgaccgccgctccggccccattctcttcttcctcttccagctccttctctccctccacggagtgcacagcgaaggcagcggcgagctcaggcacgggcggcggttctcgggtgcgggcgcggcggcgactctcgagcgtgggcgcgcggtgctcgggagcgggcggcggctctagggcacggtcacggccgggcggagctcgggcacacggggagggcagatccgccgccgccgggcctcggggagggtggcaccgacctcgacgccgtcgaccgtgctacccggctccctcctctccgacctcgacgccgtcgaccgtgctcccacggctccctcctccgatcgtgttgctagatttgattttttttctttttttttgcgtgttgttccagatgatgcacatatttttgatctgtgtaaatgatgtttgatctgtgttgctgatgattttgtatttcgtatttgaatttggaaatgagcagcgaatctagatgtggatttgaattttgaaattaatgaatcaatgggcggttgcatgggtattttcactggcggctgcgcagctgcatgggtatttctttttgggccaaaaatagattttcactggcggccgatttaacacagccgccagcgaaaatccatttttgctggcggccgtcttaagccaacgccagcgaaaatagtttttttgctggtggtcaataaccgctagcgaagatctttgcctttgctttgtggcggctgcaaatttctccagcaaaaatccaaaatagccgccacgaaaaatggttttcgtagtagtgtaaagttcacagttgttcgatgtgtgatttttataataattggctgtagttttttaaatagtttaaaggccgtaatgaatctattattaagaaaaaaattaaagaggtaagcgatcgaatgaatatttgtaaatcattggtgctggctaagttggacgcatttcaagagtgaagatggtgtcatctgcctcagtttatctcctttttcaaaaagataggtagcattggttttatgtgcatggcttttgcataggtccgtttgaattctgtgtgcgccggccacacgaattaatcaacattgctggctcatgaatgatgatagctgcatctacaccatttgttgctactttttttttctatgactggatatcaattatctatcattgctcaatacgataatgataaatcaagagagagttgatctagtcagtcgcgacgattgatgtgaatgaatgaatacagttgatgtgctcttttttgtattattacacgaaagacagatatatatatacacaccaagataatatatatcgtagacactgacgaatatgtctcctaacacacgcttaaagagagataagaccattcacaacccaaaacaccagacatagtttccataaactctacatcatcaagaaactagtactagacaccactcttccaatgcaaacactactattccatgcttaagtttaatgctaattatctcatatgatgtcttggatgttgtgtagaaaccatgtctcatgcaagacatggtttccttttctttcattatttattcacttgccacattactttttatcctacgtggcagtttatttaatgttatggacaatattctaatattgggttgagaatggcctaagagataaatccctattccaataaaatcctattgaaagcgcacaaccaatgtcattaattaatgggattcaaaccctggtgtggataaagtcatgccctcatacctgaccgagctacatcaccggtgctttcttttaattgttgatgtactcttgatgagatgtcgatttcaatggtttctcaaggttcgactgcgaaactatatatcatgtacattagatatattacatcacatgcacatactcagtacgtgaacactatatattgatttgaatatgtacaaattgacaacgaaccttgctgtttgttcatgcatattgaaaaatgtacatatatacggtttcatctaaaaagaagaaggaattaaattatatcatacatatggctaaatttcgttccaatgttatagttaatacacatatatgtatacatcgctagttccctgcatgacagtgttagattgtgaaatgcgtaataatcagttgtccaaagatttgaacatatcttgcttcgatatatgatgatcgagaacgctgacttaactgtacatgtgcgcggtcctgcagcagtgaaagcgaacagattttataatgcgcatacttgcactgtcgcaatccaaatagatttttccttttagttttgattcgaattgcgtcccaacctggaccaattaatatttttgttaaatcctcgcgtatatttgtcgccattagactcgttcggagacttagtcaagggctagctagagggtcgttttaatttttaaacataagaaggactaacaaagatgctaattaattaaagggctagagggcaaccgattgtgccatatatggtgacaaaatttactgtattttgtagtctctcgggattttcttttattgttagatgagaatatatactgtttgtttagtgaaacactactttcataaaagaaattaaacagttttgattcaatcagtgcgcgtttgaccattatcttattcgaaaatttagtgtaaaaatgtaaaaatataagtcacgattaaaataaattcaatgacaaaataagtcatagcaaaataaatgatatttacatttttaataagttaaatagttaaacattataattaaatatcaacaatgtcgtacatttaaaaattaacatataacgaagatagg

SEQ ID NO: 68933 - DNA, 1184 bp, Oryza sativa
ccgattaatgtgagaatttctagcccccacagcaaacgtggtgcctcctttcaaagctgttttaataatataagtagcatggtggcctgcgcagattgcgcggctagcatcattatattttctatcatataatagcatatatgttttctcatcgtattattcaaatatattaaaatgacaacataattttaaattttacagtaactttacaaaactactaatgtgtaatattcatattatattttatatatgtgttagttattaattattttaatatcaaattttagttatttgtaaattatatatattcctatatgtactctagacttgtcttttaatatttttttaattccgaattttctgtaaattgtatttctatatagacggtatgctcttcttccaatattatttatttttatttctgaatttttcatattatattttatatacgtgttagttattaattatttttaatgtcaaattttagttatttgtaagttatatatattcctatatgtactctagactcgtcttttaatatttcttttttttaattctgaattttctgtaaattgtatttctatatagactgtttgctcttctttcaatattattttgttatttctaattgcttttatatgtggactctaaacttatctttcaatattctttaatttttaatttcgaatttcagttacttctaaattgtatttctatatttgtattcctatattgaccttaaactcttcttcccatgttattcttaatttcgaattttagttatttgtaaattgtatttttatacagactctaaactctacttttaattttattatgtttattccaaattttagttagttttaaattcctatatggactctatactctacttctaatattccttattttttaattccgaatttctatttttttcttaattgtatttctatatggatactatactctacttctaatattccttattttaaattgggtgaatagctaatatgctccctgaagtttcacttcggctcaggttagtccttgatgttttaaatatccaaacaagtcctctaaattaattatttgggttaatatagtccttggacccacaaaaagtgccacgtgagcatgtcaagtcatcctcgcatacagcggtatgaatgaaatgaccattctaccct

SEQ ID NO: 68934 - DNA, 1391 bp, Oryza sativa
  unsure (1)..(1391): unsure at all n locations
aagacattgttagacccgcccataaccgcgggcacggctattcgaatagttttactctgccagaggtgtaccactgtaccccaagacacagccccacaacatgtcaccatgtgcctcaataccaccacagtacctcggaaaggagctgtgacaatacccttcgcacaacacaatccaccacagggcacctttcctggatcataatcacccccttataaacaaggcatggactccccagcaacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttattcccaatagtgaatcataagttatcccaatagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggatcggcgagatcgatccaatccaaaacggacggccgagatcgaacggtccacgaccggctcacggcggacgaccccgatgacgtcagcgacaacttcagcgatgacgtcagccaccgcggcgactcgggtgggttcggccccccatgctcccggcgaacgacggctctacgacccgaacggagggcaccaacgggtatagggcgacaaggcaaacttcccggtgaccaaaccggcggcggaagacaaccgacggcgcctgcactaggaaaaaacggcggcgaagatcgggtcgacggcggcgacggtgctcccgcggtcttcggcggcggtgaaccaacagacgatgaccgcgacgacttggcgatcccgacggtggcctttccgagtgacgacgacgacctaagcgacggcggcgcaccgctggaccaacggtggcatggcggcgccnaagctcacggggctagggcgctacacatggcgagagaccaaggccagggatgcggccggtagaggagacaccgggggtccttttaaaggggctaacaggcggcggctaaggcccatggcggccggccgcgagaaggaaacttcgggttccgggagagagagaggaatcccattcgatct

SEQ ID NO: 68935 - DNA, 4808 bp, Oryza sativa
gattgacctctagtccagattcattgtactttgagttttttttttacagagattttggatggatgggacacttcctgctccctatccagattcgtactactagaaagtatctcctccatctaaaatcccttacattctagaacggaaggagtacaatgccacagctagctagctatagctaccactaattccttctttttgcatgtataccattgatgtaattgagcatttggaataaattgaaatactacctccgttccaatataaatgtagttgtgggtttccgtgttcaacgttttgactattcgttttatttgaaaaaaaatatgattagtatttttattgttattagatgataaaatatgaatagtattttatatatgtatgtgactaattatttttttaataaaattttcaaataagacggacggtcaaacattacacacggaaattcacaaatgcatttatattgggacagaggtagtaattgtttagaaacagcccggataaattgtacggcaaattatatatttagttaatcgcgctaactgtaattaattaataatttgagtccaaagataactaactttttcctttagcccgccatcccatcttgtagtttaggatggaggaatttgaaaacaattgtatcatcctctttccttatagtgatcataaatcttatctgatcagtttgctagatgaatggtgatacatgccgtgacgaaaaatctagacatatactgttgacggaaaaaaatatgcagatactccaaaaaaaaaaagaaagatagccttgcgtgttggtcagcatggctaacccaattattccatgaaaattgacatatagtagcatgtaacatagtccatatgaactgaacttttgagaggggaagtagctcagcactttttacattttgactctttttaaaaacttatgttataaataaatctctaaacaaatttattttaataatagaccattttcacggtgccaaggtccctaacgccgaggtacaacgtctcagtgccaatactctcgttcccacaacagccaagacatagaagacatagaggagtcggtgccaaagagactcgcattgacgacctatttataagaagtgctgagtctatttgtaagaacaaatatttatattttttacccttctcagaaaatttattttacaaataggtacctggcaccaatctctttgggaccgatcccctccacgttactaacttagctacatgaggcgaggggtgtatatgactgtgttattggcgccaagacattgatcatggtgccaacaaaaaagaatacatttgtagaataagttttttcaaaggtctatttgtaaaatttatttgtaaaataaattttagaaactaaaatgtgaaaattcaggaaagtagctagtagcatactatacaccgtaccttccatggataggtcatgtcccatcaaatacatcaaatgatcccttcgataaaaagaaagaaaatatgggcatattaccatgcaaatctgaccaaacatttctatgcgacacatataccaaataatggagccctaacatatattcctacaggaacctcgagatcgatcgatagatagatggatggatatatatatcgacgttgttgcgtcaaatcgtccatttttctccatcaaaagttgagtcctttcgatcgatccatggatggcgagaggtgtccattggacgcatttcactggtccatgtttctgcagctagctagcatatcatatgcacttttgttttggagggagatggagaagacgttggcttcatggcgaacccaggaccagccatggcctctttaatttcttgtcatccatggggcgagatggccttttttgagcctcactctttccctcctagatgctccatcaattatggaaaatgcttatcccacgcaatagtgagtaaaaattgtgcttcggagcctttcaagaggtggaaaagtcgaggggtttaaacgccatgatagtttgattcgcatggtagtcattttctcagtcgccatcggatggcacgcggaaattggcatacgtgttgattatgttgtattgatggtataatcacgttgttttcatcaaaagtatattggttttgtagaagtatttataacaaagggtttaatttaatttgtaattaattttggtgtattatttatgtggttttatgaaagcaccgatagatttgcaaagggcatgtttacatccatttggaatagcaaatgccaaatgacaaatattttggtggcaaaagttttagtattgcaaaagtactagttagctggtgattagatgcatcctaaacttttgccattctagcactttttggtggagagagagagtggtcccaaagcactttttggcacaatttgctactacggactagcaaatagcaaatgacaaatatttaacttttgctactagtgtttagatccaaaatggcaaaacttttgccattttggaggatctaaacagggccaaagataactatttttggcacttgctgctccttacatttttacctattttacaatgaaactactaacaaattatgagatgtcacgaattatgaatcatgacgcagaagatcctgtttttttgttttcatcaacagtaaaatcaagcatatgcgtgtacattaattacttaatcaggtcagataatatggctctacggtcagataatagttatgtaactcatgtatgggtatgtttcttttaatattattttagtaatacaggacagatttaggagcgattatatcaccaccatgtgtaattgttctaaaatataaaaacttaggatcggatagaacattttctattatttgtcttgctcggtggtacctatatatagcctagcaaatgttccaactgagtataagctcttatattttaggctgaaggttgtattatcttaaaagaatctgaaattaacatctgctacctcagttcaagctccacataccgtctatgcgaccagacccatgataagaagttcgcgccgccgtccctacgaactccggccaccgtggccgcggccggggagcacggccacgctgagcctcgtggccgacgcatacagatatccgacaagcaagccaaagagggtaaggctgtgtttgtaagagcaagtttccaacactttctttttaattttcgcgcgcacgcttttcaaactgttaaatgatatgttttttttaaaaaaatttatacgaaagtttttttttaaaaaaagttatattgagcaatttctaaaaaaatttaattaatacttagttaatcacacgataatatagtactccgttctatgagcgcactttccatcctgctctagcgaacagtctaaaaagggaaaagaaaagtacagcggaaattatccacaattggcacagtactttcgatgggacatctctttgtgcgaaccggaaaacgtacccccttcctcgactcgtaaagatctcacgtgcatgacaggtgggtcccaccttaatcatggcccactggtaagtctcttaacgtagaaacgtgcgagtacgtggaggttttccttaacctatctatctactcctcgtaaattgagcggtagtatcctttaccctatgctgaaaataaagtccttttttcataaaaagcctgcaaaaatatttacatttctttttttttacaaagaaaactttgccgttgtgctctctgctaaaaaaaaaagtattttcaactgtgatggctatttaaccagtacctagaaaaaaattaacaaagctcctatattttagaggcaaattttaaatactactagcagtcctttccagcaagggagtgaccatcaccaatgaactttcttgtggccttttgggcatggatgcaaataaacaaaacaagatggccaaattttgatgaactacacttttaaataagcctccccttggattctggcctccctcggggagcgagcagcataatctccttctgctagctcactgctccctctcctatcctccatagcctcatcactctccacagcagcagcagcagcagcagagagtgagcagacagcaatatcatatccgcagccttgttcttgctgttctcactaatcaatcaataatacctctcttttcttgaaattttgatttcttctttttatttcctcgagaggaagaacatcttttcttctacttgtttgatggcagagacttgatctttgtcaatcttgtttggttgctcaaatcttttggtggttcagtttggttttttttttctgaacatttgtttgatctgatctttttttttcctttttctaatcgtttctgaatctcttttgctcattggcaccatcccaagaacaacagattaatccgcagtagatttggattaataatttaagatcgcagtaaggttagattaaaacttgctggattaattatctcgagctcaaatgctgaagaagaggtgtgatctgcaagctccctcacctctgagcagcgagctcgccaatggcggcggggggctcctctcgccgaggtcgtcgtcgtcgtcgtcgtcgtcgctgcagggcttctctccgaggagcatcttctccgtcgacgaccaggccaagaaccatccctgcgcgagcccaaggaacccgctgagcggcggcggtcaggtgaccgggctcgccggagttctcgtcgacggcgagggcgagcggcggtgctacgggaggaccggcagggtgctgctcgggatgatgcggctccgggtgcagctgcctcaggagagggtgctcg

SEQ ID NO: 68936 - DNA, 5738 bp, Oryza sativa
agctcgccgatcgagttcggcgtgaagaaccgggacgcgcagctggcgctgctctcgccggtgcagcggtcgccgctgtcgtcggcggcggcgaggacggcgcagggcgaggcggagctcgccgaggactacacctgcgtcatcgcccggggacccaaccccaagatgacccacatattcgatgacctcgtcgtcgagagctccgccgccggcggcgacgcttgccgcctcttcatgcagcacaggtaaaatccaaaaagaaaaaaaaaagaaactctgaattttgatgctctgaacatcgaaatttcatcgttgtaagtaactgagtatgattgattcacttgatatttttgctgatatttgatatttgaaaagatttggagaagtagtttgatgaaattctgtcggtttggtcagcattgagtgcattgtttgttgcggtttttatgaagtttatttttgggtgccttttaaaaattacttccatatgtaactcctgttaagagataatggaaatgctttttaagtatactagataagatcatggtcatactttattgtcaacctacttagtgcaaagcgacgtctttggctgcaattgtggtggtgctcatatggtctattgtcatccactccaataagatttctttttttttcttttcatttggatgaaagctaatgtaaatatagtttagccacagcttggtaaacaatttgatgcagcattgctgtcattgtgagccaatgagtgacatcaattgatctcaggttgcagaaatttgattgaattctggctcatttttttgtggtccctaactcaaacattgataggactgtagatctggggtctccaatctttgtcagtcattagttgccggccctgaaattttttttctatgaatgtgacgtttccttctccttaagttcaggatgagagttcaggatgagaatgagatggatcattagatgttgcctccaatattctctgctaattattgagtcattggatgcattaggccaccaatcagttgttttcttctgaattttcgtaaaacaatacccgattttcgaccaactgatcaacatatagtacatatttgattgaatgataatattgtcatgtactccattacgacaaaggcatactgttactatcaaactgcacacagcttttgcactgtgtgtttatcgcgtcgtgataaatagtatagtttactgattcaccattatttgcctttcagagatgagaaagccttctgcagcagccaatgccgctaccacgaagtgcatttcgataaaaggatcgatgaagcatcggatgtgtcatttaaactgaagaattgattggatcttttcttttttttttcagcctaaattttggccactacctgcttatgagttatgagtgagattatcattcttctacctaaattcttttggtttgaatggatgcatgtgttgtatgggtgagaaaaaaaaactagcagggtttggagagccctatttttgctgtataatcagaagttcagaactggtgatcatgagcaatatttgagcagtctttcctgctgcaaaaatgttcatgtttcatcaccacacatatgcagcattaccccacggtctgcaggttgtctccatgcatctcaccaaaaattcagaacagtgagaaatggagtacttagcctacatccttgtacccatttcccaatcttgccagctaaaatggtgagcacaaatgcaatatttatatgttgtaatcttcaactagttggaaattggagcaaagctgcagcgcagggatctgcacaactaaaaacttttgtaccaccaaatttgacaccataacatgtttttttttactgccaattcaaagcagacattgaagcatgcgggcatcgagaaatctcatcagcacagcaagttaagaaaacagcaacaacaacaataatagagaggatgaagctaattatgctcttaatcatccaatacatttccagacaaaaccaagaacaaacattgatcctgcagactgcagtgcagctgagcaaccatttgttcatatgccaattgtttttactctgcttgtttgatcgaaacagctactggaaacaaccatttattcggatcgaggatagtaaaagcaaaaaagaaaaaaagaaagacacagagttgctttggctgattgggcgaaagctctaggacctgcgaggcggcggggggttggtggagcaggaggagcggaaggcgtcgatgtggtcctggcacttggagcggtcgcccttgttctcctcgaggcacttgcgcagcgccgccacgtcgcacgccgccgccttcttcttcgtcgccgtcccgtcccttccgccgcctccgcctgttcccgcctccgcctccgccgccgccgctgcttccatgggaccctggtggtgtcctctgcagagatggatgagcggaaggctcgaggtcgccgggaggaggcacgccgccgccgccgccgccgccgggacgcgagacgcgagggggagagattgcgctacagttttcttttttttcctcttttctttttcttttcctttttatttttttaacgtgtgattatggtaagctagaggatttttttagaagtagtaacactaacatgaatggaatccattcaatttcaatggatacagcccagagaccataggtggagactgaaatttacaaatttgcaaactatttgctactcttataagtggtaaataagaatttgtcactggacacacatgttatagacggtaagtcgcaaattcttaattgccgcgtcttaaaagtggcaaaaggttaaatgcccctgttttgataccaattgaattttctcaaatactacattcgtccaatataaattgtaattctaatttgtttagcatatattaaggtttgagtagaaagactataatgtctcttattaaatggtgtataggtaagagtgaaatggtagttgaggataaaataggaagaaatttaaatgaaaagtgattaatgagatctttagtactctattgtaacaattattttgggacaaattcaaatcctaaaaatacaattattttgggatagaggtagtaaaaaaaaaacagagaaacctatactaaaacttaaagaacttctttggcatgaagcaatattatgaaaattttagaggaactgagccatttcgtgtgaaaattagtcgaagttcatgcgtctcaaaaggagcccttgtcatttcgttgcatttagtttccagtattaattttgttgtaagagcatgttaatttgattgttctttcctaattcctattagaattaattagtgctaatgtatgaaacaatcttttaacaacaataatatgaattagccaattgtaaaagtttctattctatatatattgttagatcatttttatctatcgatagattgcttcctagtctctactgcgtattgtttcttagtatgggccgcaaaagaaagtgtgttagtaatatcttttagtcgtaaaatttggggtatacaagtcacacagtttgagttacatgtaaaagtttactaatttcattcaagaatgagtttattaattgttttggagtggtcttaattttatcattctgtaaagaaatggaatatgaaacttcatacaccacatgcaaaattaaatttatagtcagggtacacagataggccgggcttattgttttgggccggcctactttaaacatatatctttaaagatagatcgggaacgttaatttcataacaggtagttaatcaacggtgtcgatagtgggggcaaggataattagggtttatgataggtcatcctatatatacatgctatggacggcgccacacacgagtaaacaaaaccaaggtaaacgataaggtctatgatagatctcaccatacaaaatcgatagaagagctagtcgtgtgcaaaggtgaagaaactaagaacaggtaagatctttttcttttttatcaagatgaaagttagatattatttgttttgttgaaaagtattagaagatttaggatttttgattcagcgaatacataaaactaagaacatgtaaggtgtctttctttcttactgagatggaagtaatatatatttgttttgttgaaatgaactagaaaaaaatagatttaggattctgattcagcgcttgaaaaactaaactaaaatcaacaaaaggacttcttttcacttcttttcttttatcttgttttgttgaaatctaatagataatttaagtttaggattcgggtctggcgggtatgaaaaactaaaaacatataggatctctcttttctattgagatgaaaataaaatttcatttgttatattgaaatgtaggagaaatttagggttccaacatagcaaacacaaaaaactaactctttcattctttttaaccagatggaagtaaacattcatttggttttgttgatatgtacttacttactccatcataaaacattctagcaatttctagctatgcatttgaactttatccttaatttgttttatgaaatttttgagaaaatttagattttggattccgatctagcaaatgcgaaaacctaagaaatctctttcattttttatcgagatggaaagaaaattttatttttgttttgttgaaatgcaacactattacttcaatccacaaatataggagtaataattttcaggtatgtatctggatatattcttatctatatacatgacagtgcccagaaagttattagactgaattccttttttactgagatgaaatcaaagattccatttgccccaaaaaaattacttaaaaaaatggatttacactagcaagtattaaaaatcctccatatataggagagatggagaagaaaaccaaaaagaagaaccctagcaagagggggagaaaaagaggaggaagaggggagggaagggagaagaaagtggaggagatcagcagcagcagcagcagccgcggccgcggccgccggaggatggcgccggtgaagaagtccaagaaagggaagcgcaagtccaaggactccggcaagctcaagatcgtcaagtatggcggcggcgcccctcccctcccccccgagctccgcggcctcgacaccgagtggtggtacaccttcctccacaagcactccgagctaggtatcgcttgttccttcccaagatttggtgcggtcgacgattctttaggttgattgattgtttcggcgtgatattccaatcttgcaattccaatctaggtctgagcgcgccgtcagatgagggggaggcgttcaggtatttcttcaggacgtcgaggaggacgttcgactacatctgctcgattgtgagggaggatttgatctctaggccgccgtcagggctgatcaacatcgaggggaggctgctcagtgtggagaagcaggtggcgattgccatgaggaggctggcgtcgggcgattcgcaggtgtcggtgggggcggcttttggtgtcgggcagtccaccgtctcgcaggtgacttggaggttcatcgagtcgatggaagagcgggctcggcatcatctggtgtggcccgggcaggagaggatggagcagatcaaggcgaggttcgaggccgagtccggtctgccgaattgttgcggcgccatcgatgcgacccacattatcatgacgcttcctgctgtcgagtcgtctgaggattggtgcgacccggcgaagaatta

SEQ ID NO: 68937 - DNA, 4617 bp, Oryza sativa
tgttgccagaccagatgatcaaaaacatgattgtgccactcaagcactcaaattagatcagcaacattcattggcatttcatcaatctgtgtgctgtagtactgctcaatatctctcaggatacggatgtcttcctttttgacaaaattgatggccacaccctacaatatgaaatgattatttagtcattagaatctgcccaatcaaactgttacctatatagtatgcagtcagctagctcgtgataataatcatttcttatggctggatgcatggagatgtattgaaatcatctttcctaaacttccaaaaaaaattggaattcagagagtaaatattgtttaatcatttctagaatctaaagataatgtgatgaactgttgggtgtttggttggtagccacacttagccacatctttggcaaggaggtttaccaacttagcctagtgtttggcttgccacaaaaacatatccattaacccgcatgtcgtatacagaaactttaacaagttttacctaaatcatggccagcaatttgttaaccacacattgtgtttgtgtcaacagtgtgaagtcagaattcctgtgttctaatttgtcatatactgacaacaaaaaaatgtcaaagcatttgatggattattattgatgatcattatcggtgaatgtgtgattgtgttgagcaaaaccatggtacatatgtattagtacaaatgtatcagtagaaagtgtagcatgcgtccaagcatttgatcccatttgattgagttgtgtaggtgtagcattaccttgcgaccaaaacgtccagagcgaccaatgcgatggatgtaaagttcacgattatttggaagatcatagtttatgacaagagagacctgaaaatgaaaataataatcaatactccacgcgcagtaaaatcaatagtcttcaaacaaaaatcacaacaatcttgcctgctgaacatccaggcctcgagcccacacatctgtcgtaattagaacacgggttgcaccagacctgaattcacccataatggcatccctttccttttgaggcatgtcaccatgcatagctgataccgtgaagttattgctgcgcattctttctgtaagccaatcaacctgaccaaaggaaaccaaggatataaaaaaaaaaacatcaataacaacaagtgggcatggttggaacacagtgcaattcaaaatagttaaaaaaaatagcatgattgttaagtcgtaaagttgagtcgaggtacccctggaccgacttgtcaacttggtcgaccagtccacaacttggtcatgcaaaaacagggtgcaattactaccattatactgtactaagcaacgtatatagtataaactatggagtatggagtagcaagtaataagacaaagtcaacaagaaataataaaactaaattactaaatataataagccaattagcatggtgaattgctgatttgctacgactcatcacgaataatctatgaccgcctttacgactaatctacaactaacaacaactaatcgcacaacttgctatttggtggagccatggttctctagtctagtcgactagcttgaccaactttacgacaaatctacggctaatcacgactagtcgagcgacttgataacagtgaaacatagcaaactaaaagtatcaactcgtgcaggattgtacaaacaagtaaagtttcaagagacatgctgtaatagcaactgcccagatggcaaaaaacaaaaggtgtttgaaagaactacaaaggagctatgaccataagatagcacaacaatttggtgtagacaaacaacactgaaaggatcaaaaaaaaaaaaagagcaccatatattacctttctcttcgtgttgcagaaaatgacagcttgggtgattgtcagtgtatcataaagatcacaaagagtatcaaacttccattcttctttctcaacagcaacaaagaattgtttgatgccctataaacatgatatgaaaaaatgaacatattaaaaccaacaaagtaaaatacataatgaagatcatcaagtttgtttgataagcaaaacaagtaatgatgttttacctctagggtcaattcatcacgctttacaaggatccggactgggtcagtcatgaacttgctggtcatttccaagatctcatgtggcagagttgcggagatcaagcaaacctgtaaaaatgaaaaagatgtgctggtagattagtattgggatatgactacccaggatatgccatcagttattgacatcaagttcaagcactatgccatcagaaaacaagtcatgcattacagaatccaaacagatacaaggcagcttagtctgttcgtatgatgacacgttacaagaaaccatcaaaacatggacagaatagtgtaacacaaactgcaatagagatggaaaatgctctccctatcccaaaatatgaggacttataagttaggcatgagtattaaggagaagtctaaaataaaatgagggatggttgtgattggtttagacagggaagtaggtcaagatattaaatgctccctctgtcccaaaataaggacttttagagtcaggcgcgggtattatggagaagtctaaaataaaatgaaggatggttggaaggatggttgtgataggttgagacagggaagtaggtgaagaaattaagtggaagatgattgtgattggttgagacaaggtagtaggaaaggtagctatattttgggacaattttaatgctaaaggtagctatattttgggacgagggagtagatgttagatgttatagactagtgaggagctaaatttaaaagaatcaattcactgaggggtgaacattgaaacacaagacaaactatcagtctagtacagttttaatctgtgattgacctggagctctgggggtagatatctgtagacatcatatatctgatccttaaagcctctgcccaacatctcatcggcttcatcctgtaattgaagaatgttattctccaaccatttgatcaaaccaaaaaaaggttccataaaacaacatgagaaataaactaaccagaattaggagcttaatggctcttgtacgcaaggtccttctcttgatcatatcacagactctgccaggtgttcctgacacaacatgcactccatgctcaagctttctaatatcctcaccaatacttttgccaccaatacaagcatgcacttggatattgatgtaatcaccaatggccagcataactctttctgtttgtgcagcaagttctctagttggtgagagtatcaaggcctgaaccctttaaaatgaagaaacaatattaactaccaacagacataacgattaatggaacatagaaaatgacagggaataatcattaataagtagaacaaggcatagaaaaattcatataattaacatggatgccatcactacattatacaatacctagtttctttttctttcaaaaaatataaattcctagccctaattattagccgacgaaagatcaggaaagaaaatattatagcaatagcaatatataaggtaaaaaacagataaaaacatgagccttgacatagaaagtcagaatacaaattgcggtgccctgaatcaaatagctcggaggccaagtcacaaccatagcaaatctacacaaacgtcgagagttgcagtaaggaataaaaatgaatcctatccagacatttatttaggtcctaattactgcactgtacctaacagctaatctgaagtaaaataaatcgcgcattcggaaaagggcgcaaacaagtaaaatgtctggcagctagtagtgaaaaagatgggggtagtaagagtaagaggaggcgtactctcggacggcggtgtcgacgatctggcagacggagagcgagatcatggaggtcttgccggttccggactgggcctgggcgatgacgtcgcggccgctgatgatggggaggacggcgcgctgctggatggcggagggcttctcgaagccgtaggcgtagatgccgcggaggaggtcctcgcggatccccatctggtcgaagctgctgatgacctcgaccccgggggaggtctcgaaggtgaggttctcgtcgtccatggcgccggggccgcgccggacgtggtggccgccgccattgggggagacgaagcgaaaccctagaaaggggaaggagatgggggtggtcgtcgtgggtggggagacttcctgcctgtggatgctaccgctgtcagtatgttttaatccgccgttccgttggataggtcggtttggtcccatttctgagttgggctgcgccaccccaatggcccatgccttacttggtgtcatctcgactgggccttgcctacggttacaattcagccctgctcggcccactaacgtaaccttcttggaataagttcacttcaggtccctcagtttgacgtcgagttcgaataatatcctcaaaccacaataccaagtgcctgttcactttgatgaaaaaaaaaaccttaccaaattttggcaacttcttatataattaccaaaatttggtagcaaactaaatgtagccactttttttaaccaaaatttggtaaggttgaaaatggcatcaa

SEQ ID NO: 68938 - DNA, 9621 bp, Oryza sativa
cgacccgcatgtcagtcgaagcatgaataacctgttgagatggttcactttcggcggcagcatgcttaggacgtcaagcctcgcgagcgctgggagcgcggcggcgtcgaacgggccaaaaaccttgagccatgctgcatgatccgacctcccgcacatgagtctcgccggcctccccacctcctccaccccagtgtcagcgtcgaggatgccgcataacatgatgtcgtgcactcgtgtgcccgtacattgacacactaggatttggcgacagagatgaaccgaagctcgtccggtatcttcaccccacaggcgtggcaatgcacatatggcttgagaaggaggacggagagggacctcctgtcctaccgctcgtcgaggtcaagctctgcgtggatcttgccacctcgagggccacggtggctaggccaccaatggagattgggggcagggatggtacagtggagattggggacaggggcagcgaggtggaggttgggatgtaggcggcgtggcacggtgagttggaggttgggggcaccagcatagttgtcaaggccaaatctagtctggcgtggtcgtcgccgcgttgcggccctccctcccctcatcttcactgctttactatgagcctgctgaggatgttagcggggtgaactcgtggagaccaagaatgaaaccagcgagctcgcagaggacaccggtgaatccggcaagcgtcagagaagggaggagagggatcaagaacattgaacgttgcgccgccgccgctagctccaaccttgcagcgttgcctccacactgccgccgctgatgaagatgccacatcgttgctcctgccctcctctcgcccgacgaccgcctccatgatgtcctctttttggttttgtctttttttttttggctaagagaaaggaaggagagatatgacatgtgagcctaatatcatcattattgttattaagctgactggatcgtcacgtaggagcaaaacctctccagattgagttaggagataattcgaccggtttaaaaagtttgagatgtaaaatgtatggttctgtattttagtaggtaattcgtactgtcgtaattttctgggggtaatttggacttttccgaccacaattggtagcagcaggatcgatcgagtccccagtggctatgatcgcaactttgtgcttgactgcggtgaaggcaagtctggtttgtgcccttcggtggaagtaaactgatggaccgtacccttccagcttgagggtccttcacatttgggcagatgctcctggtcctggagtgcagttctgttctatacatggcatttgtctacgggaagcactctgcactccctctgtcttcccaaacgctgtgaaccagcctcggtggtcgttcaccctggtgacaaacgcttctagtcatatgatgctgcttgagttctcaacaaaacgatccagttcttgtagatatacgttcttgtctttcggcctttttttttttgcgaggttgatgcaatggtagttatatactgatttcatagggttagataacagtgtagcaaagttagggagcttacgacctacgtacacaagatttccctgtgtctgctcaatgtacataaaaaaaataaaaaaacaaatgcattgtaatttgatgaagtggatggtaagtgcataatgcattaggatttgctaaaattaaaggtattctagccttttaaactttggattgatttgtatatcatgagataaaaatgaagtcttttgatacggaggtagtgctaagcttacttaattttagaattaatttaggtttcttaattgttttctagcttttaaccttgaattttgatccgctaaaaagagaagtagaaaagtgttactccctccatcctaaaatataaggattttaagttggatgtaacatattctaggactatcaatccggataatttttttttcatattcatagtcctagaatatatcaaatcaattccatctaaaatcaggacggagagagtactctaaaattgtcttttcaagctttgttcacattcataaaaaataccttccaatcgagaaaatggacatttggctactttcaaaacatggtttcgctaaaatgtcatctcgaaaacgcgtttcgttaaaataccaatatggagcgcgtgctcaccgccactttgccatcttggccgttttgtgtattttcgaaatcatcttcgctcctccatcgagtgacgagacaaaattgtccttcatgtcctccgctaccgcctcgtaccacgagcagctcactgtcttcctcctcgtcctcctccatggatggcgtccggagcggtgctatctgggagagcccagacggcgagtcctctgacatcttcccctccctcgacctcaccacctccaccgactaccttgccgcggttgacgacggcatcccggaggtcgctgactacctcgccgcagtcgacgacgacggctagggtttcgaggcggccccatggcctcgcaggcctccgcaaccacgaggcctccttgacgacctcgcctccgcctccgcctcatcggtgctgtctggcggcaacgggcaggggcagtcgccggtggttccatcgctccgtccacccgcgcacccgcaggtgcgcctcgcttcgccatacccccagatgccctcgctggcagtggcgatgggctcatccggcggcgctgccagggctgccgccacggaaggggaaggatggaagggcaatttcgtcaaatcacccaccgaagaagcaaaaatgatttcgaaaatgcacaaaacggccaaaatggcaaagtggcggtgagcatgtgtttcatattggcattttaacgaaacacatttttggatgatattctaacgaaaccgtatttttttgaacatggccaaatgtccattttctcgcttccaatcaggccctctgcactaccagtctgttagcatcgtttatgtccatgttggaaaaagcgcttagaaagcgactctatggagaagcaagcagacttatttttctcttagggggtgtttggatccggaggtgtaaagttttaacgtgtcacatcggatattatatagggtgtcacatggggtgttcgggcactaataaaaaataattacagaatctaccaataaaccacgagacgaatttattaagcctaattaatccatcattagcaaatatttattgtagcaccacattatcaaatcatggagcaattaggtttaaaagatttgtatagcaaattagtcgcaatctgtgcaattagttgttttagcctatattttatactttatgcaggtgttcaaacgttcgatgtggtagggtgtaaagtttttgtatgggatctaaacaggcctttagtaacacagttgatataaaatatttattaaatgtttttcatagttgcgttgtctcatggttgctaatgactagcaggtagtgtttcacaactatattttgtctaactcttaattacatggcccacatgttataaactctattttttttgcctaactttattttagtttagtttatcattttgtttaccacaaaagtatgacaagactaagcttaaccaccttagtaaaaaatatgtggtaccatcagttatcaaccaaacatgcccaagttcaacgctgtccttttcaccttgttattttagttgccatgcctaatcttgtttcttgatttatttttttttcagaagactagtttgcagatctaaaaacggaaattaggtttgttctttgccttgtacgcgctgccaattaacatagcctatcaaaattttgcatactgtattgtctgcatcactgaaatttgcaattttgtgctatacactagctaggagttagatagtattaattctatcagtagtcttttcttaggaccaaataatccacttcaataattaaagtagtaattctgccagatggcacacatgtcattacacagttttgaccctgaacaaaaatcaaagaaagaagacgaaagatgagagcaggacgaacatgcattaggtaccctgacattctgttcttctccagatctgatctgatatgatgcaaatggcctgcacgaaaatgcgtattattgaggaagagaatggccctcatcttgccccagatgctggtacctgaccctggcggcgccggtggcctccgccacctccgccgacgagcaaatgctgggcaagaataagtaggcccgccgcccgcgccctccttcaacggcggccggaccttgctcctggtcctggggctccccacgctgccggtggcggcggcggcttgcttgcttgctgctgctgctcatgttcttgccgtggtcgtggctgacgacggcgacctccatccttcggaagtactcgacctcgcggcacaccagcgagccgatggtgccctgcgcgccgacctccaccggcgccgacgccgccatgcccggagggtagtggtactatgatgtcatcagatgggaagagagatctgagtggatgaggattgtacagggtttagaaaacaggacttcccatacgagaatcctgattcgcgcacccctggcccatacagcccacgcggcgcgcgagattttttcttcgctaaccatcgccgttttcttttttatcgctttccttttttttctgttttttccagattactttttaatcttccagcagcaagtgttttcaatttttttttgaaagtttttaaatcttgacttgaaagtttttaaatcttaatttaaaaatttttaaatatcgagttgaaagttttcaaatttcgagttgaaagttttcaaatccgagttgaaagtttcaaatcttgagttgaaagttttcaaatctgggttgaaagttttcaaagttgagttgaaagtttttcaaatttgacttaaaaaatttaaattttgagttgaaagttttcaaatctgggtttaaaattttgaaactgtgacttcatatgtagatttctttttaatttgttagttaaaaaaatctcacataaaaaataaaatcttatctactactacctacgccccaaaatatagcaattattagctatgaatctagacacctgtgtgtccagatttatagctacaaatgcttatattttgggacggagtaacatcattatcataaactgttattatctaatatactagtagattagtatttttttagagaagggtattttttacccggcctctacatccaactaatatactagtagattagtatttttttagagaatggtattttttttcccggcctctacatctaaccggatatatgcggtcattaaaattaggaacttagccccgcaaacaacccaatctaaaattcgctcatatgaaaatttgaactcaggaccttggggtactactcaggtgactgcaaccaccaggctacatgccctatcgtagtagtagattagtagaactacttaggccgaaaaaacgagcgacggcggcgcgtacgcgtcaggtagccccttcccctaaccgggcaaaaagaaacggttttgctaaaaaccgtcccaagaaaattagggaggaggacaatttcgaattttggaccgccggatatgcatcaatattcatgattaggagaggaagaaaatgtcacaagttttctctccatgcggacagcagtgttagaattcacgttgtcaacaatcaaacaagcacacacgaacacacggacacgaaagtgaagggcaatcaactttattgatgtttctctctctgttacaagtattactttgccctcaacctcactattgtatttatacccacaataggatgtcctatatggatacatacatatatatttggtataagcccacttcattaataaggaaacagaagaatagaaggaggaggtaccgtgatcctcatgatcacggtcctataaatccgactccttcgggagatcagtttcataacactcccccttgggtgaataccgtgctatacatatgcctcatcaaaactccttccaaaaacccagtgggagaaaaatgaataggagaaagagtacatagtacacgctacttatattgcactgttgcctcattaaaaacctaaatgtgagaaacttcaaacaaaactcactaaagggaaaaagagtacaaccataagctaatctactggataactctatcattcttcaaggataactctatcattcttcaagaatgatgtactgatctgcatgatcaatatcaacggaacacagtcagggaagtgctcccccgatttgtgcacatctctcatcctcctcataccgatgccatgcacaagcttctcaaaaacactaattggcaaagacttagtaaataaatctgtgagattttcactagtcttggtgagagtcaccttaatttcttctttcttttgcaattcatgcatatagaagaatttaggcgatatatgttttgtgagactcgtcttcacataacccgtttgtatttgtgcaacacaagctgaattatcttcaaaaataatggttggagttggtgtgatattcagcccacatgtattctgtacatgttgtatcaccctcctcaaccacatgcattccttgctcgcttcaaataatgctataatctccaagtgatttgttgatgtcgcgaccatcgtctgcttcgtcgacttccatgagatggctgtaccaccacagagaaacacatacccagtctgtgacaatgctttatgggggtctgacaaatatccagcatcagcatatcccaccatggtcaaatcttgattttttctaaagaataaaccgagatcttgtgtgccacgtaaataacggaagatttgcttaacgccattcaaatgccgtttggtaggagccaaactgaaccttgcaagtaggttaacagcaaatgcaatatcaggcctggtaccattcgcgagatacattaaagctccaatagcgcttaaatatggacattcaggtcccaataattcctcgttattttcctatggtctaaatgggtcactctctactgctagagatcttactaccatgggggttctcgtcggatataaatccttcatattaaatttctccattatcttctggatatatgcagactggtgtaacaataccccttcatgagtgtgctcaagctgcagacctaagcaatatttagtcttacctaattctttcatctcgaactccgtctttaggtaagaactagcttccttaatcacctgtgtggtcccgatgatattcagatcatccacatatacagaaataatacaaaatccatgttctgatttttttgataaacacacagggacagtcatcattcttgatgaatccttttccttctaggaattcactgagccggttgtaccacatcctaccggattgttttaacccatacaatgatctttgcaatttaacactgtatatgttgtgtttttttcttcaggaacttgaatcccatcaggaactttcatatagatttcaaaatccaatgacccatataaatatgcggtcactacatccatcaactgtatttctaagttcaaattgactgccatagatattaagaaccggaatgtaattccatccattacaggtgaattggtttcatcgaaatcgatgccaggtctctgcgtaaacccttatgctactaatcttgctttataccgaaccacctggttgttctcatcccgttttcggacgaacacccatttatatcctacagaggatatccctacgggggtacgatcaataggaccgaataattttcttttattgagcgagattaactctgcctttattgcttctttccatttgacccagtctgaacgcttttttgcattctgccatggactttggttctggatccagatcaatgatcttagcgatcttttcggcaaagtatatgtcgacaatagtagtctctctattgtatgtttcacctgtatccacataactggtggatatttcctctattctttcacattcctgatcttcattgtttcccgcaatgtttaagtcaggaatttccggtctcctagtgctagtagtaattgcgcgcgcattctcactgggttcattgccatccgggcatgtcactgcaggtggctcatctacctggtgagctccttcactattctctggtgctgtggtattctgtccaatctgttgtttcgtaggacgtctcctagaaactttagtttggttgtgtgcaaccggtggtctccccttcttcctagaagttggggtagatgtagaaattaatttgaaaaccagttcctctgcgtcaggaggtatttctactctttccggtgcattcacagcaggtatatgagatttcatgatcccctttaggttagtgaaggcttctggcagattatttgtaattctttgcgaatcaattatggtctaaacttcctggtcagattccttagtacgtggatctaaatgtaggagatttttagtttcccactcaatttcgcggcattcgaccttctgtaggtactttcctccccctaatgccgggaaatgatcttcattaaatatacaatcagcgtatcgacccatatgtaggtctcctgtcaatggttctaaaaatttaatgatagacggagattcaaatcttacatagattcccaattttctatgaggacccattgacgtacgcttaggtggcggtatagggacgtatacagcacatccaaatttgcgtagatgggaaatatttggtgcatatccacgtgtaagctacataggggatacaacattgtatgcagtaggtctgatttgaagtaacgccgctgcatgcaaaacagtgtgtccccaacatgtagttggtaggttgctatgcagtagcaatggcctagcgataagcttaatcctcttaattaatgattcggcgagaccattctgagtgtggacgtgtggtacagaatgttccactttaattcccaaagccatgcaatattcattaaataccttagaggtaaactccccggcattgtccattctaatggattgtatccggttacccgggaaactggctctcaactggattatttgggaaataagccgcgcaaaagcgtggtttctagtagaaagtaagcaaaaagtgctccatcgagttgatgcatcaattaataccataaaataccggaatgatccggacatgggattaattggtccacatatgtctccctgtatttgttgcaagaatactggtgattctgcgttcacctttagattagagggtctaacgattaatttccatgttgcacaatcagtgcaaacaaaatcttcttggtttgggaaatcgttaggtcgtaaattatagccatttgaagttgagatgattcttctcatcatccctagacctggatgtcctaacctatcatgccatattctgtatgactcgggatttttaaatattgttttcagtgcaacattttcgggttttatatgagtgtagtacaggccagatttcaaggaagggagtttttcaacaatagtcttacgatttccgtctaatttcgttatgagaagaaattcgagtttattctcatctttggtttctacatgataaccattagcacggatatcttta

SEQ ID NO: 68939 - DNA, 1268 bp, Oryza sativa
acccgtcgccacctttgctttcgcctctcgccatcggaagagccctagcgccgtgtaacctcgagccgccgtcgtcgccgtcggtccagccgtgcttcgccgtcgctccagccgtcgccgtcgctcggggaggtcgccatcgtggtcgccaagtcaccgccgttctcgtccgcccctccgccgtcgctgttgaccgccggagcaccgtcgccgtcgtcaagccgaaggtcgccgccgcttcttcctcgacgccgtcgccgtccgttgattttccaccgttgctttggtcgccggtgagttcgtcgtgcagtccgctacccgtgggtgccctccgttcgcgccgccgcgccgtcgttcgcggcgagcgtgtgcgcccgagctgccgagtcgccgagccgccgccggaggtgacgtcaccgctgacgtcatcgtcgtcgtctctcgtgagccgccttagacccgatcgatctcggccgtccgttttggatggatcgatcttggccgtttcgtttccccgtgaacccgttgccgtgttgcccggtccaccgcaaaacccttagccgctgacgcaataaatcccttttccttttcaaaaataattcattattgcgtcataattcaattaaaatccatataagtgttttaatctgatttaatcttcaaaaattcataactaattcatcttagctcggatttagttggttcaagtctctaaatttttctaaaattgagatctacatgttaaaaatatccacatgtactgttcatgcttgtttatgtgctattttggtgattttgctcctttttgtttagattccgacgtttccggagagtctgttttcgcaggagaagaatttgaagagttccaaggccagcaaggcaagtcacacagatcccaaacaaccctttgagcatgctgaacctgtttaaagctattgatttatttcaacttatgcattgttttctgtcacgcccggaatttctatccaaaattccaaacgctttcatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaataagataaacggcgcagacgactccactccacaggcagcttgaccaaggctacacctaatccttcacaccatcagcatcattgtagaactcttcctctgatgaatgattg

SEQ ID NO: 68940 - DNA, 850 bp, Oryza sativa
cgccggagtagtggaggaggtggaggaggacagagagagagaggcgggattcaaatcgaatcccggccatctcgcgggcgcgggggtgagcgggagtggggcgtgggcgcgggagggcggggcgtgcgggaagtgggcgacgtggcccggggcgcggagtggggcgccgaaagcgggggaggccggccgcgatgggtggtggtttcggcggcggttggcgcgggcgtgggcggccagaggttagggaaagggctgacaggtgggccccacctgtcagcgcccgagagggagaaggaggccgggtgaacttcgggagtaggagggaggagcgggccggcgcgggaggaaatgggccgggcccaagaaaaagaaaaaaggagggaaaagaaaaataaaaagaagaaaggatttttccagggatttaatattgcactttgctcattttaattgattaaaattattttcaaggctctgagaattccactaaaaatcgtgttagcatattttgacatgtagaatccaagaaaaattccacatgtcgattccgattattatttgcatttattaattagggattcatctctaggttaaattaaacaattacttcggacgatttattttatgaatttagagcaagggaggggaacttcagggcgtgacagaactcgagataacaagttcggcaagtggtcaccgaattgggaagggccgtttcaaattcataaggttgtgtccaaatgggcttatatgttgcaaggacttaatggagaagtctatggacgagcgctcaatggcaaatacttgaagaaatattacccaagtgtttgggtgaatgcatgatcggctggat

SEQ ID NO: 68941 - DNA, 10243 bp, Oryza sativa
ccagatcaccatgatactggttatagtgaagagaagtgcgagcaagtggatcctaatggcaagataatgagagatgtcattacaggatatcttcaaatctaagaagcttcccattgaacttagctaagctgactggcagtactctggagttgcaagaaggcatctctgttcttatgtttttctcctcagttgtccttgttgtaatcagacctgctggtctccattcggtaaagattagcaatgaaataattcagttaggaattagctagctcaggagcaaactatctcttccttgagttaaggaaaaaatgttaatgtgttcatggtgatgacaatctccatcattttgaggtacaagatatatcagtggtcaattgctttgaatgaaggaaatcgcctttaaggagagtagctattcaactttgttttataaatgtttagatttgcataatatagtaaaactcatgctcgcatgttattaaagcatatccaagaaaaatagtaacctatatatgacatgttgagttgagtgaactagtcttggatgtacatcatctcattttcattttattgcaaggctattgttttctaaaatcatacatctaagtttgacgtgcctggtagtgttttactgaattcctgatgatatttgtgactgcatgatgttcattctgttttgttgatttactatttttttgaagatgatgtggtatcttgttttgttgcaagtgctttatgtgtaattatatctgggctcgatgtaaaactggttgcataatggttataaatcttgtccatgtaaaactgtttcccctcaaaaacacaagtataatgttcttaaagaatgtgattgaatatgcttcttctagttctatgtcttctggtctgctattttagtacattttctgcagactaatattctgccctttttttagggaaaatattctgccattttgggttggcttacctacagattcccggaaaggctaattcgcgcgtacgcgttggcggcgcgcacgctggcccactaaggcccatgcacgcacgagctgcgcttctctctttttttctttcttttttagccgccgtttcttttttttcgctgtttttttttccttccgtacggataggagaaaaaatcgtaattagtttagattagtttcctatttttactagtgattagtttactagtaatttttaaatcttaactttaaaattttcaaatttggacatgaaagttttcaaatctcgagttgaaagttttcaaatctcaagttgaaagtttcaaaattttcaaatctggacttgaaagtttttgaatcgagttgaaagtttccaaatcttgagttgaaaattttcaaatctcaagttgaaagttttcaaaattttcaaatctggacctgaaagttttcgaatctcgagttgaaagtttttgaatctgagttgaaaattttcaaatctcaagttgaaagttttcaaaactttcaaatctggacttgaaagttttcgaatctgagttgaaagttttcaaatctcgaattgaaagttttcaaatctgagttgaatgtcttcaaaatttgactttaaaatttaaatcttaaatcaaaagtttctaaatctaactttaaaaaatcgaaaagaacacgtaaataaattaaaatgtgcagaggagaaggggcgtgacaataggagaaaaatcaagaaaaaaaagagagaaagaaacatataaggggaagggcgcgggccgtgcgagtcaggaagccccccagattccctttctatgtcttaattgcggcaatgtaaaagctgggaacaaaatctggttaaccaacatatatgatgatactcatcagaaggcatactattcaaaatatattaaaatgaagaaataagaggcatactaatgactgatctaatacaaggtcacataagatctagctgctgcaaggtaagcaggcgacaatagccatgaaaatgaccttgtgcaataactagaagacatagaacaaggcacaagtagggatgagcacactggccattaaactcgctgctttctttgagtttgtggcgcttgaggttttgttagatcctgcacttcctgcatcgaattggatcagcccagtcaggtacttgtaactaaatttcacaatcatctagcaattagcagagtacttgtaactaaatttcgatctattatttaccctaaaaaaaatttcgatctattcgtgactttacctgcaggtggtggacttggttcatcctcgtttgtctctgctggctcatcagctaatgtaggtgtatctggtgctggaggtggagttgggacggctgaaacaaatcatccacacattctggttaatcttctgagcttaagatcgacatgaactgatcatcatctgcatttgattgcgagatagcatttattacctgtgcattggctgattggtggtgcctggaccttgcagacaccagggagctccagcgccctcgtgtggttgatggagatgccgaaggacgccgcgctgccatccaggaccatgcagaggcaccgggggtcggactggacgacgccagcgagcgtggtgcagcaggtgaactcggggatcggcgatttgccggagatgtaatccaggcacggggagagcgtcatcatcacgctggagcagccattgttctgcgatgcggcacgggaagcaagcattgtcatcaccaccacaatcaccgccaccactggagcccgtgggacgccggtctgcgactttcttgcagccattgtcagctgccgatcgatggtccctccctccttccctccctcctcctcgacgacgaacaatacaatgccggtcaaatcaagaactgattgatgtatgtctctcagaaaaaaaaaagagtaaaaatgcttttggggcatcaggtgagaatggtttgtgaggatgttgatggaggatgagatcgttgtatgctgcagccactcgtgccggaattgaaggaatgctgtgccgggaaagtgcagggatgtgttcttcctggccacacagttgtctggccatagtgctaatgaacatgtatgccattttactgcagtcctctatttatggaaagaatttgatgcatatgcagaaatttagggggtgttttggtctggttttgctccaatttgggcacagccttacccttttctctcttgttgtttccagaatcagcattagcagactagcatgttgtgacaattatagacagtgaagaatagtgaagaaaacctgtcatcatcaagtgactattttttttttcttttttatcaattttagtgactgttttttttccatatgtatacttatcgaacaacatgtttaagtattttccttggtgaaacaaacaattgtttagtgaatcatacaattgtaaaattaagaaaattctaatctagataactacagaaacatttataggtgaataacttagaacataatttgtagtttggtgaatcatacaaatataaaattaagaaaattgtaatctagataactacagaaacatatctaggtgaatcgatacaaattaaggaagaaaccaaattaaatgttaataagtaagagtaccaaagttcatcttttttttaaaaaaaaaacactaaagttggagtaagttttggctctccagaactctagattgacactaaacaagagtattcagatgactagtaacttacaacttcaaaagttgaaggtttaacatgtatatttattcctaggacatgcctgctagctgtccctcttggaagaaggacgcatatcactgttcttgttggaatattagtgaattccgatgttgtttttgttgttaggaatgcgaattaatcggtatttggagcacctaatattccaacacgaagaggaagcatcttgcctaccgaaagtgcatgcatctcactgaaaatttcataaatatatgtccaattgccaacagttaatcaacaaactaatgccaatacacccaaacaaattcatcaaaattcgtatggtagtctctgtacatctcaccatgcaaaaacattgatcatgtagcaatgtcattagtcatcatcatcacctgtccaataattagttagagctgtcattaggaagagttggtcaccaacgacatgcctaagattccatcacttcacactatataaacaccccaacttaaacacacaatctcacacaccatcaagctataatccgatcttaattacatcattagccagctaattaagtatatatctagcttgcttagctagaacacactctacagctaagctagcaatggcgcgcaataatggcgtcgcggtgatgttcgccgccgtggtcgtcgtcgccggcgcgctggtggcgggggcggcggcgcagagcgggtgcacgtcggagatggtgagcctggcgccgtgcctggactacatgcaggggaacgcgtcgaggccgacggcgtcgtgctgcgcggcgctgtcgagcgtggtgaagtcgaggccggagtgcctgtgcgcggtgctcggcggcggcgcctcctcgctcggcgtcaccgtcaacaccacccgcgccctcgagctccccgccgcctgcggcgtcaagaccccgcctcccagcgagtgcagcagtgagtctctctctctctctctaagatggttgccggagtttggtcaaattcaaactgctttaaatttgtaaaaaaacatagtaacattttcaatctaagacaaatttattgtgaaaatatatttaattattgatttgatgaaactaatttagtactccctctatcccataatataagacgtgcacacattacaatattcaaatttaaaaacgtttgaccaataattattataataaaaattaaaatttattgtttaaattatatcattggattgacaattaaatttactttaagatggttataaatttgttgcaataaacctttataatatatgaggaattttaaatcaaagattagttttgaagactgtgtcaagtttaaccatgcgttatattataggattgagagagtattataaatgttattatatttgtctataaacttagctaaatttaaaataatttaattttgatcaaagtcaaaacgtcttttataactgaaggagtattactatcttcttccatttctctggcgagcctccgccgccgtgggccgtagagtgggtgactgaccgtcgacggacgactacgttgtgttgtgttttgcagaagtcggtgctccgattccgtctccggcgccggggggcgcggcggcgccgaatgcgccgccggctgcagggaccgggtcgaagacgacgccgaccaccggcgcgagctccgccggcgagagcgtcggcaaggcggcgtccgttgcgatggtgatcgtgtcggctgcgtttgcaatgttgtatgcttgattaattagtttaatttctgcgtggattaattgagcagtttgattattgtttataatgccattgatatatactgtgtgacatgtcatttatttcttcatgtattttaaatttcgattattattatattcattgtatgatgatatatcatttgttgaataatatattcaagtgctttgcatttgtccggtacgtttgggtaattcctgatgattactgcaaagatttcaagtttctttgtggatggatctccttgttgtatatggaatccatttccattggtctcatattgttctctcctcgttcaagcacaataattaatttatttttaaattaaatatccgaaaagaatgaacttcaaaacctggacacttttcagcgtaccctaatatatcaaagtgttcactttataataatgaaataaatttccaattgaaaccaatggtttgatggacaaattcctgatggtgacaggttaatttgctggtgtgagattgattcaaacgaatttgatcttatggatggagatgtttttgtggcagctggttcatcttgttttctttctaggaatgtagtaataagcaaattaatggcattcatagagtgcttgtaataatctgattttgaacagttaaaatagatggttaccttacaatttctacaattagttcttggttaactaactgaaatataaatatttagttcagagaaggtacaaatttcagttagcaagtgggactaaaatatgacctttgatatcccagaatcttaataacgaaaatctctgtactgactcatatatagtaatgttgcatattctttctagtcaaagcacaacatattatgccaaaaaaaaatgtgcttatagttggttaattaggttgttggtgagtagtatcttgcatatagttagattggtctggctggccaactccagccaaatgctacctcccaattcatagatttttaccggttggcatatttggttcatgcactatgttctatatgtatatacgcagaaggagaaacgtcacaagtgcaacgacatgattactattttgaattgttttgataaaaactgcagtctcagtcaacaatgtaaaagtaagtacattgtaatggatggctaattaataaatttacgattcacaagcaaaaggtatgttggataactagtggcttattctgtcacatcctgatttttgtttcagggtttataaattatttaataaattaataatagaatttatgttaaatgttctttaatttacaagtgaagtaaaatgtgggaaataaaatttcctaaatataaagcatggatggatttaatttttgttaaattctccatggttaattatactctctgaaattttctcggatttttcagagctcaattcttaaataatacaaagaacagttcagtaattatttgatcattaatgatctaattatatttgttaagtgcttttcttgtttaaaaatccttaaattataaattgttgtttaaaaggaattattagaaattattttaaaagcctagaagagaagatctaattttaatttgctaaatctcaacataaaattgggctagataaaattttgttaaatactttgcttaattctataattcctagatttttctgggatttatttgagctaaggaagtatttttaataaatggaattgcatttcataaataatttaaattgaaaaaggtttttaaaagtcttcttttggctttgggccgaaagccggcccaaaacccttctctctctctttctctcggcccagtcggcccagtccgccgagccgccgctctcctctctctctcagccgctgacaggtgggccccgcttgtcaggttcgtcgtcctccttcggccgccgccgcccgcaaaccctagcgcgccgccgccgccttctccttccaaattcggccgcgtctttccttctccggccgaatcttttgaggggaaatgatcttctcgatctcctcttccttttctcttttggattcatcgcctaattcggtttggaaactcgatggattcgagatcgaatcggattcttctctctctcccgaacccgatctttccttctcgtcgccggtcgccgtgggccttcgccgccgccttcttgcacctataaaaggatccccgagctctcctctatccgccgccacctttgccttagcctgccgtcgcgtctagcgccgcctccgcgtagcccgagtcgccgccggtgccgtccgttgcccttccgccgttgttttggtcaccggtgagttcgcggcgccgcgctctacccgttggtgccttccgttcgcgtcgccgcgccgtcgttcgccggcgagcatgcgcgtccgagctgcccaagtcgccgccggtgctgacgtcatcgctgccgtcatcgctgacgtcatcggagccgttcgccgtgagtcggtcgtggaccgatcgatctcagccgtccgttttggatagggttgatctcggccgttcgtttccgtgagccgtcgccgtgcacccggtccaccgcaaaccctagccgctgacgcaataatcctccttttccttttcaaaaataattcattattgcgtcataattcaattaaaatcaatataaaggttttaatccgatttaatctttaaaaattcataactaattcatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaaatatgatctacatgtttgtttactttatatgtactgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacataatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgactagttgagctatatatattggttcagctagatattagatatgattgctttgccatgcttagaaacattagcacacaattgggataactaatgtttcattatcacttatggttatatttaatggtagctcacgatggtcatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccaacgtgggcaacggctttaccttttgtatagcatgattcattgcggagcaccagactgagaagtggcggagataagcccacgggggtcgctggggagtccatgcctctggtttttgagggggtgattatgatccaggaatggtgcactgtggtgagttgtgttatgcagagggtattgtcacagcctctattcgagtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataagtattgatgttataactggtaataatttgcttagctcctggtttggagttagatctgtacagccgggtatggttgttcaggatggttgggcctgtacagcatgggtatgctgttcagtgttgattaaaatttctgattaattactctactgttttactactctaaactctttgctaaatgctgctttcgcaaatgagcctatactacgccatcctttggtatccttgtgcacttgcatatttgctgtgtggcttgctgagtatgtcatatgctcaccttacaataatcaatcaacctcagttgaagaaaaaggatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcaatttgtgtacctcggctcattcctggacgaggatttcatgcacaaataagttcggaaattactagtgaatttccgggcgtgacatattcgctgatccagagtagaagacgacgatctcatgcacataatagataaacaatgaacacggatatagggagaggcatcacagctttattgatttctcatatgtggatacatcagccaacctctcaagccctctctctgtatatatacccataataggaagagtcccattaggatacgtttccatatatttggtatgaacccatattatttttggcaggagataatagtttcataccactcccccttgggcgaataccgcgctatacacatgtctcattaaaaactccatccaaaaacccagtgggagaaaaggataggagaaaagagtacatcgtacacgctagttatattgcacttgttgcctcgttaaaaaccttgcgtgagaa

SEQ ID NO: 68942 - DNA, 752 bp, Oryza sativa
gatttcacctagtcacctaataatcaaagatccccgtgggggcccacctgctgatcgataacggtcgctgtgacggtgggcccggggtggcctgggtcgtgattgggtgaggccgtccgtcggaggggtaggtgtgtgtaggtaggcttggctctgagtgtggggcccatccgacgtggcgtggtgtgtaagccaagacgacacgcatgcacaaatccggttcgtcgaggttgacccatcgcgttagacacatacaagcgggggcggctaacaccccccatcctttctttctcctcatcttcttctcttcctactacaccataaatttttaaaaaataaaaaacataagcttgaaaaaaattatatatagaaatactatatataaaaaaattaaatttaaatttaaatttaaaacaggtatgtaaacttttgacttataaactttgggtctataaactaatatttgaatttaaattcaaattttaatcgggtatataaacttttgacataaactttgggtctataaactttagatgtacaaaatactatatataaaaaatatttgaattcaaattcaaatttgaattggatataattcaaattcaaatttgaattgggtatgtaaacttttgacttataaattttgggtctataaattttaggtgtataaactttagatgtatagaaatattatatataaaaaatatttgaattcaaattcaaatttgaatcagatgtataaactttaggtc

SEQ ID NO: 68943 - DNA, 535 bp, Oryza sativa
accaaatcttgaaatacttagtttgaaaaaataaaaatgttacgtgcaaatttttgcactgaaaacagaagtactttcgtaacctcataaacttcttagattttacaaacatattactccctccgtttcaggttataagatgttttgactttagtcaaaatcaaactgttttaagtttgaccaaatttgttgaaaaaagtagtaacatttttaacccgagacaaatttattatgaaaatatattcaattattgatttaatgatgaaactaatttagtattataaaaataagtatattcgtctataaacttagttaaaaatatcttgtaacctgaaacggagggagtacagtaaaatgcatttggcgccgccacgcccgcccacgcgggagacggcatcggagcgccaacttctgcgaacacacacacacacaacacaatgtcgtcgtcgacggtcagtcacccacgccacggcccacggcggcggaggttcgccggagaaatggaagaagatagtaatagcactagaaaacctgg

SEQ ID NO: 68944 - DNA, 750 bp, Oryza sativa
  unsure (1)..(750): unsure at all n locations
agtaaatgaacattttacactccaaatgagtgctactccagctgctaagcgtatgactgagatgtgataacaatctcacaaaaaatggacctattcttttttttttaaaaaaaagaagaaggatgaaatgcatgtagatagatgcgagaaccagaatgcagacaataataacccacgcaaccctgacactgcacgcaccgacaattcgtcgagcggcttgggcgcgtcccgtccggccgccaccggcacaccaccccccgccttcccccgcgacagctcggcgttcccgggcgacgccacgagcgcggcgatgcgcttgcacgcgctctggacgtgcgccacgaggacgacgaggtcgtcggccgcgccagcctggcccatgtactcgagcagcgtgggcggcgtctccgccgccgcggtcgccgcggccatgccgtcggctgctacggcacgcgcccgggagacgggcgagcggcgcgcgagcggctagtggcggaagatggggaggaggagggcgcgagatggatgctgcggtggcgggtaatttgaagttggcggcagcggaactcggtggatggggaggagggaaagagaggataacggcatagtgtanccagtggtagtagtggatggttggttgctggatgatgcgtggctcgtgtggatattgcactccacgtttcattgcaaaaattggaaaaatatattacaaaattttattttattttttaataagacgtttcattgtag

SEQ ID NO: 68945 - DNA, 6573 bp, Oryza sativa
tacagctgaacttggagtgtcaatggagagatgtatccagcaaaaggttgaggttatcaaagacaaaagtgattcaccattgagaacttctataagcaaagttatgttggagaaatcggatcaaatgaagtctactgaaagtgatagtgttaaaatgaaggacatggcgattgaggtgaaagtcacagttgagaacttcagtgaagcaggtaaaccagcttcagcgcttgtcatgtcaaatgacattaatggtgaagttatggctaagcctaatctaacttgtggggatgatcaacttcatggaggggatgggacatacaaaaatagcatggaagatgacctagcttccagagaacctgttaatgcatgactttgcatttcctgctacaaaatgtttaaggtatcccatatcctagaatttgagctcatcgtttgataatcatattattcacatactaaattattccctgccctttttttgctgttctctctctcccccccccccacccctcccctccaaatggtaatgattttcttgacaataacctacttcaagctacaggcatgatagttttaagaatgctccaaatcattcaaaattagctgtagaacttgtaatataacatcaaagaattgatccatgatcatttgcaatgcttatgttccatgcgaatttactatcatttattctgatatattgatagatttctttagtggcctaataattcctaggagaaaaggactaaaaagaaatcctgctagaaaaccccatatctagttttagtttccttaacatggacaataacaaaaacttgaacataggaaatccattggtaatttctaattccatggcagttctctctttttttagttatattccccacttgttccattatcaaaaggaactttattgaatttgttttgaatccgtaatttctggactaagaactttgtcttacctttttatgcttacagtgagcagagcaatgggagggacgatctagttttctgcaagtagctgcctcagctcgttctccatggctacaacgaagtgtttagagttgcattttgcagcaatgaaatgctgatgtttcagaattttggtagtctgtcgatcatgggggctttttgttggtttagtaggcataagtagttcacaccgtaggacctcttatacaaaccccaaaaagtgggccaaatttttggtgtaaatacatgtgggaaattgctgttggcattttggtgcacctgaaatgttgtctgaagattgtcgatgaaaacagacttgcaggtagtgcctgtacagatataaaaatccatcctcatctgtttgactgttactctgaattttcattcggtttagaattctgaattctggatgggatttcagcatccagattgttcaccagctatggtcaaatttgctgtttacccataatgtgtcagtggcttgagtattcgttatccttcgtaaattctgctgtcttctactcatttctatcacctctgttcataaaagaatgaagcatatatttgaagaaactgaagggaaaaccagcaaacctccctcgttcagaaatactcgtcagtgttggtcgagcgatgaatcaaggaagaaaattctatgcggcggtgccgcaccggacagcccgtgcaacaccgtgtaccctagtgacgcgtgtccaatccctgttgcaacccgagccgatcattgcagccgagccgatgtccaatctcccagagctctacagtatcgagtcatatctaccggctgcatgtaaaatctaattcatttttttaacagtgctctatttgatgcgagatacataatgccgttacttttagacacatatttaactactcgttttatttaactttttttcatgattattatttattttgttgtgagatgttgtaatcactaaaaatattttatgcatgatttatatcttatgtatgtccacaaaatttttaaataaaataaatgatcagacgtgttttcaaaagttaatgagatcattattaaaaaacggagggagtaatatacaggggatttttctagggtaatatacattttactaaactttatcaatatgcctcaactggtcagaaattattttttcatttgaatagggttgggaaattccattttgatgacgtagaaatcacggtttgaaaagggctttgagattacatttttgttgacatataaatcacggaaagtttataaggctgcgttcgatcaactccaaaagagagaatttttagcgcacgcaaaacgagaaagcgtattagctcattattaactataaatttaaaaaatgaatttatttgaattttttaaataacttttatatagaaattattttaaaaagacgtattatttaacaatttaaaaaacgtaaactaccaagatgaagtttggagtagaagaaaataactaggcctaagtaataatcttgcttcgataatcatgttctggtaattgtttattggcacgagactgtgtaactgagggagacgtgggtgtagaagatcggcttggctccaaagaggcaaagatggtctcgggctgcaataatacatcggacacgcgtcaatagtctgcgtggtgttgcacagttgatcttgtgcggcactaccgcagagaatattcttccatgaatcatcaatttatttgatcgtacaactacatataataaatataaaaaagaagcatgcgtttaagcatgtttttttggggcgttgctaacttgcgcgcgctgcctcccccggctccagaagcccatcgggctttttttctttcttttattcgcgatttttttcctttttttcgattttttcttttagttttttctatttttctgattactttttttaaaaatctttagcacacgtagtttttttaaaaatattttgagttgaaagtttttaaatcttaacttgaaaattttcaaatctgatttgaaagttttccaatctcgagttgaaagttttcgaatctcgagttgaaaatttttaaatctgagttgaaagttttcaaatcgaaggaaagttttgaagtcagagttgaaagttttcaaaatttttctttcaaattgaaatttcgaattgaaattttcaaattcggagttgagagttgtcaaaatttaaatcgtaagtcaaaaaataaaaaatctttctttaattactctcattatccttaactatttgaattagttacgttaaccctaagtcccgcgcgccgctggcgcatacgcgccagctagtcttctcgtgttttttgtcctaaaaccgcatcattttcagtccttgaagttgataaaaggaaaaagtccactttgactcccttaaatatacgtcgaatctaattcgtatccctaaaccgtaaaaccggataagacgactccccgaaatattgaaactagtgcaatttgactccctcagcggttttggagggcggttttgctgacgtggcgctgatgtggcgatgttgacctagtcttcatcccacgtggcgcttatgtggcattgaattaaaaaaatatctgtgggacccatctgtgattcgcacattaaaaaattgtgggccccgctgacatgtggggcccacatgtcatcctctctatcttcttcttcttccttcctctctctcccttctccctttctctccccctttctcttcaccttctctcttggcgcaatcggcggcaggggcggcgattccggcggtagttggagcggacggccggtgctccacccgagcgccttgtccacacccagcgccctcgccaccacctcggcgtccgcgtcccgacgctgctcgtctcgccgtggatcgagacgatgctaacacgggcggcgccgagggaggactgcctcgccatgctgctgaacccgccgcggctgcgggacatagaagcgggttggacacgccaccgccgccgccacccacctggccacctcctcgccggcgtggtggggagctcgacggtggggaaaaaaggaggaggaggccgacggtgggaggctatgggggaagatgctgcatgggaagttggtcgccgcaggactgcggggaggctggtggaggcgctcgtccggtggcggggtaggcgagcatggcgacggtctcgtctgggatggggaggcagcggagctccgatggcctcctaaagccagcgagggcggcagctcttcggggtagcagagacggtggggagcccgaagggtggcacgctcgtcaaggggaaagaggcgactggcggtagtggggggagagtggcacaatgagccaatgaggaattgctccgggtggcgttttgcttgatgatgccgatagctttgagtataagtaaaggagagaagctcagagccgactccagtggtggcgcgacggcgtggacgtggttcacgcgtgcgacggcttcttcgaccacatctccgtcccggtcaccggcgccccttcctcagatgacatcgtcagagctgcccttgtgtatttcgccttgcaccgcctcggagtcggagtcccgactgtacgagaaagcagtatagacatgttgcagcccacctcctacggtcgctcgtcgttccccacttcagccgttgtcgactaccgctgtcccctcagcggctgctggccaaggtgaagagagagaccgggggagagagatatataagggggagagagagggagggaggaggaataagggaaggagagggtggttgacatgtggggcccacatgtcggtgggtcccacctttttgtttgaatgacatgttggtcttacaaatctttggatttggttattattgtaatgccacgtaagcgacatgtgggacgaagaccgggtaaacaccgccacgtaggcgccacgtcagcgccacgtcagccaaaaccgttttcaaaaccgttgagggagtcaaattgcactggttttaataattggaggagtcgtcctatccggttttgcggtttagggatacgaattagattcagccgacaatgaagggagtcaaagtggactttttccttgataaaacgcctaggaaacctgtagttgcgtaagctgctgcgttgggccacagtccattaacccaacaacaacatattaacaagcccaagtaaaagcccattcaatctacaccctagatctcaatccccatcactcacagccgtccgatccactccacccgcaactatataacagctccgcctcctccgcgaaccggaaaaccctaaccctcgcagccgcatcgcgccaccgcctcctcctccccctccccctccggcgagagagcccgcgccgttgccgccgccgccgccgccgccatggtaagctccgttcctctcccgcatctcccctttgcagtggtctctttgcgcaggtgctaaggggaggaatcgcgtgtgtgtttgatttttgcagtcgctgatcgcgggggaggatttccagcacatcctgcgtctgctgaacacgaacgtggatgggaagcagaagatcatgttcgcgctcacctccatcaagggtgtcggccgccgcttctccaacatcgcctgcaagaaggccgacatcgacatgaacaagcggtgagcaaaaccttctcgcctcacgcccccccttccctgatctgggtgctagtttgtgctgttgatgatgtgctggaatggtgcgtggcgttggatcgtttggtgtgtgtaggtataacgaatggttattagtgttatcgggctaatttctagataatttgagcatctttgggtttgtagctttgtaactgtgcattttgaatccgaagttttgtggtttcgttggttctactgtgatgttaggtggatggatcatgcactagagttattttgttcgatagtgactgggattcagagtagggtttactggctggtgctttaatttctttgtcgtggattgtgtgatctgttacatactcttacatggcaatttttttgtgcataaggctgccgcaaagctgattattaactgtctgccaactaagttagattgcttggaacttttagaatttattttaacagcacaaccgttgtaattgtaagttatggatttattttttgctaacttgacaggggattcaaatgcctgctaattttgatgtgtttatatatcaattggcgatgatgttgattgcatggctgatcttttggctccagttaattgcctaatactgtgtttattctgacgtgatgtcacaaggtgtcagtttgttgcaactagtttcagttaagttgaatttgtgttctatttggcttaataggtcaggagttgtctgttactacttagcagttcacaattatgttgaatggtagggcatttgattagtttatattttctgggacgtcattaattttgggctactaagatgattagtctatttttatgctcgtttggaacctgagggtttaattagataaaaacgtgttatagttatcacatctatattttatttggtattagttgtttcatgctgcttggttaatctgacatgccatactgtactttgcttatgctaagttaatctgatatgactttgtaa

SEQ ID NO: 68946 - DNA, 2845 bp, Oryza sativa
gaccatcattgctgatgagagttacttttctgttggcacagtctatcacacctttatgtttggctaaccagtccatccctagaatgacgtcaaggtctttagattctaacaagataagattggctagaaatggtaccccttgaatttctattctgacagaggggctacgttgcagagagagtgcttgattacttggggtactaaccatcaaaggacgtctaagatcttctacttccatcccatgatttcccgcaaaactcatagataagaatgaatgtgtagcactagaatcgaaaagcacagttgcaggaactgagttaacagggaacgtacccaaaatcacatctggagcatcttgagcttctgcagcagcaacatgattgacacgggcctttgatgctggtacagcagagttattctgggcagggacaaccttcacgcgtcggggcttcggacacttgtcagcataatgtcctgggtctccatagttgaaacacaccacgggcttgctgccttgcttcctcttggcaggttgttgctgtgtcgaggcagcaacaggacgtgggacttgattacggatgttgttgccagcattgttgttgaagaactgacgctgcggacgaacaatggacgaagaacctccctgtggcacagactggggtcctaaagtaagacgcggcttctgattactcccctgttgtgccttgaagtgagcaatccggcgtttcttctgctccatgcgattgtacttgtcctcctgacgtatagccttatccactaatttctggaaatcaggataatctccaaccatgagtgggtaagaaagctcatcattaagtcctcccaaaaacttctcctggcgctcttcatcattgcgcagatcttccggagcataacgagcaagacgattgaactcgtgcagatactccgtaacagagcgagatccctgggtgagcgacctgaactccttcttcttgagagacaccactcccgatggtatatgcgtcttccggaaagcagcggtgaattcaagccaagtaataggttcagcagtaatcctattcaggcggaagtgatcccaccattcagaggcagggccaagcaactgatgtgatgcaaatgagaccttctcctgatcagtgcactgaagcaaatccatcttcttctctatggcatgcaaccaatcaccagcttcaacaggattagtggtactagagaaaataggcggcctcacacgaagaaattctgctaacttgttctggggaggtgcatggttatttccttggttttgctgattctgaagttgctgcatcatcatgttcattaactgagtctgttgagcaagaacttgagcaagtgttgggttctctccattgttgttgttattgttgctgttggggccattcccgttgctgcgagtgagcaccatctggcagggcacaagaagagaaaccgggggaaactacttaggatagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagacacacacaagcaaacttaaagcaagcaaactaacacaacgatctaagacaacgacttaacaagtcactctagttcttccgagcatcggaggtcgattgtaggctcgttcggctcgtcttcatcatcttgagttgctacccactcaatcttggaatgggtgcgcttggattcttcttcttcatcatcacttatgatgatgaccggaggatctgctggggcaacttctttctccaccacacgaacttttggcgccaattgatagcgagggacaaatagagctctcttccttgcggtaagacgaatcctggccttctgcggtggtgcttctcccttcaacgcggctagttccttctccaaacgatccaccttgtcttctaacttgcaaatcttaccacgattccaatcttcacgatcttgagccgctaacacagtctctgcacggctttcatccatagcccacagcatctcaactaaatgccttgtggtagcatcattctcaattccttcagtctcaaggtagctgccacggtcacttccctgtggttgacgaggatggtagcgatactcagtgtcagccaaccgatcactgtagcgatcacggagctctcctatggcgatccttgccacttcctgacatgcatggatgtagtttcttcctccagcttcgaacatcactgaggggacatcttcactattactattcaaggtgactttgactcggcacttctcttcatgacgatcatgaggaatctgagcataaaaaggggcagtcccaaatcctatgacaaaggacatcgtacgcaactcctggacaaaaccctcaacaccaaacaggtactcaggcttgtagcgcggcatctaaagacaagtgaaaggagggagttaagacatctatccaattaacagcacaagtttttggattaatttgaataaagtttagaaaaatcagagtaaaaaggtaagtaaataaagtaaaccaaacttgcaagataagttaaaacagttggaaacaaggtcacaaattttgtacttttgaataacaggtttcaaaagaaataaaagaaagttataaaatcaacatgctaactttattttattgcagcaagattaaataaaacaatattgtaaaacttttgctgataaataagccattagtacagtaatagatgtacggtactaataacactggaataaattttgaatgagaaccattaaaaggg

SEQ ID NO: 68947 - DNA, 28452 bp, Oryza sativa
  unsure (1)..(28452): unsure at all n locations
ttaaatgaagaaaatcgcaaatattcatttaaagagcatagaaacttcaaatggccataacttgaccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcgaaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctaattacctttgttatgaccttattattattgttattgttagtatttccttgttcaccctagatcaaacaaaaccccaactagtggacactctactcatggtaccactagcatgattttaggtagatgcttcgctgtttaattaggtaacattaggtggttttacaactctagactttgggaatattcatatcacctggacactttggaactattggattatcgtggaattggcttcacacctccccctctattcaaaatccccaaaatggttttaggctgggctcggggtgcatggttttgatagtagcacctcggccatataaggaccggtcttcgggcctctgttgcaaagcactacggtactttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgaccaatgtacccaagttagtgttttaattcttaaaacctgcttaacaactaaaatgtggaatggttggcctgggttggcttgggacgagctgggacccagggtcgggttgccagttcggtctgaaatcatcgtaggccttgggttaaggcaggttcgtgtgggttcacggccttgataaataatattgtatagtactagattcgtgtttgcaaaatagccctgagcaactaaatatctttaaatgctgtttactgcaaccctaacccctttatagtataactcctttgtactcccttgcatttattcagcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtgtgtctttgtgtgtgctgggccttcgctgcccatgtaataaattatctatttacgcttccgcttgttaaactctgaattgtatcaacttttggtgtaccttgcctcctgggacaaggattaatgcacgcacacaaggaacgcccgttgggtcagttccggtcgtgacataatgtttctaagcaggctaagcaattatatctaatatctagttgaaccaatataaataaagctcaactagtcaaattgtaataacccaaggtatgaaggaatgaagtaatcaagtacaaaagggccataacaaagaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagaacaaaatcaccaaaacagcacataaaaaagcatgaacagtacatgtggatatttttaatgtgtagatctcaattttagaaaaatttagagacttgaaccaactaaatcggagctaagatgaattagttatgaatttttaaagattaaatcggattaaaacacttatatcggcttaaattgaattatgacgcaataatgaattatttttgaaaaggaaaagaaggtttattgcgtcagcgggctagggtttcggtggaccgggcgcacgggcggcggttcacacgaacggacggccgagatcaacttgatccaaaacggacggccgagatcgatcgggtccacggcggctcacggcggacgaccccgatgacgtcagcggtgacatcaccgacagcggcggcggctcggcggaggagacggctcgaacggcgcacgctcgtcggcgaacggcgatgctaggacgcaaacagagggcaccaagacggagaggacaacgcggcgaactcaccggtgacctaaacggcggcggaagaccaacggacggtgacggcgacgaggaggaagcggcgggaaccttcgggtcgacgacggcgatgctgctccggtgatctccggcgacagcgaagaggcggacgaggacggcgacgacttggcgagcacgacggtggtcttcccgagcgacggcgacggctgaaacgacggcggcgcacggctggagcggcgacggcgacggcaaagctagggcacacggcgctagagcgattccgacgacgtgaggcgaaggcgagggtggcgacgggtagaggagacaccgggggtccttttaaaggggctcggaggtgacggcaaaggcccacggcggccggcggcgaggaaggaaagatcgggaagaatgaatccgagacaaactcgaatccaacgctttccaaaacgatttagccaaagattccaaaggagaaaaggtagaggagatcccggagatcatttcccctctatcaattcggccggagaaggaaagggacggccggattggaaagcggcggcggcggcgcgaaactagggtttcggcccgaggaagacgacgggcctgacaggtgggacccacctgtcagcgacagcgagggcgcgcgcgcgcggcggctgcggactgggccggactgggccgaggagagagagagcggttttgggccgactttcggcccaaagccaaaagagactttttaaaacctttttcaatttaaattatttcttaaatgcaattccatttattaaaaatacttccttagctcaaataaatcccagaaaaaatctaggaattatagaattaagcaaagtatttaatgaaattttatctggccccattttatattggaatttattaattaaaattagatcttttcttcaagacttttaaaattatttctaaaaattccaattaaacaacaatttataaattttgaattttcagggtgtgacattaagaccataaacaaagcactgccgggagatacccggattatctttgtaagttttctttccaataaaagcaagaaactgtgtttaagatagtgtacacattcgggtattcttggtcgctaaccatttcacgttgagattaagagcgagggtcatacgatgcctaagaacacgggagccacatcaaccgtacaccatggtgatccttggtaatgcgatacgctttataagaggccccagtatcacatacttggtttttgacgtctcatgacacaaaagaccaagtgtgggggagggaggtctacgagcttgcatgaagaattccatcaaccaagaccatcttggtttacagttggtgttagtcttaccttgctgaaaaaaggaaaaaaaagagaaaaaaaaaggagagacaacaaaaaaatgaaaaaaaaagatgggagaagaggaagagagcaagagagctgacgggctacatttagatcaaagaatgcattatgtgtgagtctttaaaaaatggctatacaccttgctggtagcgatcatgatgcctggctacacccagcctctctcttgagctcatgtgttgccttggcttagccttcatccactcctagctgtgcacaactcctcactcttgcatcacctactcgcacacaagcaagaggagatgcactcttcttttctaggtgttttctgctccactccagttggtacttgcatatttgctcaaaaagagatgcatcctacgtctctacaacattgtaccaacggagagaatttaacttccaatctcttcacccagcgaaataaataaaataagatgtgtgggcgtgccagtgtactaagtacacaaaataaaatagaagaaggaaaatgcattttattataattcttgaagaattacaaaaatacaaaaatccttggtcaaatgcgctccacagctcattgacgaggtggatctgacttggcgactgtgttctcatggttcccggggtctcggaaaacacccggttaattactctcgcgggttagaccgcgagacacctcaaattaagctacgctggtcgtcgtcgtcggtcttcgcttcacattctcccatgcatgattgtgatggtggtgatggtgtcgatgtgtgtgggcgctagtagcggttcacggcctcgtcggtccgtgcgccggtgtaggtgacatcgacttcatatagactccacttgtccgtgccatttagcctcatcagtcttaaaaagcgtatgtagttggcataggttttttggttgtaagcactaggaggctggtacaactcttcttgaccgtcttggtgccatgtcaatagtgggagaataattgggagagaacattgaccaatcgttttgctcgattatcgtcgcggtaggtctctggctcggtgtagaggtacatgttggtatggccttcagtcgaccaatcaccgtgacactcgggatagcgctgcttttctggtttctagcacaatggctgaagatcattgtggtacaggagtatgccttccgatcattgcactgcacactcaagattaagtgattttaggggatgttaggggcgtagcctagcccgggaacgatgagatacgttctaggaactgggtggccctcttgtatatgtgcctgacaatcggagccgaacccaaattttgttgggtcgcctccgatcgtagtggcttaactcgggagtgcaccgacgacggccacgacgaaatcatacgtcatgtgtatgggcgttgtggagtgagagacatcggtggggatgccgaactcgtgatcactagatggtgaggtgaggattcatgtgaggatgacgccagtggcagcgacaagttgaagaacttcgccggcagcagtcgagcagcagacggtggtgcatatgcatagatatatgtatatatatccaagaatttcgtcattggacagccggggtcgtcgagcgtgacgacagcgtgagacggacgcgaggtcattaccagcccgcggtgatgccaagaatgttcgtgaaaacagctagtggctccaaacttgcacgttggcgacgaatgcacgattggtaccggcaacgacgacaagaacgggcttgtcattggcggagaaacaatcagtgcgggcgatgatgaccagaaacaggttcgccatcggtgatagccgcaaggataaatgtatgccaatgatcgttgaagatgacgaggatacgtcctgtttgtggacgagatcgcatcaccggcatcgatgacaatcatgaagacgcctcggcggtgcgggtctgagagtatgatcggcgacggcaacgattcggcaatcatcgtcgatggcggtgtacatataaagattttgtcatcgagcggtcaagaccggcgagcatgacaccgtatttgtgggtatgaggatgatcccgacgtgccgaagcgaaagcgtcgtggaaggatggcacgacgacctcagccagctaaagcgaagggatcatggctggacttggcgacgatcgtgcaagcaccaagcaatggcgctccggcattcttctcaggtggctcgacaattataacatgaggaagatcatagcattggcgaggatgatttagtagacatcggcggcaacccgcagaggctacgatgagcgtgggggacagagggcgtcaccgattagtagtctttgtggggcatctctgcccagcaaggctgcatcatgacaggtgccggcacatatagtctgacaataccatcgcggcttgtggatgatatgttaacgacctccgggtatcggcaaccaaccccttggcaacctgagaatggccttctccggtgggcatcggatggtgatggggacaagcgttagttggcaacgcctcatcgtctatggatttgggcggcttagcggcgtccacgggacaacggcaactccaacgagatggctcaagacgcaaccagagctaatgacgcctttgtcagaaaaaaactcacgcgaactggctctcagtctctctaaaacacacactctgacgcttgtaggtgcagctacagctaactgaagaagttccgaaaatacagagtcgtacagaacaactgacgaacagagttggcgctgcgtaatacagtgcagctttttcggttttctcttctatttattcatctccacacagattttgttacatgtataatagaatcaaatcatgacaatctcggatcaactactgaccgcgccatcccacgatccgagccgagtcattgcagctaaagaaggaagcaaatatgctaaaacagaaaaatgctattctactggctagaattcagactccaacagaactctacatgcaacgaaacaaaagagaatataaatgctcaagattacaatccaacaattcaccccctaatcttgaagcatcagactggaactaatcccagcttgcctctcaactccaaaaatcgaatcttaccaagaggctttgttaaaatatctgcatgttgctcctctaaccttatgtattccacctccacccgtttctgatcaacacaatcccagatgaaataaaactttgtatcaatatgtttactgcgatcatgaagcacaggattcttcaagagacttatagcagacttgttatcaaccttgatcagtgcacaaccaggttcttggccttccaactcacctattggtcgagccagccacactccttgtacagcagcagttgcagcagctatatattcagcctcacacgaagatattgctaccaccttttgtttttgtgactgccaactgatcaaactgtctcccaatttaaatagaactccggttgtactctttctatcatcaatatccccagccatatcactgtcactatagccattcagctgaggaacctgttgttgcttctttctgaattccaccccgagattcagagtacctgccacatacctcaaaactacctgggtggcctgcgcaattgcgcggctagcacccaaacaaaatcatatattttttagtattattctacttaaaatttattaaatagctatctcattgtcttaagactttgaaagaccaaaccttatcatcctcgtgtttctaattatatagtttttaaaagttacaccagtatcatcctcgtgtttctaattatatagtttttaaaagtcacaccagttgctacctcctatgtcatctctttctttatttgcttactcgatctatcactatttctattcattctttctggaacctttaaaatttggattttatagttttagagtttattgtcatatagggtttcgtttttataatttccagatgtcccgtcaaacgttgcgattatactcctctacgacccgtccactgtctcttctctttattgtcattgagatttgtcacgtcccaaaacgaccctaaaatatatcctttaaattatgcctagaataattaaaatccgtgtgaaagcctccaaaaattaaaatgtgcaaagtaaaagtcaaacaaggcttagaggatttttgtatatttcctaaaagcctgaaatgtgtaaataaattttagtggaattttcggagcacaaaaaaataattaagaaataaataaagttaaaaaggttttataaaaaaagaaaaaccctaaaagtcccccttccctcctttgggccggctcggcccatctccctctcccccctctctctctctctcctctcccccgcagcccattcggcctccctccccgcgcgcgcaccgctgacaggcgggcccgcccgccaccctcactgacgggtggggcccacccatcatccccgtcctcccgccgctcctgccgccccgcccgcgccaagcgccaccgccgccgccaaatccgccacataccgtcgtccccgcgtgcaataaagtggggggaaatactccccatgattccctctccctttccccccatttttccctctctcgcgttcaaacgggcggatttgcccccgcaaatctcgccgccgccattgatggcggccgaacctcccgcgccggtttccttcctccccagccgctctctccccttccaaccctatttaaacccttcccgcacctcctccgttcgtttccgcctctcgccgcccttcctcctcgccggattcgagctcgcgacgtcgctctctctctccgccatcgccgccgagctccggtccgccgccgtcgtcgccccggaccgcctcccacctcggcgccgcctccttcggcttcgccgcatccttgccgacctcgtccacctctccgtttcggtcgccgaccgccggagcgctgccgtccccgtcgacccgagccttgccaccgcctccctccgctctggccgcctcctccgtcgccgccgtcgcctcggggtgagttgtggaccgtcgcctcctttcccccttccctcccctctctcggccgccgctccgccgagctgatggtctccgggcgagggaagccgcctcccgtcgaccgcgccggcatggccgccctcgggcgcgccgagtggctgccgcgtggggcccggctgtcagccgcccgcgcgctcgggtgcggctgacgtgtggggcccacggcgccggccggcgtgagccagggtgcacccggtccaccgtggaccgtgaggctgccgcgtgggccccactcccatggacccggtccgcgcaccccctccccctcggctgacgcaataaaccctttttaaattaaaatttaaataaagaaattcgcaaatattcatttaaatagcatataaacttcaaatggccataacttggccatttgaactcggaattggaccattcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaggttgaagccgacgtttgggaaagggagcaaggaaagtcacatcatccttgaacatattgaatcccaatttataaaattattttgatttaaattattgcattatcgctttatttaaattcccgcgttatcattgttttatttagccatgcctatttacctttgttatgaccttattattattgctattgttattattaccttgttcaccctagaataaaccaaaccccaactagtggacactctactcatggtaccactagtatgaatttaggtagatgcttcgccgcttaattaggcaacattaggtggttttacaactctagactttgggaatattcatatcacctggacattatggaatggttcaattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtttgattataaacaaaagtacccggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtagggttgggtcggtactcttgtctatggctaggatgggttggaaactatgtcatgtcttccgtctgtataccatggtggtatgtggcacgtggttacatgtgaggaagatgtgtcttgtgggtaaagatctacacctctgatcagagtataacctattcgaatagccgcgccctcggttatgggcaagccgagcaatgtaccaaagttagtgttttaattcttaaaaccttcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctagggacatatttacaaaatagctttgagcaactaagtgtcttttaatgctgtttactgcaaaccctaacccctatattatggctcccttgtactcccttccatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtctttcgctgttttttgtttgtcttcttgtgtgctgggccttcgctgcccatgtaataaattaactatttacgcttccgcttgataaactctgaaatgtatcaacttttggtgtaccttgcctcctcggacaaggaataatacacgcacgtaaggaacgcccgttgggttatttccggtcgtgacaagattttaaaaatcaaacataattatcgtttgggttcatttttactttaagtcccgtcaaaccgtcagcggctttgctattgtactcttctacggctcgcccgctgcctcctttctttattgtcgttgagattttaaaatcgaacatgattatcattaggtttttttactttttggaagttccgatcctttaaaatttgaacgatgccactatgcccctctacagcccgtctgtcgcctactctttattgtcattgtgattctaaagatcgaacataactattgttgaaattcattttttattttctataactcttatacgcccgcccgctgcttctccttttatgtcattgaaattttaaaaatcgaatatgattatcaatggggtttatttttttactttctagaagtcccggcaaccgccttacttgtttgcttcacagcctgcctgacgtccctccttttaatcgtcattaggattctatttgttgttttattaacatttctaatttcagaacttatttttttaaaaaaattagttaataccgtattgtgttctttaaatgtttttattttttttatttttaatttcagttgtttcaaaattgtattcctacttaaactctcttttagtttttcaaattttagatattattttattttttatttgaaattttaattaatctcgtattgggttcttatacggattcttctttcaacattgcttatttttaattccgaatttcagctaattttaaattgaatttctacttgaactcttcttttattttcttttgctaattttgaatttatttttatttttattctgaattttaattaatctcgtattgggttcttatatggactcttcttttaatattccttatttttaattccgaatttcagctatttttaaattgtattccaacttgaactcttctttccttttctaattttggattttattttaattttatttcgaattttggttaatctcggattgggttcttatatggacacttcttttaatattgcttagttttaattccgaatttcagctatttttaaattgtatttctacttgggctctcctttccatttctaatttcggattttttttatttttattccgaattttaattaatctcgtattgggttcttatatggactcttcttttaatatttcttatttttaatttcgaatttcagctatttttaaattggacttctacttggactctcctttccttttctaattttagattttattttttttattttaaattttggttaatctcatattgggttcttatatggaaacttctttcaatatttcttatttttaattccgaatttcaggtatttttaaattagacttctacttggactctcctttttctttttttctttttcttcgattaatgtgggaatttctagcccccacagcgaacgtggtgcctcctttcaaggctgttttaataatataatagatagatatgtttcatggcagcccaatgttcagaggtcggtttctccataaacctgctaacataaccaaccgaataacttagatgaggtcttgtgttcaccaagtacctcaagctcccaattatgcttctgaattgagtttcctccatacattctcctccctcctttctcaacttcaaccgagcatccatgggagtctgacatggattacaatccctcatcccagctttgtcaagtatctttgctgcatatgcaccttgagacactgtgatcccttcctttgcatgtttcacctccatcccgagataataagagagcagaccgagatcactcattttaaaaagagcctgcatctgctccttaaacttgtttatttccatcagacttgctcctgtagtaatgagatcatccacatatacaccaaccacaagtcatgagttcttctctcctcgagtatacacagcacttttgacaccactcttgacaaaattcaggctcacaagactagaatccaacttcgcataacatgcacgtggtgcttgtttcagtccatatagggccttcttcaatttcaacaccttgtcttcttttccatcaacaacaaaaccaggtggttgaaccacctaagcatcttcttccaattccctattcaagaaagctaatttcacatccatctgatgaacttcccatccctgatgagcagccgttgcaatcagcaatcgcacagtctccatcctcgtcactggggcaaatacttcatcaaaatcaactccttgttgatggacatatccctttgccaccaatcgagctttgtacttcacaatgacatctttggcatcacgtttgattttgtaaacccatttcagtcctgttgctctgtggctagagggcaaatcatagagagtccaggtgttgttaccttcaattgattccatctcttcaagcatggccttcctccagcagctctcctgctcagcctccaagaaacttgctggttcctctgctgccataaggcattgatcactgtaattaaaatctaggattggggtcaaggtggcaagcgtgttcaccactgttctgtagctcctgggcccttcatcagtcccttcactagcatcagttggaggggaacagaattcaacaccagatggcagagttgttgcagttccggtgcttgatgttggtgatgttgctagcatggttggagtggctgctgcatcctgggcatgtgtctcactcccttggactgggattgtgaaattctccaccgtaaactccacatacgcgtcctgatctccttcttcatcagtgttgctgccccagtcccagaacgtcgtctcataaaaaaacgacgtcgcgtgacacacacacgcgtcgcaccacaaaatcatacatcttgtaggcttttgatccttgctcgtagccgatgaagaccatcctcgtgctacgatcatcaagctttctcaagtttggcttggctgtcttaacatagcccacacactcaaacacacgcaggtgttcgacagtgggtcggcgaccataccacgcttcatacggcgtcaccccatcaagactcttcattggtgatttgctcaagacatagacggctgcaaccaccgcctctccccagaaatatgccagcatgtttgccgccttcagcatggacctagctgctgccaccacagtctgattgcgccgctccacgacactgttctgctgccgtgagtagggtgcagtgatttaacgtttcacccctgtgtccgcgtagtactccatgaactctatagaggtgaattcacccccgcgatcagtgcgcagcgccatgagcttccgattgctatccttctccacgccggcttaatcgctgccgatgcttcgtgtttggcagagaggagtcgtatccacatgtgatgactcatgtcatcgactaggagcaagaaatacttcttgccccctgtcgtcgccggcgtgattggtccgcagaggtcaccgtgcaccagctcgagcgccgtctgcgccctgtactgcgcctcctctgggaacggtgtgcgatgttgtttgcccgcgaggtacccgtcacacaactgatcaatgtgatcaatttgcgggatcctgcggaccacgcctccttttgccaacctccgaagtgccaggaaattcagatggccaaatcgtgcatgccatcgccatgctagctcggagccgctcgctgccatacagattagtgtcgcaaggttcaacttgagaacatacaggtaacttgaatcacgatttaccttagctagctgcatcccttccgggtcacgcaacgtgaaaacaccatgccaaatgtgtgcgtcgtagccgcgcgcatcgaggcgaccaacactaacaatgttttttctcagcttggggatgtagtacactgcctctagtgagcggtgatcaccattcttgctctgaaacaccacagttccgcgcccctagatgtcaaccactgagccatcgctgaatttaaccgtgcccacaacaccagtgtcaagctccgcgaacgctgagcgtgcgcccgtcaagtgattcgtggccccggtgtccaggaaccactctccagtcttctcctccttacgcccatcctcatggtccagcacaaccttcttctctgtgagatgcacttcctgcacacaaggtgttcgaccaacggccgcttcgccggcgagcgacacccccatcacgtgtgccatgagcagagtcggctcttcctcagcctggaccagatttgcatttgcctctccccgacattggcgacgcggcatacggcactgcttcgagtaatgaccgtattcatcacaattgaaacacttcaccttagagatgtcacgacagccatggccgctggtggccatctcctttcccttcggtgaatcgccggccttgcctcgacggttctggttgccagagcccgcccggcccttgttgctgctgccagatccctcctactcccgctgcttgacaccggcctgccactgctccttagtgaggtacaatttgccaccgtcacttgcctcctcatcatcactgtaggagtcgaccgtcgacagccactcgatgagctcctccagggccatggtcttcacgtcgaggagctgctcgagggaaattgccaccggcttgtacttcttggggacaacacgcagcagcttcttgttgatgtgttcgtcttccatgactccgcccatgttgcgcatgtccgcaacgatggcagtgagccgcatcgcaaattcctccggtgtctcaccgtccttgaagcgcatcgcctcgaactgacggcggaatccctgctccctcgcctcgctcacgcggtcgacaccgacccgcatggttttaatggcatcccacgccgccttcgccgtgtcgtgctttgccaagccgcgcaacatctcgcggggcacagcttggagaatcgccgagagcgctgcacgatcctcgcggtactccgcatagcagggatcgatggccgtccagagcccctgcgcctgcaggttgacgcgcatcaacagcgctcagtctatataatttgtcctcgacaggatcaagagacgggcagtgtgccctgcatcgactagcgggagtgatgccgcagccgttgtcgcttcccccgccgccaccgccaccacgacggccaggcggtgtgtatgacattaccggatcgtctcagcaaagctctgataccaaatgtcagaaaaaactcatgcgaactggctctcagtctctctgaaacacacactctgacgcttgtaggtgcagctacagctaactgaagaagttccgaaaaaacagagtcgaacagaacaactgacgaacagagttggcactgcgtaatacagtgcagctttttcggttttctcttctatttattcatctccagacggagtttgttacatgcataaaagaatcaaatcacgacaatctcggatcaactactgaccgcgccatcccacgatccgagccgagtcaacgcagctaaagaaggaagcaaatatgctaaaacagaaaaatgctattctaccggctagaattcagactccaaccgaactctacatgcaacgaaacaaaagagaatataaatgctctaagattacaatccaatagccttgcaggcaccaagtagtggtgctccggccggcgttctcttcaggcagcaaggcaatgaatgtgaagaagatagcagcgttgatgagggggagcggacgtcgacggcgttgcagagaagaggccgaccagcaaggtgacgacgtccgagcatctcggcgacatctcctcgccatatagaaacatcgtcttcaacatcgccgcgccatatagaaacatcgtcttcaccttgacggagacttgcagacgacgtcaactctggcgactctgacgatggcggtgcatccggcatcttctctgctgaggagcttcataccggcgtgcatgcgctgaaatggagcaaagggatgataagaaaataggctagttacccatggcagtgaactggagcggcatcgtctccctggtgatcgtctcctccttagcgcgcttcctcagcggctcagcgcacgcgcctccttgccggacgccgaggtacggcagccgatgtcgccggccgcagagcacgctcgttcccgcaggacgccgagatactccggccaagacgacgtgcgtgatggttgccgatgagcagcctgtgtccgctctccttgtccttgtgtttctgtgtttctctcctgtgtctctgtgtatgtctctctagggactactgccaaggctgggcatggcggcagcggcggcgtgaactgcaggccctcggctcgtgcctctgtactctctctgctgcctccccccgccgtgaaggaaatggcctgttttatagtggcgatccggccgtatcagagatccattgatgtgcgatcactttccaatcgactgtggcgcaaagagagcatttccttgtatttgtatgcacacgcgcgtcccagccgcgcggacatatatagcaaggatctttggccaaaacaatattatccaccgtatttattttaattccatgcaaatgcatattcgaaatctactgttgattccaaatgagttagagcccgataactatccaactaaagaggattttttttagataatggaatagatcatcccggcctttgctcaaaagagctacaaccaattattacaaactaacactctaaaacaagtaaagttcaaaaaaaaaaataggacaccaatttaagaagtaaaataaccaaaataggataaggagtacacatttattgaagcctatttgtgaatctccatccatagttggtaaaaagttgtataaccgtcgtctcaagtttacgacatgcaacctttagaagatctccgtcttcatcacacctttataattgtgcccaaaatcagagccaatatgttgctctgaaaattatctgcatatatgtaaaagatgatgatttgttaaaaaccatatcattcctgctcaaccacagcgcccaacatattgtagaagctccaaccaatagaagtttactctttttcttgtccacccctaagagccacccatcaaaaatatgagaaatgctagtaggaaggtataaaccaaaagagaattgaactgctctctatataaactttgcatgatgacaattcataaatagatgttaaatagactcatttttcatacagaaacagcatcttaaactgtcattccaattttgtttagtcaaattatctttagttagcactaccactttaagcaagtaccacataaagatcttgatcttaagcagcatcttaagctttcaaattatcttgtttctctcaatgttgccattattaatcaaggctagatgcatcgacctaaccgagaatcgtccactctgattaaatttccaaataaaacaatcaaaagattgattcaactgaacatgtacaatagaagcacacaaatcatgccaagatacaagattatgaccaaccaatgctctcctgaacgaaacattaagcggaacagagcccataacactagcaattgaagaatttttccttctgataatagcatataaggatggatgcttatcttgaaaagcaagttccctaaccatttatctggccaaaatcttacttgttccccattattcacattccaggaacccatattcaagaaagtactcttaactttcatgtggtctaaccaaaaatgagaatcaccttgtttcctatcaacttgggttatagactgattataaagatattttctcttcaataagtcctatcaaaccccttgctcatttattaacttaaacaaccattttctcaaaagacatttattttgtatttcccaattatgacccctcatgccgccctgatctttgggctggcatataatatcccatctagcaagcctttactttttcttatgatcatccccttgccaaaagaagcgtgatctataataatcatttttttaagaaccccttttggtatctcaaaaaaggatatcataaacatagctaaacttgaaagtacataattaatcaaaaccaatctacctccgacagacatatgtttacctttccaactactaagtttcttttcaattctttgtgcaataactttccaatccttgttactaagctttttaaaatgcattggaataccgagatatttgacagggaagttacctaacttacaaccgaagatattataatactgatcataataatcctttgcgtgaccaaaacaaaataattcacttttgtgaaaattaattttcaggctagatagctcaatttcagcttttcaaagaggatattgtgatggaatgcttccattccaaaattttctagcatggaatgggatcgtgtgtgtttccattctgctttatatacgcattgtattgcccagcagagagcatgcatagctgccgatcgattgtcccatatatattgccattcatcatcaggttgacctgtgaacccaggtgatcaagtatagatgcatatggcactgataaagatgtcagacaagcaacccctattactttctggtgcatttgtgcgtccttgtcagtaatcacttcagttaagactaattaccgtgtttaactaatcatggaatttacgcatatagtgaaaacttgtgggaaatgcacacagcttgtttgtttgttccttcgattggcacattcatgatttttagttttacttaaaaaaaatgcacaaaatctcgtccaacacaaggtaaagggttcttgcacctgagatgtgtgcataaccgaagcactcgcttgagttggcgtgatcaaagtgccttcctccaccacaacccgcatcaagacggaggagagatcgacaatcacatgtgatcatgctaccgctccagagatttcaacatatgcatcatgccggcggtaaggtatacaaaagacagcaaatgattcaccatttcttttacacatacttgtctttagatgagtttggcttgatcatacctggttatgcgtcctcagtccattttcgtatgctatggtttgggtggtcgtcgacattcataggctttttaaaattaagcatgatgcttaggataaatagccttctttaattaaagttgacgtggtgtcaagtttgcttaaatgaaccgtaggtccagtactttcatggacttcggatgtatatccttcgtgaactaacccctgcagggaatttttcaaattgacgagcgagtcctcaagcacgagtcacactggaggtaagacagagctaggagaaaaatcagttgctaacataaaaaggagaaacatatcacctatcaaggtgtacggtgcgcatatttctaattgctcctttagcatgttcatgcaaatttaccttagccctgtatgagttttgcttaaatgaaaatttggtgaacaataaaaaaaattgaaagaaagaaagagaaaaaaaagaaaattttgttttcaaagaataaaagaagcgtctctcgattaaaaaaatttgtctctggagtaaaaagaaaaaaagatgatgacaaaataaaattatggcaaatttgtgggatccatgcttattaagaatccaattccttgttagcatggatgtgaacaattaatcttcaggctatgataaaatcttttcaattttttgttgtccctcgggtatttgttatccactaaccttttgcaggaaataaaaaagacaatagaggagtagtgtaaaataactccaacattcataccacgctccttagtctatgagaagacagatgcttaggaaaccaagcagaacaaatgcaaagttgtgctgtattcttgcatccaaatcaaagcttggtaagacctatctggtaataattcgaaacacctcgtgcatcctcgcctcacatatgtccaccctgctaagttacccatcacctcaattgatgccataataaaaataaaaataaaactataaaaattataaaatgaaaataaaaataaaaacaaaataaaagtgaaataaaataaaagtaaatttaggcacttcatgcgcctagagttacttaaataaaatttggctcaccgatattttaccccggtagaagcctattttgctttccatcctttttgttgaataaagacaagccacaacacaagtgtgggggagtcttttcgaactctcgacgcgcaacagcatcgactcaacatgacactgtgatgaacaccagcctatggccgcgcacaaaattcagcagtcatatatgattctcattgcaaggcaatactcctcagcgactatattattaactaccaaggccatatatgattctcattgcaaaacattacatgtataggctgactgacattacattgagctttctcaaattattgtgacccatgtgagatgctttttgatactttcattatcaagatcacgtacactaaacttacaagcacgtaagctaaatttctacactggaagctagcatccattgtccatcatttattttatccattatccacaaaataaatactccatgtcatttatgcctcatcctccaaaattctttcaaaaaaaaaagagagagagaggcatggctacgcaaaataaagaaaaataaatttttgctcatagaaaaatggagcattgaaaagaaaaaaaagagagagaaaatcttgctcatataaagtatggggaatgaaaaaaaaaagaagaaaaaaacggatagccatgcactctctcaaattggacaatgagagaaaattggaggaggaggtatatcaaaggagttgttatcatttatttttcctttttccacccacaaaacaaccatacacatatcacacacatgcacattcttgatcagagagtatgacttgcgatctccttaggtctggtcttttggcttggtgaaatatgtgatgcaggtatgccccgattgatccctaccaagctccacatatacaaccttgtagaattgggacaattcagcaaaatatgccttggtgagaatccacaaatcaaaccacacgagagacttgagagaaagtcattcgaggagtatatctactttgaaaaaatatatgaaaacccaagagattgacaggaggaacaagaaggacttgagccacgacagttccattcatcaattacccaagatggatagttagacactggaaagttcacaagtacttgtatggcttagaataaattgtatacctgtattatatcttggaaagttttattccacattcatccttaaccattactcggaacgagtaaagagctaagtgtgggaggttttgttgatggctgttaaatacaaaatatatgccgtcaatacctgcataaaaccataaatgtaaaacatcaaccatagtggtagggtttatttctaatgatttccactagtgctagtgtatatttgtatgcaggtgacaaattaccagagttgagaaaaaataaacatgtaggcagggggattatacttcccgttggagtccatggagtgatgagcccacaaaccatattaaatcattatttattgggccaacgctggaagaataataaagagggacccaaatgtcaggagatagaagaaggccggaggcagttgggccagcccatggttcggctgaaccgccatgaagcccaattcatcccagccttccatgtgggcgtccaggattgctccctaatgatggttggatggtgtttgggacatttcccataatgtaactatcatatgaagcctataaatagagctcctctccctcattccaacacacaccaagacgtagagctgaattacaagaggctctaagtatactttaggttcattatatgttctatagtacacttagaatagggatagagtaaagtagaagaagtcggaggaatcccagagttgtcgataatcctctctttattcttgtactttgttaattactctggttcaatagaaatatcattctgagtaattaagatttgcttagcgagaattattcttcgttagttcctaattagcatatgggattattgttcactatagtccattaattatatagtgattgctttagtctttagctagcactagagtagttattaattgcgtagacacggtgtctggataattaatttccagtacttgctgcgtatcccacaatacgttagacgtgggtgtagaggtggtgatagccctcaagagcacttaagtcctccctgtgcgggtacatagtagagcgacatctaggaacagcgagttgctagtgcctgaagtatcgcgttaggattaaaattaagctttccttggacactttttctcactaagaaatcctctctgccctgtgcccatatttatcttatgtccttgatgaaccggaggaagagataatcacacacgttcccttggattcgatacccttgaaatactccgtagggaaagtcctacatcggtatatccatgcgcttgcggattctatctgtgatcgtaagaaataccaacaactggcatcccgccatgcctcttgaacgatgctgacctcgatcttgtcggtgatcaggagatgcaagcctactacatgctaaaggatcagatatttgctcacacgcgggcatacgatccggagctactaaaaaagataggtatggatgttaattctcataccatttggaaagttgttggatggcagagatttgcggtggcagatgagcctggttctcgtttgcttactttacaatttcggtacactttgaaagaaatagaagatggaatttcctttcgctttttccgtaaagaatttacacttacatggaaatgattaagtacacttctttgttttcacgatgactataaaaccgttcttcggaatttctgggttcgagaaaaacagattttgggaaaatatttctggtggtccaatttgcaagaaacctagaacgaatgacatccataatcctacacttaggcttatgcacaaatggattgttatgactttgtttcctagaggtgatcttaggcctataagagaggataaattgattatcatgtttgtcacagttaggaagattaaagttgctcctgtgaaatgtgcaatggttagagagtataaagtttactgctcctgttgagtgcacttccctaattactagcatagcatacagacttggggttatttctaatgatcagattgcttatatttcaacccctcatccgtgtgttgacgagaattatttagtgcaaggtcatattcttaagcatggagtagatggatctttgatattctttttccccggttgtacaaaaaaaatcccattacctaactcgggatatcatttgtacaactgtcatgaactaaccattcccgtatagaccatagaagaatcttgtgcaggtggatcatatagggacacacgcaacatggcgagaaatgaacaagaaggttcaacatccgtgcaaatgtacgaagccggttaggaaccaactggggatgcacccggatggacccaagctctacaccatagcctcagaggctcggtctggaagagtgccagcgagagccgacagagagcatctcatgacatacactggggaacatgaacattcattccctcagatcaagcagtatgccttcatcccccaatgaatggtgaatggtgctcaagttcctctcgttaggacttgggagaaattacaaggaggatggataaaattgacatgcaaacgggagagatccaatacaacctcgatgtcgatttctaggatcggcaatatattttaagaggtgcgctagatcaaggagagatggtgacgcagggattatcctggttcaagccctctgagagaggaaataccgtacgtccagtgtgttctttcttgtgtatagtggaaaaatggtcggagaagctagacagaagagtcgtggagatgattcgacctcctctagggaccccttccccctcttatataggatgagggggagggttacaaggaaagtatctagttgattgcaactagatcaacctattctatctataaaagatatgcaggatcctcgggatttatatcttatcccgggaatctctctttctttatttacaagtatgacgcatggggcntaggacacttggcccaccccatgcagtgtggcccaagggttgtcattgggtacccgggtaccgtgtaccccccactcgatgaacacttaacacagacgcaagaatgacaaccgaatgttgatgctcagttcaccaacaccaacaacgcaacctgatgcagcaacagcatgacgaccttcaagcgtactttcgcttccaggggttcaatccttatcaaggaccctgagcgaaaggcaagcttggtgggagacgtctctccccccgctgaggtaacttgtatcacattgcatgtttccctttccaaatgcatgttttattttcattgcatcttataaactaaaaacaacataaaaattgcaaaatagaaaataccaaaaaaataggttagactttattatgctaggtaagacaactttttttttgactagaaatactgccaggactttgcccagcagtgtagttttatagaactcaaaaaatgttttcaaaattacagaggaaagaaaccacacaaagactataaagtttttaaccaatcagaaacaatttgttttaagggacatatgtagaagaatttctttcacaaaaagtgatctccaagcttggaaagatggctgaatattctgtaaagtaagacaacttagttctctttgttgaaatgatgaatagttgctctgttttatatctctcatatatggggtcatggttaaatactctctcaaaagtcgaataagagtagccaacaaatatccgggagcctaagggaagtgagctgcacttgctgatttgagtctaagttgttgtgagatatgagatagtaaataagagttgttatgaccctagtctgaatttgacttgaattccaaatgttttctttttctaaaataataaactcatgaagttcctcatttgatataaatttctaccaaagccaaaagtattcttattggataaaccatatacattttggttggctgtaattccattgaactttatcaaatttttgtgacttgtgtagatacttttcatgctctatgattaagatcatacacccacatatatgcacatgctaaacttctacactggaagctagcatccatccatttcatcttgatattccttcataccaccatccaaataaattctccatgcttaaatgtgctttcttctcctagaaagaaaatcctttcttaaaaaaaagaagagaaaataaggagggaaaggcatggctatgaaaataataaacttatgctctctcaaaatataaatcatgatgatgaaaaaaaagtagccatgccctctccatatttatgaaaggaggattttggagaagaaagtaagcacaaaggagaagcattttctttattttccacattccattttccaccatataacacacacactttgcacgatcttgatcttgagaatgtctagtcatctattttagtccaagtttttgacttagtgataaatgtgagtacaagtatgccaatgccatcgagatcatctacagtatcttcggtgtagaaatttgaaccctcaacgacgccctcaaaacaacaattagggctctccatctctaactggttgtatatcacaatcggacacttttagataatctccatcccaaacttttccagataagcaatcaactccatccatctcccaaatagtcaaatcggcattaccaacattaactgacttgtcggctggcacgatttctatctggtctcctttccattggatcaagctctggtgcatggtcgaaggaatacaacaatttgcatgaatccaatcccttcccaacaacatactgtaagaacctttcccatcaatgacaaaaaaggtagtagaaattgtcttgctgccaatagtcaactccactttcaaaattcctttggttctgaaggattccctccaaagtctttgagcaccatcttagtcttgatgagatcatctgaattcttccctaacttcctgaaggtagaataaggcatcaagttcacagcagccccaccatcaactaacatcttggagatcggcttgccattgacaaatcccttgacatataacggcttcaaatgccgatgccctgttccttctggcttctcaaagatagcttgcttaggtgacagacccaacttagccaaagattcttccatgatttctgcatcggctggtttagcacaatattttgctggcaatataaagaccatgtaaaccaatgaagaagcaacagccttccctttggctaaccatctcgccttgtcggcttcgacctcatcagctgagacaaccttgctcttaacacgccactcattccttgtcctctttagccgatgattgatctcttctttggcctcttgaatttgctccatgttcctcgtcctttgaattcttctcttctggttcttagtgaaaatgccagaaggacaccattggggtttcctagtttcatcttcatcttcagcatcctcctcctgaaacgaatcttgatgagttggacccaatctctggtgaacaggcaactttttctgcacttgccgatcctctctccttgcatgtgatcgacttgaactcccaacatatctccttctagagccaccacatcctgggcaatcttctattgacggcaatctcatcccctcattctagcagaacctgaaaaactcgcaactccaatgaggatcaaaattgcaatcatcttcataatatttttcttcttgcatctcatgcttcctctggtattttgtcgcgtcccaaatcgactctaaaatacatcctcgaaattgtgcatagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccttcctctcttgggccggctcggcccagctccctccctctctctcctctcccccgcagcccatcggccttcccccgcgcgcgcgtcgctgacgggcgggcccgcccgccaccctcgctgacgggtggggcccacccgtcatcccctacctcgcgccgcgccccgcagcctcgcccgtgccctagcgccaccgccgc

SEQ ID NO: 68948 - DNA, 20339 bp, Oryza sativa
agtggtgaagcaattttgggcttgtttttttgaaagaggaattttgggcttgttagctagctttttcctaggagtaagcttcttggattgctagcaaaaaggtcatttcaagtttccctgctgacatggcacactaattagggagaaaatctctctcttgtagtgtttgtgtaaaaaaaatctaagagtggcatatggatagtggcactccggaagagtggcaaatagttaaaacccccaaaacaaattatagattccgtctgtaaactgcgagatgaatttattaagcctaattaatccatcattagtaaatgtttactgtagcatcacattgtcaaatcatggcgtaattaggcaaaagattcgtcttgcgattttacatgcaaacggtgcaattggtttttttctgtccacatttaatgctccatacatgtgtccaaacatttgacgtgacggaaaagttggaagtttgaagaaaaaaattttgaatctaaacacagcctttagcttctaccaaaccgagctgaagtccaagcgtccaactttggtcactcgttcctcggtctaatccaggggcgagcggtgtgttgtggaggtcgtgacctcatttcatcgtcctaccgcgctcgccctcgccctcccgctcccgcgtgcatgagtgagtgagcacattgtcgtttttcctagcctccgtgtcatcgtcgagctcatcccatgggagagaggggagatccagcaagccgccactgccgcctgaggctggatccagcaagccccgccgtcaatccgcttggcgacacagtcgctgctttggccgcctctctgcccggtcgcgccgacgagacggacacgccaacattgctagatccgtctcgagctccttgccatccacgcacgcacgtggtgccgagctcgttgtcgcttcgatccgccattctgtcgctcaatttccgacggcgccccgacgaggaaggtggagggagagccacaccaacgggcaacggttggggggagggaaagtggtgaagggggagaggggtgccgatagtgggtggtaaggagagagggatgcggcagggtagccgaaggaggaggccgaagtagggaaaggataagggagaaaggagaggggggtattataatttttttctagattttagggtgttcggtgtaaattttggacctccacataaattgaaaaataaaatgagaactacaaaaataataggggataagctataaaattgaagccacttctaaagccactttgcagggaaagagcagtgttgctaccatctatgaggagactcacgaaaaagctatgtgccacataagctgaagaacgtataagaaactattcttacaatgcgagtggctttgactgggggctcgtctggcccattctcgcttgctttgcacgaggagcatacttggggcatgacagatacagacgtggaaaggatctcctagttggcatgttggggctgaatgccacctaggtgcattgtgaaagatatgaagaatcaagattttagatctgtaacctaaacctacgtggcactccgaagctcctcaaatgagtaggacacactatgaatgagctaatatggcactcagggtttaatactatgactggctttcctttacccaaaggcggtaatcatctctcacccactaatgcgtggggctatggtttagctaagacagtggggccaccgatccggtggttgatctcctcaatcgtgccatgaggtggggcgggcggttgattttcacgtacgtccgactgggatttaaggcatgtttggttggtgccacatgttgctacacttgaggtaggttaatttgatcaaatatagctaggtttggtttgtttctacaattttagcatgccgcactttcttagatctcttttgatcccactagttatagacctttttcttaatcaaagtttgccacaagtgtggtcatcaattttggagccacaatttacattttgccacacctttgacacaaaattgtggcaaagtgaggtgggcatccaaacaggcccctaagtttgggaaatatactcgtgagatcagctatactactccaaatcattaaatttttaggtttttgtttaagaaaaaaaaatagtcttcaacattagccctaaacaaacttccgaaaatatttatccctacttgtgaagagcgagatttcagctcccaaccattaaggtcgtgcacgtcaggagaagaaggggccatacactggagtgcgaaaagagaatggatttatttggaagtttcttttatgtccacctcttttaaaagttaaattaggttgccggggagaatacttttatcccttaaattctattagaggttttttttttaaaaaaaaaagaattggagaaatagatttgtgtggtctgtttgtgatgctgataatacatcatttacacaagtaaataacttgacctaggtaacagaaacttttaagaagattgaatttatgagcagcttgggatttctatcaattgtctctcaaaaataagacttcatgaaagccaatgattatttcccatcaagcccatttggccttttctaagggaaataactcatcttctcactcctcacgctttatttccattggtttttatttgaggaataagttcatctaaggtcccttaacttgttaacgaatccgatttttatccttccatcgaaaaaacagatacaacgggttcctcaactatcgaaaccggtgcaatataggtcctatagcggtttgggcgacaattttagctgacatggcgcctacgtagctgaaagtgcatctaggcccttaatgtttttggtgattaattacaatgcgattagagatgactaacatttttatttaagcaaatgtgaaggttgttatgtcctcaatgagttagcgtaatgcatatcccgccgaatatgttgatgtgtgtgatgcggcaaatgagcaaatggtatattgtaccttttttctttcgtttgagtcaataggaatgccgtactattaagagggatgatgtattgacatatgaggagtgatcaaagtgctcaaaatcaatttttaaaaagtgtttctcctcagtttggtgtgttctggaaattttcggagttttccgaaagtcattttcggactttccgaaaatgcacagaaccaattttcgcttctggaaattttcggatatgtccgaaagacattttcggactttccgaaaatgactgtgaaggcaaatgtggttctgtttattttcggacttttccgaaattgattttcggagtttccgaaaaacttcagcaaaggcaaaaatcgcttctgtgtattttcggacttgtccgaaagtgattttcggacttttccgaaaacatccagaacgatgttttggtgctggaaattttcggacttatccgaaaaatttttggaatgtctgaaaaatctttcgttgactttgctattggtgctgagctggaatttttggacttgtccgaaaatctttcgtaatatccgaaaatctcaattattgtgcataacgggcagaatttgggctgtggctataaatagccccctcccctcacttgtgagcgcggctggttccattccaatcatttgtgcccttggcttgctctctctctagcacttttgaaccttgctttcttgtttcccctctcacccgtgtttgatttggatttggtgtgtgtgtgagagttgtggattccagtttgtgtgagtgcttgttgttgactttgtaaagatttgtgagcacttgcatcatctccgggagttctttgcttcatttgttactcttggaggttgaggactcctaggcggctaggtgtcactcccgagccactgatctacttgtggttggccgggagaagtttgtgaaggtcggatctcacctccgaaagggaagagatacccttagtagaaggagtgcttagtgcaacctcttgaggaaagggttagctaagacccggctcttagtgagctcctcaacggagagtagaatcccctcaaggattcgaacttcgggaacaacttcgtgagcttcatctttggtgactttacttcctctctctccactagctttgcttgtttgagccgctataggtctagtggctgtttgtgctagcatattcttgttgtaggcaactagatctaggatttactttgctatttgtgctgactccgaaaattttcggaaatatccgaaaattactgcttccgcttttaattgaatttttgaattagcctattcaccccccctctaggcctaattgacacttttagtagctaatttgactctgtcttcatctgatgtggcagtgatgcggtgcttacgggcaattttgatttggaaaataataaaaattgcaggcccacatgtcagttacacaaaaaaaatagtggggcctacgtggccccacatatcattctcacccatcctcttcttcctcctctctccccaactcccctttcttcatctctctctccctctcctctctccaggtgcaagtgaggaggggcagcacacgacggctgatgggagatgggaaaggaaggagtgacgcgcaatggctggcggaagacgagggttgcgcgatggcctatgaggctgaggagccgaccatgccgccgccccgctcgagctggatctattgcccgtctctaacttggtctgctcgctcaacatcgtcgacctcttgttggcgctcatgcacggcaaccaacttgtctcgttttgagccatggcggcagcaacctcatctccttttgagcggcgacggtgtggtcactgtgctcgaccggctccacctcgtctcctctccatcctatctttcgagtgacgtgggtggtggcgtcgccgtcactgagctcgatcgatatcatctgatctccttccggtgagcctcccccatgagctcgagctcaagatctcgattggcactgcctcctccctctccactctacccccgctcgttgtcctcctccctctccgcccggacgccacgcaccgcccctccttgtgagccatccaccgcgcaccacccctcctcacttgcgcctggagagaggagaggaagagagatatgaagaaagggaagttgggaagagaggagaaagaagaggaggggggtgagaatgacatgtgaggcccattttaaaattaattttttggtgtaactgacatgtgtgggcccataattttgagtattattttccaaatcaaattgccatgaaagcgccatgtcagtgccacatcatatgaagactgagtcaaattagccacgtagacgccacgtcagctaaaaccgccatccaaaccgccataggacctatattgcaacggctttgacaattgtgggaccagttgtatatggttttccggttgaaagacgaaaatcagattcattgacaagttagagcaaggcttataatacagccgacatgttggctataaggttctttatagacttctctcagcctacccatataatagttagctttttataattaatacgtagcccacttgtctgtctcacggagtttttttggttcttgtgtccaagccggctgtaagtttacagcccgcttctcctctctctcctctcttctctcctccacctcagcatttagctggcttataaccttctattatacttgctctaagggacctaagatgaacttattcctttatttgattcgtcgattttactttagctggagcaggatggcttgatgtgggccagacgaaactggcataggaatggtcgacaggccgagaacccagctcagtattcgcatcgccatccttcggaggattcttcggcggagttattttagtactcccaacacgggtgcggcctaccatggacgacctcgccgtcgtcagcttcgccgggggcctggagcccagccagaagccgccgacctccatgagtttcagttgccctgttcgtccatatacaggtcttgctcgcttgaatcctaccacgcttttctttctctctttggcttcagtttcagttggtgcgctactgaaatgctctggcgaaatgcgtattgagatgaatgcaaacgttccatggattaaggtggaaaaactgccaagaaatccaactgggttcaggttttcttgctttgcaactcggtgacagttttttttttggaggggagagaactttaggaattcgtagcggattttgatgtttttttaggcctgcagggattcagacttaggaggatcacttgtgcaagatgaatgggcctgaatgtccgatgactaaaaatatctcagcttggaagttggagagctcttctaatatgccaagttaatcaggtaagttgcagagctgcagtgccactgatggcacatgagcatttctgcatttgtttgttaaccaaatattgctcaatgtttcagttccttgcgttcctttgttggaacgaatagtggttgcactaaagggattttagacttagtttggtataagatgagaattttgtaggattacgattcacattatttgcgccttggtactgaaattgtaaaatcgagggttagggcaaaatttggtcactgctaaacattctaatgttaccaaatcccaactagacaaagacatcacatgttatctgtagtagtgcaagatgtgtctgacaggtggttcctgttattatgttgtctgaaatactgttgatctggttggagacttataacagatagcatctggtggtcatcctgaaaaaatataataaaatgtatgaagaaaatagaaatggatctttgtctgaccagggaacatcttcgagggaatctttggatatttttttttttggttggcaagatctcagtgttactgtttgcttgctcatgtagatatatatatgtcagttaactcatggattgtatagccagtttaaaacggttacatataccattagctaagcttcctaagaagcagaaatttggcctatatgctgatgaaagacagctgcctccttagcttccattgcgtcaggtgcaccttccctttgtctactccactaattatctcatcaataagatccttaaagatggatttttcaatggccaaaacaattccttgccgttcactgtcggagctcttccactctttcatgccttgcattgcatcctctgctagcctgctatcttcctcttcagagcaccttatcattgaggaccgagactggatcatgtcaatctctgcacataagtccttgaaaagttgccacccacttaacttctttgactgaaagaactgcactgatgaattcacagtgtggttggcatccatttgctgggcgaggagttcatttgcaagatcaaatatgagcctacggtgcagcttttcttcgtctggttttgcttgttcaaggatgaggaaaagctctggattaatcgggtagcttgatggtcgcagctgatgaggcatcatttgaaaatttagtttgttgtgtaggatccctgatgctgaaagtatctcgtagaggtactggtgatctttattggcagcaactgatgaaaaagtgtcatcggttttcagagcttcctcactcaacatttgcaagagctcaagcttttggatgagggctttcatgttttctgcctttatctggttgccatcgttgcttgcctttgaaggtggtgtatcagggaggcttgttgggttccaactctcatctgaagtatgcgtctcgccgtctgaacaagtgaaaaaaagaaagaaaagataagttgataattcttgtctatctgacattctgtctcatctataaaaatcaaaataattggtgggctcatctacataagtatgtctgcacattaaccaacatactatcatgttccttcgtggcaagtgcaacatgtggggttccttgtagatgttaggtgcagactgtagacatgaacaacagcaggcagctaaggaattgtactctctaacagtttggcacaagcaaacactcacatgtgtatctgcaactgtcaatttactgtgatccttccgatctgaaaggaccacaagctatgcttggtgcattggctactggttgcctgtcactatgattggtggatgtgcttacagctaagtatgcttgtcctatgcctaaccagtttgagcttccttagtggatggaaacaaagttacaaacagtataaaaactcaaaaagtttgcagaagaatagcttgccagaccaagtcctcacctttgaaggaatctgagattctcttcagagaaggcgatgacccctcatgataaaatgttgcatcaagaactgacacaggacttgggatgttctcctgtggatggatcttcttcttgtctgcaggtagaattgtaggcatttcctgggaaaaacaatgttttgtcaatcagttgttactgccagataatgttttcataacagtaaggtctttagaggtggtactacagttaattttctgtacctcacgattgggtgttgaagctattttgctttgatggatatatggtgagttggcattcagaggattcggatgatcaacgacacccacatcgatctgctttgccaaattgattttagtttcagggatgtgtaacacattatcgttgtcagagttgctctttgtttgcgagtgccttgatcttagcctgcctcttggggacactgtttctttagatttcttgcctggtgacgttggcaaaaccggtggaccacctcctttcagagtccgccttcttctgtgccagcctggggctcaatgagctggaaagccttggtgatcttgcagaatttacaggttcctcaccactggaatgagcactttcattcggagaatgatttctcttgctatcactgttttcattcttcctggtgaaagatgtctcttcatgccgtagtcttcttatgccttttggccttgaaaggggagcaaccaaagtatctgaagcatcaggttttgtgatgcatcttgctggtttcatgatcacaattggagactggaaattttcagaatcaactatttgttcagaggccttcttttgaatggctgttaattcaggattgttgtcgctctggcttgggccatcctttttgtgcagtgtgctcaatatcctgagagccctcagttccttgttgcattccgacaactctagacccctgagtcttctctgtatgtcagcatagatggatgcagttcttggcttcacttcagctgcacgtcctgttacagctctctcattctgtctccatggggctgcttcagggataattcttggagaaggattggttttcagtactggagagtgattcttctgcaccgggacactatgatcttggttcttgatcctttgacagtgtgacggctgatcaatttgcgtgccatggacaggtgtaggtgaccttgccgtctcatggatgtcaggagtagttccttccaaccccatgagcttggcaacgacgctgctggcccgctgatggctcggcgattcttggtgcttcagaacatccaggaggttgtcatcagttcttatgtagccagagttcttcagacgtgaacatggattcatggattcttttctgctgtccaaggacagcctgggaagctccttgagctttgctgaaggcttcttgctgtcttgcgcttcgaccgacctcaggagttgccgatcgtcgcatgagaagcgtggtggcctgctggattcatgaacatatccaggaacgccggtgctcctgtcgatcccaatcacgtaagttccatcggttgatttggagatcagcaacggccttggtgagtctttgtgcaatccttttctggactcctttgtcgacgtcttgatggtcataccatgggtttcccggttgatggactccttgacaatgtctctaaagccagtgtgtgggtctttggttttggcctctgtcttggaacatttcacactctttgtctgtgagcttcttggtggcttcccagcaaaacgctctttgttgatgtaggagagctcttgttgtattggtctgttgatgtctgtggacgagaacgaagagcacgatgaggaagaagaagatgcccgcgatgattccatggagaggctactgttctcggtcatacttttgctgaaggttttgtcctacacaagtaagtattatgttttgagtcaaaaaccagtctgtttgaggcagatgaactgcatacttgggatatatatttgtcatgcacagtacagtaggaaaattaccagagtgttgtttgaagcaactgggttttgaatcgagacattgctgttgctgtttggcaaaacatggcctaaagaaagtattcaggaaacagttattaatatgaactgtatttgggtataaaccaaaagaaagttaccgcagttaaattataaatatctaatttgatcgagggaaggaaaagatcaatatcataaagatatctgaattttaaaagttggatttgatcaagaacatatcactgaaatctattgatttgtttcagccaaagaataccaaatatctgaatagaaaaagcacttcactttactaccatttcatttttacttgactgattattcactgtgcaattgcccattactacaactcatatgtgctacatctacattcctgcagcttctgaacttgtgtcagtttcttgtccatgaccatgtacctccctataaatttcccctgttcttacttggcagcagcagtactttctaaacgaaacaattttttaatccctgttctagtttagcatctactgccagtaacactgttcatatctccacaggacagttagtattcagttttgtctttgtgataaactttggcagcaaaagagagagagagagagagagagagagagagagagagagagagaaagaagaagaagaagaagagctacacgaagagcacacgccgcagaagagtacagagaagaagaattggtatggtaccactacctggtggcgccgtgcctcgggctccgccgcgttgacgcgcggtgaggaggcggcggcggtcgaagatctggaacatgccggccatgcagcccatctgccggtcgaagtcggaagcctcctgcgcgaacgcctgcatcatccgggacggcatttcctttgccccaagctaagctctcggctcttgctgaacagctgaagacaacccccaagaatcggagatgaacgagaggcctcttcactccatggcagaaccaggctaagctagttctagcagcaagaacaccccaaccaaagagagcacgtagatgcaggctttacacagagctttcctttccttttctttttttttatcttctttcttctgttctattctctcacgctatcatctacttctctctctgtttgacaggttcagttgagaggaatggtgcttgtcaagaggaggagggagaggcagcagcttgatttaagaacgagaagatatgtgtgcaatggcattgcaaatgcattgcagcagcaacgacgactggtatggctggtcctacggaggccacagcaaatgagcaaatacaatactgtgcaaggcacatgtgggctgatcattgtgggcatgggcatgtgatgcctgtcaggcttttgcaccgtcgtcgtcgtcatcgcccgtcagatcagattcagcctagatcgatcagagcctgccactgccagtgttaaggaaggaatgcagacctgtccccgggtcccacattccgaccccggttatatatacaggtgagaatgattaaaacctcattccttaacattgatggagtgggaaaaaaatgatcataattttgttgggtttcataaattggatcatatgaccgagattagtagttgtcgaagttacatcctgaaaatttgcattcacgtccaaaatggcgtgttttccgtaaacagtgggaagtattactaacatgtataaatctgtaacccgaataaatatagattggttctaatctaagtatgctcatgtgcagaacaatgctagagcggttggtcaatctggtggttaagccattcaatcttcctgtgaagaagaagaaaaggggaagattggagacgaaggaagattcagctacatatccctggttccagagcggcgcgtgtggcagagagcatgtgccggttctacatatgagatatataatctaagcttgcttctggacgtggatcacgttagcagcaatccactacaccaccaccatgaactgtttgttttagctgcggtcagaacggccgggccatgctcaatgttcagacttctacggcctcagctgatcaccaccaaacgatgtggatgctctgcatgcccccacaggcaaccacccgaagatttgttactccgggttttgccgctccatgtggcactgacatgtgggtccttaaaggtgttacatgtgggtccttaaaggtattacaggtagtcggtggtagcgagacggtctgtttgattaggatgatggtggaaaagaaaaaaaagggatagatttgcttgaacgatgatgatagggtgtgtatgcctgggccctcgcatgtttgcggatgcaggagcatgcaaatggaaggttggcactatttttcggatgagttgtaagcgctgtacttgagcaatttgatgggtgagctgtgttagactgttaggcatctggtttttgcaaaaggacaacttgatcaacgtgctgtttgctgttcggtcatctgttgcaagagcaatttgatcagtgtaggccacgaggttaattcattctgcaattaatctctctctgtatggaaccactgttcagtcatctgtttactgtagatccccgtactactcactcattgtggcaccgcgtttgccacctcaatttgaggcgccatgtgtaatgtagctaagcctaattatacagctgggtccttgactcaatttgtaaatggctgccaaacaatcctatctctcagctggtttatcagatgaggtccatgagattcctcttgtagcctaggtggaccaaaagagctattcctcttgtacagtttactcctcttttcacattcatccacacatgcatcatgctctgacactgctgcatgaccctaactcctggaactctctgcaaagtgtatcaacactgacatcagaacagatcaaacatatctcaacatgtgagtacgtgaccttgctgttgacaaccaccttttctttttttttttcactttgcacacaattttcagtcaacataatatatgaaacaattctcgggaagtagttaacacaccatttgttcagtttaaaggattttcagcccatacaaatattaaaagtaaaggaataggaatggatgcacgtatcaatccatataattttttctaagaggtttgagcggatgtaaaattcccatgttttctctctacaacttgtaaaaaaggagaatttcctttggtttttctatagtttgtttctacaacccaaatgatacttatagaaattaatctttagaaattctaatactttgtttttcttctacaagtagaacacgctctgaatataccgaatgacactaatacaaattattctttagaaatttgaatactttgttttttctacatataaaatacactctaaacgggtcagcatcttgcgcattgggtactatataacatattggaattactcgtaatatagaagtaaacatagtcaaaagatactatgttttgttttggaacagagagggtagtagtacagtagcagtggcaagggttgcagtaccaaacttgaaggggatgcaggataaactgggaagtgatgaaggcagctactagatcagagcattcctgctggttccttctcaagaagctgcaaagaggggaccaagcaaaagacacagcgataaatggatagcaatttgtgtgttttgggggtagctagttgtactccagggaccagtgtaagcagatctggaggcatggatgttgttaggtgggttatactacctcacactgatggatgtatggatggatggattgctgctagtgctagctgtattttcttggacccctttgctgtggtggtggtcgtaagttggatttgcattgattaattagtggacgccttttatgtttcgatcgcctgtttgtgctttgtccgcctcaattgattaggattcctggatctgacactacaaaccatatatagtggttctttggtatatcaatatacttcatctctccattctataataagtttatttttaactccactcgttttgtttttaattaatcattgtatcagagtttgtgaaagcaggaaataaatatgttgggagtagataaagtataaaatagttatattgggatttgataaactgaagttattctgatatttttacatttcattgatatatatggaattcgtgaaaaatgaactcattttgaaacagagtggatttttttctttgcatttaattttattggaatgttcatttttaaccgtttggtaaatgtgcactttcgggtttcaacctggcgggagcagctcaatggcgtgccgcgtgccttgcaaccaaggaaacgcttttatggtcggttaagggtctcttttgaataaaaggtttaggaagaaattttataggattaaaattctagagaaaatgtttttatttacccttttatttaaaggattggagtttttcaaatcctataaaattactatgaaatgactcgttagatgtagatttttgaagaaactttgtaagaagtccaacctctttgaaaaattacttcaagtctatatctctcattcgattactgtgtttttcccgcggttcaatcaaacgattttttcctatattttgcaatcatccgttttacattggcattgtcagaattttgtatgtatttcctctatttcttagttttttcattcatatgattcaaaaaggtccctaagatcaataataagactcactaatatggtagtatggtgtaatgtaaatttcttttttacttcggattatgtgaaaaggcatatgtatatacatcggacatcactacacatatatacaccaaagaaatgggtgataaagttgaatatatatggcttcaccaaataaggttcaactaatcttagtacccacaattaattacgtatatgcgggtgtatgtattttcactgggaatttggtgaggttcacacggaattatcgctggcctttcttatttgaacgttaaaaggtgctctgaaacttttacccatcaggtaaatttagcgatagttttctgctaagtgtctgttgatccatttcgctcttttccatgagcgcagaatagaatttagttcttttgatagtattaattaatttctccttttttacaataaaaatcaattcaacatatattttgtttattcctttttttattgtggtttaaagaaattgtattgattacttcggaggaggtgggctgtgtgccgatatgatgacacaggcctaagatgtatactatactattccattataaaaaagaaggaatttcttccgggattaggttaaacacacacatggccttgtgccatccaatgttcaaactcatgagatatgacattttacatcacttccacattcttgataagataactcctagtgttaaatggttaatttaaaatacatcattaaatcctaaccatttattctctctctttgatttaaaactaacccttcactcattttcctatcccaatcctacttttcttatcacattatccaaacatagcaatattatgtaagttactggaatcttatgagatactattaatttgcatagccttatcggttgctcatattcactaataagccaaaatggtttattagagaataaaaattaatttatatttacaaattttatagatttttttatagggacttaaaagccaacgctaaaaaaaattgcgttgaaaatatcttaaaattaattttaaaattaagttcaaaaatttaaaatttggcttttgctttgatttatcaggccgagcgataatgctctttgttgttccacgtgaactagggccaaagaaaccacacaagtaaattagcagtgttctcagactatttgtttcaattaccgtgcccaattattccaatccataaattgcatgggtaagttaattcatattgttttgagactttggtctggtctgtcccttccaacacttacacagcttcgttgtttcgcttattcacttatccgaattacttattaacaaataaaaaattatttgtgagtaaaacttttatatacatgtccttaagaactcaaaagtaaatgttgtaaaagaaaatatgatagaaaaattttaaaaataaattcaaaattgagttctaaaatttaaattttggtttataagaataagcataagggaaacttaattatgagaccctagttgttatcaataaaatgttttgaaatgagatgaaaggcataagggaaactatgagaccctagttgttgtcgataaaatgttttgaaatgatatagaagtagccgaaatacagaagaaataaggccgtgtttagattcaaaattttttcgtcaaactttcaattatttcgtcacatcaaatatttggacatatacatggagcattgaatgtggacgaaaaaaaactaattacacagtttgcatttaaattacgagacgaatcttttgagcttaattacgcaatgatttgacaatgtgatgctacaataaatatttactaataacggattaattaggcttaataaattcatctcgcagtttacagacagaatctgtaatttattttattattagtctacgtttaatactttaaatgtgtatccatatacttaaaaaaatttggcacatgaactaaactcagcctaagcttgggaggtttcgtttaaaatgtcatctccacgtatctgtcctcctcgcttgcaagtcaacatatttttttggttttcgtttacacagagtacaagttgttacaccgagatgagattctacgacttgtcgcatttatttacgctttgcacgaaagtttatgtaatgtcaaacaaactttaattagacataatgctctaattaaatttccatctcaatgaatgggattctgatcttcccccttaaaaaaggtaaaccaatttagaccactgccaaaatgatgggcaaggttgggcttcgggccacgcccaataagcctaagcttaatgctaaggccctctttatttagatatagacttattaatttagacttttaagttagcttattaggtttatatgatttataagccggtggatttaatatcctaagtttaatagtcaagtcatgtatctatctcacataagtcaaaaaagcttctccaacttattttttggcttaatagtgttagaagggcttatagctttagaaaagccaaactaaaaagccgcttatttatttaagctcagatttttcgggggaatagttggcttataagcctaaaaacaagggcctaagacaaaaagtcaaaagagagcccgagcctaaccatcctagggttttgagatagggtgggttctcttagcttttttcaccgcctcaggccttattcgattaatccctataagggagtggttggaggagatttattctagtatataagttaaatgagtgtagccccatttaacctgggacatttaacattttgccacttttaagatgtgcgtaattactagtatttatcactcgttatctatgacatgctagctctcatgtgtctatgacaggtaggtccagtagtaaattttttatcaccactcgtaaaagtggcaaataattaatcattctattttatccgtttatcagcgatcgtaagagtaagagtggagctaaagaagactagtaccggtttatccgcttgtgcagaaggtgaaaatcatggggaagagatcttataataatatcgtcaacaatagaagagctaataattggctggaaatgtgctcataaattttagatcgctatattctctgcaaataaaacaaagaaaataaaccaatcgcggtccatcccttatctcctcagtttgtcgacacgtgtgtgtgtgtgcgtgtgccgactaaaaaccgctgcaagtcattgcactgcatgcaaatgtaacttggagaaacaattaatggatgccggggcattggccggtcgacgacaaggcttccatttatcctcaaattccgacgagaagatatagagatagagcgcatatgcatgttccgatacacatgcgaatggagcatgcatgtctttttcttctctttcagctagaggacatgcatgttggatagagagtactctagttagatgttgcagtcaatccatcagtcgctgccatgtgtgcagtgctaaagctagcatgcattatttaaacggtttttgaccgtttatatatatatatatatatatatatatatatatatatatatatatatatatatatattgaccgtttaaataagctactagctagcaactcgaccctagctatagctagggctccaggacagttgccgggggatcgaccggcagacacgcgtgatcggttgatcgatcgacgcgtgcgacgacgagatgacggcgaacaaagccaatctaacgttctccatcgcgtcggatggcgacagcctctttttccttcgctactttacccatcttatactactacagtaacctaaaatcgtatgtaacttattctaatactattaatagagagttttctatcaaattcattgtattatcataaagcacattcggttttagattgctatatattctgagacagagagaatccatattgttctctctctcatgtacttatggtataagattatagtcgtagtatgtactcctgtaccaatatatatgggggacatataaagaatacaaaacgtactctgtagaacgtaggagctggcaagcatgcgtgcatacaacatccgatcaatcggatggaaacatagggtataccgtacttatgtacatgcatgcatatataacacttagtgccggtcctgctactgtgtatcatcaacatctgtgattgaaaggtttccaagaacatagaagaacaatatcacagaatcaaacatatactagtcagcatccaagaacacagatctcgaaggaagagaacgacataccgtcactgctactactcttcgtgatgaagttctccaaccagtgcatctaccgctgtcactgcttatcgccgtccaatgcgccgactgccatcgagcccttgctggtgggaggccacccgctatatgccgctgggggaggatgcacctttaccgggtggagaagagaagaggatttggtggaagataaactggtcgcttataagtcaacttgtgtcttatgtcatctcagcttgattcatcggtggcgtttttcttaaactaattaaataacactgatgtctcatatataaatactggtttttatacgcccaacacaaatgactcacatgtaagtatcagttttttgtcataaccaatacgtgtatgactattgatattggttttaatttgataatgtcaaaacatggaaaacctctcatatgagactggttcatatgacgtgttttgtactagtgcagcccccacaccggtaaggcaccttatggcctatggcacattgcagcctgatagctagctgttctaaaatacaaaatggactccaaaatctcccaaatttagtcatcgatgcacttctgaacaaaattccgtgacaacgatgaagtgcactatactatttgacgacctttgtgatggtatatttttcaattcacgttccttgcaacgatagctctggcagagtcgatcaacaaaataaccagcgatatcatacgcatcatatatagacaaatgcaactgacacgcacacacttaaattaactattaacaacgatcatgtgcgcgtccttcttcgatcgttcagctcaagattccttaatcaaagcatcgagattatattttttttcgtatgtattagcctaactagctaccagtgtgcagctggtacggtagtgcagctccaaagtctttctaatatcttatactcttttcatggtcaagtggcagtatctcgcattgcatgcatgtgagcatatatatcagcgatcgtttgctggagccacgggtaaagtctagctagctaagtgctaattaggagcacacaaaaatcttgtggcagttgtcatatttattcttcagttaattaacgacaaatctgtcggtcgatgtggatcgatctatatatatatatatatatat

SEQ ID NO: 68949 - DNA, 4875 bp, Oryza sativa
taccaaacaaccaagttacaatatcggagtataaaagttgacaaaagcatcatccaacaaaactgcctatcaagactgacatcattaaaacgctcataagataagcaaaatgcatatttgctgtgctgatgggcatggaatttatctcttcttggagacaccgacagtctttcccctcctgccagtagtcttggtgtgctgaccacggacacggagaccccagtagtgacggagaccacggtggttcctgaattacaaaaagatatggttcgattacaattaatcgtagtagttcaaatgaaatcaaagcgcaatttgttcaactgtgagaatacaaaaagtactcggtccaaggcctcaaataacgaaagaatatgatttaaaccaagttcacaccactagctggttgagaacaatgttgtcaggatcgggatactaggtagtatcgttttgctcaaagtaatatcgtatcgtagtatcgggatactatgatattttctttttttaagtttaattaatatttatattaattatatatagccattctatataaaaaaatatagtaatgatatatgtcatgcaaatagagacatttatcgagagaaaccacgttggttttgatatatttaactgatttttataaaaatttgagcatatttatttatattattttcaaaccatgttattttaaataatattttgtagtatcgtagggatcgtagaatcgagataccacctaagatttcgtaggatcgtgtagtaatgaatagtaggatggagatactatgaaaattaggatactaggtgggatcggtatcgtttcggcttggtaggatcgtagtatcgtaagatactaggatacgtatcgggatactgacaatcttggttgagaatgactgatgacatgaacagtacatacttagctaggaatttcaccataacacaaatggatatatgatttaaccagagatgattcattcccatttgcccatgattgatgcagtaaacatctcactaaaaccgcacaaatttagctttttttttttacgaatgtaacaaagcatgaaacaacttatcagtgcaacaaaagcatgaaaagataaatctaccctacacatgcaagttaccatgaacctaaaaaatgtggtacgtgagcacaaattaatcagaaatcacctgatcttcttcagcctctcaaggtcatccctgagcttcatgtccagagcgttagaaacaacctgagagaacctcccatccttgtagtccttcttcctgttcaaaaaccagctgctaggaggatgatcacacagacagagaaaggtgcgaagagtgtcctgtagaccatcggccagccgttggtcatgatcatggcgagggccgcgagtgcgaggaagatgccgattgttacggtgaacagaaacacctcccggtcccaggtaaaagatccctgaatcaatcggttaacatctccaatttgtcggtaaaatagtgtgcagtgacagaatatgtatagtcgttttattttccagaatggataatgacattttcactagtgaaaagtgaaaccaaagatgatattggaatgagccacgtcatgaaaataaaatgcaccgttggatgccaatgaggaaaaaaaaaaaggacaagcaacatagaccgtccgatcaaacaaggaaaaaagaacaatgcaacggaactgaggattcccgattcctgaaccgtaagaaggagtcactttgcattcagtgccaatcaatattggctctgtttttttaaaactatattactccattcgtcctaaaatataacaaactttggactctgacatggtctctgaaatggtactttgaccaacaatatctataaaagtaaaatatgttaaataaaaagagttgcatattatgatagtttatttaatgatgaatctagtaacatcaattttatatgattaatcttttttatttgtttgctatcaatagtcaaagttaaaataatttgacttgtcactatgctaaaaatgtttatattttaggattgagggagtagctttgatcggaagctagatactgctgctggatagcagcaacagcggtagaacggcgtttgggaagagcggtggccaccgccttcgtccttatgtgccttccgctcttcaccgccgccttccgctccttcccaacctctgatggacacgccgccctgaccacaggagagaggagggaggccgctcttcgccgctgcttccaaaggggatggattgtagcggcaagtcacggctcgatctcggcaatggcgatcgacagagaccggatttggggggtttcgactatggtggcgattgggcgccagcgaggggtggaatggcattgctgggaagagaggaactcgattgtggcggtggctgggttgactggggactgaaagagagggaatcgagcgcccgagcggcgacggccgacgcagaactcggcgatggcgaggaacggcatcgctgtggtgactcgaagttgtgggctcgcaaaggggatccggccctcgcccgcccgccctcctaccgttgttggcccccgtcccacgctcgccgaagggaagagaaagagagagagggaggaggaagaaggaagaagatagagcatgatacgtgggtcccatacatactcttttgtgaatgacaaataggtcaaacacttttttttttttagttctaatgctacctaagtttcatgtcaatgccatgtggaacgaagaccaggtcaatactgccacgtaggcgctatgtcagcgaaaccatcgaaagagtcaaattgcactgattttaatagttaaggggtcgagttatccgatagtgtggtttagggatacgaaacagatttggtcaatagttaagggagtcagagtgaacttattccggtaacataacccatgtctctacttcttgcgcatgctgctgctccatcagcctgtaatttgtatatgcgacggctacggcgagttggcgagcagccaagcacagagatgcttctgaacagtaagaaaacaaaccattagatctgaaaatctcctttagcacaaatgcagaaaaaaaaggtactgaaaatctatcgacaactaatatgttcctctcgaaacacagaaataaattcagaagttctagactttcagtgaagtcgggaatcctcaaatttttcaaagatatccttaagatgaaattcataagtactcattaactcttagactgatttagtaacttacctttcaggtaatatccatgacatatacggccccatcgtagccgctcggcatgccggcggcggcagagcactggagagagaggaaatgagagacgcaaagagacgagaagaccgaaaaaagtcctcttctcttattgcaccaatcctatcttcctataaagttatctcccactaacttcttaagcttgacatgcaaagatgccacatcatcatccactaacaagatgtcacatcatcatccactaattaacaagatgtcacatcatcatccactaacactcatcacatttaaacatcatacaaacatgctatatatttatagtttttataatttaagagcttttaaaatacaaacatgttaaattatcatccaacataattcacataatgtttcaatgtatatctttattatgttttatgatataaagtatataggtcattctcacttagtcagtgcttaaatgattaatctatggtccaaattatctttctctttttttcctctaattaagtcatatcacatcaattgtttttagtctttagatgattaatatatctccctacttttcttcttccataaagtcataccagcttactttttacgtttgaatcaccattctacatactatttaaatttaaattatcataaaccacattaatttacttaatctgatgttatctagctatcttatatgttattttttttattgttatcatactaaattcccgcagcaatgcgcggggtttcacctagtataatatatagcgatgccaacaactttaattattgagacaatttcgttattgcctctattttaatataattttaccctcggttttttaggttttcgctttttatccctggttttttaaatagacaaagcgtctaccctgtttttcaccgaagttaatggtgccgaaattgttgctgtaaagaaatagaaaagaaaagaaataatgattttgcaaattattgaattacctttatacccctagctattttgcaaagtaaggaagccaaatcgctgcccaaaaccttatctccaatcctcaatcccccatccctggcggcggcgtcccggcttgcaggttgcagcaggcggcgacgggcaggaggctccggtggcgtttaggaaacccggcggcggcggctcggccgggagggcgacgggcaggaggccgcagaggcaggcaggaagttgcggcggcgggcgcacggtgaagaggggaggccggcggctacgcgcaggaggccacggcggcggtcggcaggggctacggtgcgcggggagtaggaggctacgggccagcgacggggagaggtaggaggctgtggggctgcagtgacggctgccggagtgatcggcgctggagtggctgagcgtgacgcggtgcacgctgtgtagcctccgcactacgacggccattgctcctgtcgaccacggtgagtgcgatacgtgaccctgtatctgatactcccgtattttaatatatgacgccgttgactttttaactaacgtttgaccattcgtcttatttaaattttttatgcaaatacaaaaatacttatgtcatacttaaagaacatttggtgataaatcaagtcacagtacaataaataata

SEQ ID NO: 68950 - DNA, 1882 bp, Oryza sativa
cttccgcctaggcctacgggatgaagacgctgtcgtggtgaagacggccgctaaatcgtcggggagcttcatcaggactggtgggtaagccccgtcatcttgatctggtgtcattggagaagatgcgatctcggccgactggtttgaagccgactcggtgagatggtcttgaagtagctttcaaccgcgttcgggaatccaaacgggaccgaaatccggttctctcccgactggtttgattccgagtcgaggagagaaatcttgccgaagttgtcggtgatgaaatcgaggctgccgaaccgaaacgtctgcccgggcgggaagacgaggtcgtcgatgccggagaaaggacccattgcactgatcggcgaaaagcttgacgctacccctacctggcgcgccaactgtcgaaactagatttcggcaataatgaaagggggtggctatcaagctagaaaagtgtatgggtttggagacaaaggatttatacaggttcaggccttcttataaaagaagtaataccctactcctgtccggggatgaatccgccgagtgtattattgattgtgtgattcgggaaaaatcagcatatgcccctagaggcgcccggaccccccttatatatgggaaggagtccgggttacaaaagataatccatattcctaccggaatatgaagataaaggtaaaatacagtcgtaaccgactaagtctcagggtgtttccttgatacacaagttaagaaacaaacccaagatacagacaagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaatcgtgcattacatgacaaaagcgtacgcggcgcctaaataggcatgctagccgactgctttttagccacaataaaagaaatccgagtggtttacactctaaaaggttcacgaatgaacatacttgacaggtatccgaataaaaactctaaagattacccatcaagtattatgaagattatggtaataaataagtcgaatagcctaggccttgactatttaccataatgaaaataggtatataacataccaaggaagtgactataataaaaacaagtcattcctagttaacccaaacagcttttgttagcctaaaaaagcttgcaaaaacagcataacgcctttctgtcgggcacctttttaattcgcattgcaataattccaaagaattatatgaccgcataaaaaggatttgatcagcattgggcaacactgttgtgcgcataatattgccaaagcaaaatatgcctaagtccctaaggaacacaatgggccacactgttaaaagtattgggctgaaatactgttcaggcctaggcccattagcacctccgatacccttaactgaaaaatccgatatccaagcgacgcttcgtcttccccgccggaactctcgccattttccccactccttgctacagtgaaaagctgcgccggcgaactagggttcacaactccgctcaaatccacctccgaaaagtgcatcaaaatccttcccgtgatccaccgcctcaatccctcacctttcccaagccatccctcgaatcaaatcagcacatttgagaaaaatcgatggcggaagagagagaaagcttcg

SEQ ID NO: 68951 - DNA, 1361 bp, Oryza sativa
agttacttctattgtatagctaagttacttctacaatttaataaattacttttaaattaataaaatgtttgaatatattcaacatggatcttgttttgtcacatattttatgtagagtataatggtacaaataaatcttgaaaataatatgtgatttaaaagatataagtcattaaaggggttaaaaaagacgtgtaccataggctaaaggcatttatatatgggatgaggtggtctccggttagggctaagcctaagggtgaaaacggagcggattcagacggatagtgatcataccatatcctaaatcatatttttttaagcgaactcggagcgggtgcggtccgtgtggatagtacacggatgtggatacggagcggattgtttcggatgtcggaaatagtgcggagtcggtgcggaatcagtttggaaacggattaaatttatcggatgttacgtgtgtatgcaatcaatacaatgtcaacttaacaatgtaagaaacaataatacaatagtcaatgaacgacccattgtaataattatgtgcttaagtgctaaacaacatgaatacgtgatgttcataatataaaaatacaactacgcaagtgtgacatgaggcggtgaaagcctcagactaaaaaatctaggttaattgatgaattaggccattagatggaccaacttatgttatatgcaatagatagagtgattacatgtgttgataattttgaattatccagcaaatggcatatcagataatccgataaaaatatcggataatccacatccgccagattttagagataccatatcctcatccgcatccacatccatatcagttggatttctgaaagcccttaccatagactcgtttcgaacggattcggaacagatcggataggatattatccgatccgttttcacccctaactaaaccactactactcacgtccactactaatgctattttggtgccgccgccatggagatgggaacgacagagatgagaggcaggggaaaatctaaccctagtgaccacggccaaatgggccgagatggcccaagggaattgctccgcgtcacgtgtggcattttctacgcacgacgccgaaccactcggtttgtcaaaaaccacccggttcattggttttcccaaaaactgttcggttccccttgtttttacaggtctgattgcatggatggtctttgaagtgacccaacccgtcaaggttcctagttatggttttttccggtttaaccggtccggtccgttttttgcactatgcgccaaagcgcgtactgggacaacgagcacggcaaagccggtgatggcttcgcatccctatgctaagatgataaga

SEQ ID NO: 68952 - DNA, 6781 bp, Oryza sativa
tttttggtaattttttatggagtttttttggctacttttgatggagcatagctaaatttctgcctaaacctgtgattgtttaagttagattgttcgaaatttgagcgctcggtacatcaatttaaatgcccttgtttttgtgctgaaaaaagagagtaatattctgtgggtttctccagtattgttgtgaaactgaaccctgaattcgtctatggctttgaaactgaactatgaactcgtactgatgtgatcaatctcaatctcatgtggaagtactaactgaagatttatctttctcatgatttgatctttaggtactcatcatcaattgtgccatccaaattgaagttcaaatttccactgccaagatgatcaaactccggtcagctctaggcgttcttgagatcttgtcagttctttgcatcagccttgttgctgcatacactccagtagacaactacctcatcagctgcggctcatcggtcgacacgccggttggccagcggctgttcgtcgccgacgactcgggcacggtcgtcctgacatctccggcgagtgacgcggtgaaagcctcgcccagcgcggtgtccgggttgcgcgacgacgccgccatgtaccagagcgccagggtgttcaaggcgccgtcgtcctactcgttccggatcagggaccccggccgccacttcgtccgcctccacttcttccccttcgtgtacctcggctacgacctcgccacggcgagcttcaaggtgtcgacgcaggacgccgtcctgctcgacggcttcgcgccggcggcggcggcgaggggcaacgcgtcgacgacgacgacgacggcgacggcggcggcggtgtgcgaggagttcctgctggacgtggcgcgcgacacgctcgtcgtcacgttcgtgccgctcgccggcaggctcgcgttcgtcaacgccatcgaggtcgtctcggtccccgacgacctcatcggcgctgctgactcgtcgctgtcgacgtccgactccactggccagcagctcaaccctgccgtgatgccgctgcaaacggtctatcgggtcaatgtgggcggccaagcggtggcgcccgacagcgacacgctctggcgagaatggactagtgaccagcaattattggttggacccgcaatgactaaaggagtttcttacaatcgaacaccgaactacctgcccgggcaagcgacggcgaacgacgcaccggccatcgtctacgccaccggcagggagcttatcatcatgacgaactcgacggacgacggcatgaaacaaatggcgtggcagttcgacgtcggcaggtcggcgagctacctgatcaggttccacttctgtgacatcgtgagcagcgtgcctggccgcctccacatgaacgcctatgtcgacagctccaacgcgattcaagatctcgacctctccgccattggcaatggcacgctggcgttcccgtattacagagacttcgtgctggctgctagcactccatccggcaagctcgccgtctacgttgggtcgacgtcgcagaagatcacgacacctgccgccattctcaatggcctagagatcatgaggatactcacgaccgccggcaacgtcgccgtcgtcgagccaacgatgccgccgggaacgaagaagaagaacaatttggccgtcgttcttggctcagtctgtggagctttcggtttcgtttccgtcgccgctgctcttgtcattgttcttaggaggaaagaggagaaggaggagctgcggacgccgacgacgagccagccgtcgacggcatggatgccgctcctcggccggatcagcttccgcagcgcgccgccgagcgccgtcgggtcacggtcgcccagcttcaccattgacaccaacgccaacactccaggaggaggcgccactcccggcatggccgcggcggcctcgtcttccccgagctaccgcttcccgttcgccgcgctgcaggacgcgacgggcaacttcgacgagggcctcgtcatcggcgagggcgggttcgggaaggtgtacgccgccgtgctccaggacggcaccaaggtcgccgtgaagcgcgcgaacccggagtcgcggcagggcgcgcgggagttccgcacggagatcgagatgctctccggcctgcgccaccgtcacctcgtctccctcatcggctactgcgacgagcaggatgagatgatcctgctctacgagtacatggagcacggctcgctgcggagccgcctgtacggcggcggcgcggcgacggcgacggcgacggcgctcagctgggcgcagcggctggaggcatgcgccggcgcggcgagggggctcctctacctgcacacggccaccgccaagccggtgattcaccgcgacgtcaagtcgtcgaacatcttgctcgacgacggcctcacggcgaaggtcgccgacttcggcctctccaaggccgggccggacatggacgagacgcacgtcagcacggcggtgaaggggagcttcggctacgtggacccggagtacgtgaggacgaggaagctcaccgccaagtccgacgtctactcgttcggcgtcgtgctcctcgaggcgctgtgcgcgcgccccgtcgtcgacccgaggttgcccaagccgatggtgaacctcgtcgagtgggggttgcactggcagcggagggacgagctggagaagatcgtcgaccggcggatcgccgggacggtgaggcccgccgcgctgaggaagtacggcgagacggtggccaggtgcctcgccgaccgcggcgccgaccggccggcgatggaggacgtcgtgtggagcctgcagttcgtggcgcggctgcaggaggtggacggcctcgacgcctccgacgtgagcagcctcaacatggttcatcagctgatgccgccgacgagcttgcacgctcgtcagagaagcgccggcgaaagcgagaccggcaggacggacgccgacgaggacagcagtgtggtagatgatgattacaccgatgcttccatgagaggaatcttctggcaaatggtcaatgtgcgcgggagatgatactgatcagtcatcttcaaacattccagatcatgaattagtcatcttcagactggtcagttcattgttgaacattccaggtcaaaattcacctctccagtatccagtcggaaaaagtgaacaaagacatacttagaatttaaaatatacttaccagtgaaaattttgtactgtccctacaatggagttcaaacatatgcttgaatgaaagacatgcgagtctcataatttatgtttgagcagaaatactacacagttcaaacttttgcctaccttctggaagcaggtactggatggggccggacagcaagactgcaaggcctaattagcatccatacaaaaatattagcaagagcaagcaatagccgatatgttccagaaaccgcggtgggccgcaaattccattttatgcagttcggagtacaaccaacagatggcatggtctatcaacttatgaaaggcgtcaataacaaataggatacagatccactcaaatcccaacaggttcatagatatgactaaaatctccaacaggtttaaattgattcataaactttaagactgatacatcccctaacatctcatttaaggggatgtgcttcctctcattcaaggggatgcgcttcctctaggcgaggcccgatgattgccattgtcttcataatccctggggcttgggctccggccattggcagctgtactcatgtcacggcgctcatggtcagcagggctacggctgtcagctctcattgggctcctgctgtcccttggtgcaggactcctgctggcattaggggtagggctgcggttcctcccgttgggtggtgaagcacttctcctagggctgcggctatcacgagggcttcccctagggctctgggtgtcgcgagggctccccttagggctgcgactgtcacgggggctccccctagggctgcgactgtcacgggggcttcccctagggctccgactgtcacgagggctccttgatctcctttcattacggctatccctccttggagactgggagcggctgtcaaaacaaaatggagaagccatcagtgtttgatacaaattaagcagaacatgaggattagggggagaaattaagcaactgatgaactcagttttataagagtgatctggagactttctggttaacatccaatagattagttttttgcaagtataaatcaattaaccagtcctagcaaaatcaacatgaatcaacatacattcagaactcaataggaagatcatgactgctaaaattaataatgatcacatataagataagtaagagattcccatgttgaaatcaaggaaatgatatcctcctttccatacctgtagctcctgctacggctcctgctgtagctcctaccacggctcctcccacgacgaggggatggggatcttgagtagcttcttccacgcctattatcatcaagatacaatacatttaaaaccttatattcaacaattatgcttataaaaaggaaatctcacaggaactacttgagattcttagggctgttccggcagtccctttctatatggcccctgtctccacaccgatagcatctgtttttccagtctccagctttgcagtcacgggcccagtgcccatcaatcccacagttaaagcagcggccagaaccaggtggtggtcctctgcccatatattcacgtgatcctccagggccacgtggaacctaaaattggcatgaatagcatatttagattgagtaaaattataaagtaggatcatcaaagcatataaacaagatagagacataaaatacatacaatattctgggaataataaaaataaatatgattacccctttagcaaactcaacaatcatgcggcttccatcaaagtcccgaccatccaggttgtaccttgcctcatcagcatcccgagcatcactaaattcctattatccagcaaacaagaggtggcctcgtgtaaacattgtaaatgaagtgtactgataactgattaaataaatattatcggaaacataaggcaagtgttttacttacaacaaatgcaaactcgtgcttcatatccacatatcgcactctgcggaaattgtatcgacaaagagtaacaccatcaagatgcaagtagataaatgtttcaccagtcagaaggaactaaacgccagtcaatgtttgcaatttccattaaaacatcaagataatttatcaaaagaattgccaaagtctgctagaaactttagagggacagccaccaattccacgaagggcaccctcccaccatggacaccgaggttgggaaagcccccaaaaccttcaacaagatcatccgagttaaaacatgaaggtctcgtggatatgtgatggtaagaaaaatatcagagaaagaatgctctgaacagaacagcatgctgctggcctagacctcttgctttgaaaggcatagcatcaagaaaccgtcgggatgactacacaaaaagaatgaagagttgcctctaattatctgtggccaatattattcttaacacagggtgcaagtaaaaacgcgtcgatatgaatactctatagactagactgaacttgtcacttagaacctaaaaaggtctgtcatcggttctataggtaataactttgtattaacttatcacatgcccaaatcaacaaatgaggttagagtgagatactttcaccgaaccaatctagaatctacaaagcaagttacgcttgtcggtagtatcttttgactcaaatgaacaactcagaaattctgccttgaaagactggagtacaacttagacccaatttgcaacatgcttacctcccatatctgccgaaaaggtcttcaaggtcccgggtccgggtgcgcgaggaaagacgacctacgtacagcctcgtgttgccgccgtaacggtcatcgtagcgatcacggtcatcatagcgaggcatcttgaactgtaacacaacagaatagcaaacaagagtgagctagcggatctaacgtaaggcatagggttttcagctgaatccccaaatcttgctggaaacgaattgctactagtactaaggtttaggggttaaagggcaagtaagaaaagcttccggatctacaagagaagctagggttaaggcgaagagaaaagctgtgggtagagaggaacgagaaagaggataagcgtacgtgtgctcaccggcgagggtccgacgggagaagcagcacaccggcgacggcgccgctgctcgcgggtggagatcgcctctgctcggcggcggcggcggcggcggcggccgaggagacgaggagtcgagaccgaagcgacggggagatcgactagggtaaagataggggagcaaggagaccgaggtcaattaattacgctgggctgttggctatatatgggctttctatgggccgagatttctaatcacagtagtactcgttccggactagtcatattgatttggaggcccatctaagacgaaaggcccattagcaattactctgctactgttgaatttttttcgtttttagatttttttttaatatttacagaaataatctatcgaccaaaaaaattgcagaaatagcccctgccgcccaattggtgggcggcaagctgacgtggcagacggtgggtcgaccgcgctgtctgccgccgtcggccaaaattgcgattaggcccgagggcgacaaggggctaattgcaattttggccgcccattca

SEQ ID NO: 68953 - DNA, 2006 bp, Oryza sativa
ccgtgtgaaagttgaaatagcacaatgtcaaccgtagcagcaatgaaatatgaaaacataacttccactagaaacacatccagtaaaaaattaggcttcagaatttgcggtaccaaacaaccaagtcaacaatatataaaaagtttgagaatcctgcaacgcacgatctatcttcttagacaaaagcatcatccaacaaaactgcctatcaagaccgacatcattgaaacgctcataagataagcaaaatgcatatttgctgtgctgatgtacatggaatttatctcttcttggagacaccgacagtctttcccctcctgccagtagtcttggtgtgctgaccacggacacggagaccccagtagtgacggagaccacggtggttcctgaattacaaaaggtagttcaaatgaaatcaaagagcaatttgttcaactctgagaatgcaattaattagcccaaagaagttagcagtccaaagcctcgacacaaaaaagaatatgatttaaactgagttcactccactagattcatcataatacaaatgaattatttaaactgtgtgaataaccgaaggcatgaacagttcatatttaggtagaaatttcatcagaacacaaattaaccaacaatgaattattcccaaattcccatgaccagttgttgatgccataaacatctcattgaaacagaacaaatttagctaaaatttctatcaatccaacaaaagcatgaaaggtatatgtacagcacctcacacatgcaagttacaaagctacaaaaatgtggtaagcgagcagaaccaaacctgatcttcttcagcctctcaaggtcatccctgagcttcatgtccagggcgttagaaacaacctgggagaacctcccatccttgtagtccttcttcctgttcagaaaccagtcagggaccttgaactggcgagggtttgccaccacagtcatgaggcgctcaagctcctcaggagtgagttcaccagccctacagagaaacataattgttagctttctcactagtaaaataaaagtcctttggttttgcacaaaatcatcaccatcttatgttttggttacaaagtcatctcggattaactaagcataagcaaagtacagtatggcgtatcagattagccaaactgcatgaaacaactaataccaaataaaatatagctgtgataattataacacatttttatctaattaagcccttcaggttccaaatgagcataaaaaatagactgatcatcttggtagcccaaaattaatgacgtcccagaaaagatcaactaatcatatagactgctaagtagtgacgggcaactccagggtcctggcctagtaagccaaatagaacataaattcaactgaactgaaactagttgcaacacactgacacctcgtgacattacggcagaaataaagacagtattaggcaattaactggagccaaaagatcagccctgccatcaacatcatcgccaattgataaacacatcaaaattagcaggcgttcgaatcccgagtcaagttggaaaaaaaaatacatccataacttacaattacaaaggtcatgctattaaataaattctaaaagctccaagcaatcttaactcagtttgcagacagtcaataatcagctttgcagcatagtaacgcgcagaaaatttctcatattatcacttaatccaccacaaagaaattaaggcaccagtcagtaaaccctactcgtcctaatcactaccaaacaaaataactcagtacaagatccatccacctaacatcacagtagaactaacgaaacaaccacacaactttggattcaacgtgtacaactacaaaccgaaagatgctcaaattatctagttttccctgattgtaagaaattagcccgataacaccaataaccattcgttatacctacacatcattccagaacatcaccaacagcacaaacgaacacccagatcagaggaggggttgggggggggggg

SEQ ID NO: 68954 - DNA, 2401 bp, Oryza sativa
cgttttctcatgggggcggcagtgtcacaccggtgggtgtcaccggatgatgtatatgtggcggcaccactggtgacagaggaagcagaggacctggatgactcagcgaaggcggggtgaacgaaggcgtcttcgttgggtggaaacgtatttatgtaatcatagtgcgtgtgtgtgttcagtgcctgtcatgtgggcctggatgagagggtttaaattatgaggagtcgagttgtaaactgtcgattatctaagaacaaaaacagaggagacaaagtgacaaactatccccaattctctctcgcgttcacaccatccggcggctcgcggcggccgaatcctcgacgccggcgagcggggtgttacatactccctcccactccaacgaccaacatcagcaagcagcagcagctcgatcgatcgaccgccatgagcgtggtgatcctggacctggacgagtcgacggtgcgcggcttcgtggcggacgacgacgccttcggccgcagcgtcgacgcgcgcttcgaggcgctggacgccaacggtgacggggtgttgtccctcgcgggagagggatgggacgacgcggtcgaaccgcagtcatcgtgcgccccctcttcctccttgcacggagtataatgcaccaatatggcgatgccaaccactttaattattcagtcttctgccatgattcaagaacagattcagaaatgaattcacaatctgaattttaattaattcaatcttctgcatggtccaagactccaattacagagactctcggaagtttttttttttaagactggtcaccgggggagcttccccacctgaattttcattaaaatattggaacagtacagcagcttaagttacattagagtgaggggaggatgataaaatgagtttccaagactctacaacagccctgtcagcgtggctcaatctttctgcccacagggctgcatcttctttacattttgcgataaggttatcaattgaaggtgatgcacccctagaaactacatcataccgatggttctagagtccccaaagacaaaggaagaagaaaactttgaagtgttttgcaggcagaagacctgttgggcgcagagactctcggaagtgaatcacaatctcgatgaagataaacaaaaacccaacacttttacacctctaattacattttgatagggaacgtactaacaaacctgaagtttgatttcttcagtacttcacacattgtcctcagcgggctcaggattaacctgaacctgaccgcggctacggcagatccggcaaaaacaggcgcacacgatgtcaggctcgctccaccaccatatataccccaatataatgagcgtagctatcatgagtattggcgcgaacacaagagctgacaatcccgtagccatctgaataaatgggatctctagtatcatgatagctataattagggaaactctcgctgcaactttcgccaggaaatgcagtttaggacggtctgacatggtagtggttgcaaccgaacctgctgctaggaaaatcaccacacacacggtgaaaagggcgaagagagtcctggcgaccggtggccagccgttggtgatgactttggtgagtgccgcaagcacgaagaagatgccgcctgaagtggtgaacagaaacacttcccggctaaaagatccctgaattgatcaattgacatttccaatttgattagtgacacagtagagatgaatcatacacgtgtatgatgctatgaaaaaaaatagtaagccattttttccccaaaatcgccagcacaatgagcgaatgactgaacagagtccctttttttttcccagaatgaatcattctgttcaaaaggataagaagctggcgaacctctgttggcggctgtgttgcagcggctggagcagattgtggaagggacgctgtagcagatgaagcagatgaggcaacttccccggagggacctccatggcccaggtcgcactggaggcgtgcgatgtgcggactgcggaggtgaggaggagagcaccggaagtccggaaccgtcgggggttaaggtgcggagaacgacggtcggctcgccgacggacggagcgagtatataggaaaatgaaataggatctgggaggaacatacgggagcacggcatactcatataggctctgcatccatccccgattcgaatccattcatatagaatgcttgtacgtaagagcaggttccagggtggaactgctgcacctactgagaatctgagggagaatatagattccatacaaatggtatacattatccaaactttgcttttctgtggccatttgaacaatcaccaactcagcatgcgtggaagaagtgctaccgcttatctcttttttttctctcctatataatg

SEQ ID NO: 68955 - DNA, 10580 bp, Oryza sativa
ttatgggcaagccgagcaatgtacccaagttagtgttttaattcttaaaacctgcttaacaactaaaatgtggaatggttggcctgggttggcttgggacgagctgggacccagggttgggttgccagttcggtctgaatcatcgtaggccttgggttaaggcaggttcgtgtgggttcacggccttgataaataatattgtttagttctagaatcgtgtttacaaaatagctttgagcaactaaatatctttaaatgctgtttactgccaccctaacccctttatagtgtaactcctttgtactcccttgcatttattctgcacttgtggatgtgtcttgttgagtacggtggttgtactcagtcttgctcaatttttcccaaccccagaagaggagttgcaggaggatgaaggcttcggtgtctagctcgtgcctgccgtcaagcgcctgtggtcatcgccctagtcttccgctatttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttggcttatttccggtcgtgacatatttgcttatcatcctaacaaaattaaactgaccagactgataactcttccaatcggcagctcccccactcgtgtgaaccatgttgacagtaaacggattaccatcaatcttcatcggcttctttggatcatcaaactttatccttccttgttcaatagccgattaaatctgttgtctgaaatgcaatcattagtgaaatgagatcctgtgttatgccacttgcaatatttcctcttccccaattcattagccgatgggattacatgaccagcgggaagttgaatatgtttttctcaaagcaacaaatcaaaaatcctatcagctttagtaatgtcaaaatcaaacttcacttcccttccagaattcctaacccattgacaagtaacaatcttcttgttcctagcccactcagttgcagctacttcgggatcatcttcatcagactcagaagcatattgatcaacattattgatcttttcttatgccttcctagcctcatggaatctttgcttatgtgctgatactttttgggctagatgagctatactctcgaaggcttgaactaaaaatatctctttaattggtgtcaataagccttggaaagtaagattggctaactgagaatctgtcaaagccaagatacagcatccattcctcatatccctaaatcattgaatataatctaggacagactcctttggcttctgcctgattgctgtcaaatcagacaacttcatctcatgcactccactgtagaaatacttgtgaaattgcttctctagatctgcccaactttgtatagaattatttggcaaagatgaaaaccatgtaaatgttgatccagacaaaatcaaaggaaacaacctaacttttaacgcatcattagccgatgcttctccacactgaacggagaatcggctaacatgctcataagtggacacattgtcttgtcctgagaattttgaaaaatctggaaccttgtatcggtttggcaatggaaccctttcaaagtactctgggtacggatgccaatacaaattaccaccgtccttgggcttaagaccaaattgttccctcatcacattggctatcatatcaacccaaggttgctgtcgaggtgtccctcccaattgctgctgcatctgatgtaactgattgtattgaggcaggtattggggttgaggtgatcctcttggccgatattgtacctaaggtgaataaggatgtttacattacctcccatatgatgttggggagattgatgtgccaaatggatggattgttcagggatgaactaagtaccaggagcctaagacatccccatctactgctgctgtggaataaatgatggttgccctataggaatttgctgaatcggctcaaccactggctgctttgtcttgaacaatgcagcaacttgttctagagaaagatgaggtatattgtgccccccatgctgaggctgttgcctgaacaaaacgttaggaagaaactctggctggccatgatccgatgttgatgcccccaactttcctagagccgatgccgatgcaacttgttgtttcgggatcactcctgatatatacaggctactgtttgccaccaatcttagtattgagggttctgtattgtggaaaattgccttcaggaaggaatactggccccttaacttggtgctcagctatcgtaccatcaaccacagtcttgatcatattggttaaggtgttgacaagcactcccgactggttgatcaatccgtgataaatagctgaatcaatgcgatcttgcaaagtatggaactcctcagtacttcatttagctttctcatctttacccattatatccttaggagagcttgccccttcatcatcgaacggtaacgtgaccttgtgtctttggattaccgtaccgtgccgagtcaatgtgaacgaatgtagatactgattttgcaactgattcatcatctgttccagagtcgccttctgctcctctgtcagtttatctagcatcaccgggatgatgttttcatcatcgatatcatgttttttatcaaccatgatgaagaactaccaaaggttgtcccactaggcgtgccaaaagcgtgttgatgcaaaaaacacgcactggcctgagagatttgctttactctagtgcaggtcctaaatttgcttttgggttcagagcgtgccagttggtttgatcctgcaatcaacaagaaacaaagaaaccaaacttaaatccatcaacgataaccgatcatctggattgctgatgacatatcgtctgagagcaagccgatgcggtatatttcggatcagcagtgatatatatagtaaacaaagggctaaatttactttatcggctttagataataacaatatataatctatacttcgaaatgtgtttaaaccaagcgattgggatagatcggatggctgccgagacagtataaatcacttaagtttaaaagtacttcaaaggaaagattatttatgttcattgcatagctgataggtaaatctagtgtgtatcggctattgctccaatacatctttatactaagatatcattatagattaaatatattaaacaagtgtcggtctactattaggaagacccaagtagattgagatcaagcttaatatgtttagtcttagcgagatcttaatataaatggcagatttagcatgtcaagtaaataaataaagaacaagataactaaaccaggtaagatcggctgaaactccgatactatctctattagcaatcatgaagcaagctagagattatggttctaaatattacttattagatcaaacttaattgatgtagcattaagcatagagagaaacataagatctagtaaacaagccaatgaaaactttttcgagatggtggatatactatatgatctaaaccaatgatattacctgattctatcggctgatttcgatgatagagacgagccgacaagaccagatagtaaaatcaatctagattatattgcatttatgataactcgacgattcacataaacaagattagagtgtcataaagatgtgagcactaatcccgagaacgcaagccgcaataacaagttttacctctcgccggagatcgaaaacgatgcagcccaactagagaacaagaactcgtcgaaacaatgaaagtagaaaaaggtcgcgatgcgccgaaagtgtattgaactgatgtcacgtcctgataaattcgtcccgaaattaaaaatcattcgctaaaaggaataatagaattaattaaaattcggaaagaaattggcaaacactaaaatacgtacaagaaaaattcaaatgtggcccggagaatttttgttaaattcgccttggtctaaaaggagccctcaaattttacttgaattttcagagcaccggaaataattattaagcaacaaaaacaattaacaaagtttattaaaaataaaaacctaaaaataaccctccttcctcctttgggccaagtctggcccaaagtcctccctctctcccctcggcccgcggccgaagtctccctttcctccctctctttctctccctctccttctctccctcctcttgggcccccttcccctcggcccagctccctcctccctctctctcccgggctgtctctcccccccccccggcctgccggcccaagccgcctccccctcctctcctcctgggccggccgcccggcccaacccgagcggcgccctcccgcccgtgccgcgcacgtgcgcgcgcgtgcgcgccgttgccgcgcgctgaccgcgcgcccgaccgcgtggggcccacgcgtcaggcgcgtcgtctccctcctccagccgcccggccacctctctctctctctcccggaaacctagctcgctccctcctccaaatccgcttgattcaattggccaattccaaaattaattggggggttttaatccccattgaatcgtcttcaattgcccccaaattcccccttgattcgtgccttcaatccccgggaacggacgcgccaagtccggtcgctttccatggccgtcggccgccattcccgccgccgttccgacctcccccgtggccggctccctcttctctcatataaaatgggatcctcatcccccgttctctcgttttagccccctcccgagcctccccgtggtccctagccatctccccgccgccctcctctctctcccacgccgccggccgcctccagccgcctgtgccgcctcgaccgtgcgccggccggccgcgccgtcgcctcctccagcgtcgccgccacctcctccaccccggcctgccctccgtttcgcgcggtgaccgccggaggcgcgttcccgccgtcgcccttctctttcctccgcgccggccgcctccagccgcctctccctcctcgccggagcaccgtccggccgcgccgtcttctccctcggcctcgcagccacctcctctccctcggtcagccctccgtttcgcggggaaagcaccggagacgcgtcctcgccggcaaaacagtggcgttgccgccactggtccacctccgggcgccactgtcgcgtttcccgtgcgccggccgacgtcgccaccacctccctcggctccgcgacgccgccctccaccccggctggtcctcggtttcgccggaacgccgtcgccgcgccggcctctccatcctcttcgtcgccggcgtcctttcggccacccattcctcctcgtcggctcgtcgccccgctaaaccaccaccttctccaacatcgcagcagcgcgttccacgccgtcccctcctccgctcagccgctgctgcctgccatcatcgtttcctcgtcaccgttcgtcctcgccgatcgacgtcccgtcggtcgcctggctcgtcgtctcgcggcgccgcctccgtcatcatcatcgctgcggcgtgttccacgccgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcattcgtcaagcgagccgctgcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttctcggccccggtacccgtgtaccggtgtcggtagtcgttcacgcgtgcgggtggtgaccgtgtagtgtccgtgttagtgtgcccgctcggtagccgcgtggtttccacgtgtgcaggccgtgtggtgtttagtggagtccgtttgtcggccactcgcctcggttgacacacggggtctgcttccgtcgacccgaggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttcttttttatgtgttgttattgcttctttataggcttgtagctttgcttgtgtgctccgcgtagctttcgtcgttccggaggttcgcgaagcgtggtttgcggtcgttgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctagaataaacaaaaccccaactagtggacactctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctagaacaaatgaaggctacacgagctgcggcccggtagtcgagatgtcatggcacagggttggtgccctgctgctgggggctcagtcctgcctgcctgtcccggaggttccggccgtaggtgggattgggtcggtactcttgtctatggctaggatgggttggaaactatgtcacgtcttctgtctgtataccgtggtggtatgtggcacgtggttgcacgtgaggaagatgtgtcttgtgggtaaagatgtacacctctgatcagagtataatctattcgaatagccgcgccatcggttatgggcaagccgagcaatgtacccaagtcagtgttttaattcttaaaatttgctcaacaactaaaaggtggaatggttggcctaggttggcttgggacgagctgggacccagggtcgggttgccagttcggtctgaatcatcgtaggccttgggttaaggcaggttcgtgtgggctcacggccttgattaataatactgtgtagctctaggatcgtctttgtaaaatggctttgggcaactaagtgacttttaaatgctgtttactgcaaaacttaacccctatattattatccccttgtactcccttgcattaatcatgcatctgccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgaatgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaactgatgttaattgtttacaaagactcgggcatatatttatacccaaaatacatgatatgtccatatcggacacgactcgatttgtattacaactctaaaagacgaacaagtcccttaggcgaactcttaccaaaaatatatataaggaaactattaaaatatcctaattaatatagacatttgccttcttctaacgtgatccatgcctggcaatacttttgcaacatttatattgagtccgacaatgactctaagcccctttgtcgaaatcagctgcatcggcttctccttatccgatttggtactagccgatgcagagtgcagccgatgcacactctgttttcgggaataacgaactccctccaaacccgcttcggttttgactccaaattcaacctatgatttaccaaatttggtcgttaacaggtactccttttagagcttcccctcactctctacctactctactagagcaatgcctaagtatgaaagtgagttgtactccactttattgtgtgttgagagttaagtgagctcccccttttatagctccaaatgactacggttaaagtttgtaactgctgaggaaaccgccataaccgtcattggggaggcatgaggaagcgacatgtggaagatgggggggcgatcagtcgaaccaattttactgcctttctcccccattctcgcttgagtcactgtcctgtgggccctcataacggtgtatgggggttggcctcaaatatgtcggttttgctatggtttgtgggccctccaatccgagtactcgcatctgattgggcggaggtgtgtttcttcacatggcgggtggttttcatccataattcacctgcatacgaatatttaccaagacttgtggaaatagttagtaataaccactacccgtaagtttgatattctattttgtattctttcattttcttttatgcaggatttgacggtcagatttggtacttaaagaccatcaatatacccagaatacccataaaggaaatataagaaggaatgatttgccagtcgctctaacattttatcagcgaagggtagcgtgaagttgttcttcttcgtagccttattgagatttctatagtcaatacacatcctccatcccaagatatatgttatgggatcaacttgttcttcgagttttcaacaactgttgttcctcccttcttaggcactacctgaactgtactaacccactcactatatgacacaggatagattatcctggcgtgtaggagtttcaagacctctttttatttttacgacctctctcattgtattgtttagccttcattacggctcccgaggggacgcataagaaggatctaaagggatatggtgtgtgcaaagagccggactaatccctttaagatcttgaagagagtagcctagaacaaagcgatgcttttctagcacggccgtgagtcgagaggtctcatatcaatcaatttgtaacttatgatgatgggcgactccgtatcaccatgtagaaaagcatagcgaagaactgaaggaagtggtttgagttcaactggaggccgtaaagttggattggttttgggtaactctaccaactctgcaagattgtcatcttccttgacgagtgcattggcatcatcttcgaggagggattcaggggactcaaaaggggagaaaaccaacacttcctcactagtccctccaccacttgacgctcgtcggtgcaggaagaagatgggagaaagaaggaataaaacggaaaaaaaagagatggatggaaaacgtgacggctgtgacatgtttttaattttataaaattttactggcacagctatcaaatcagtaattaagagtggcataacacaaccagcaataaaatctaaactagactattacacctagccataaatatcaaccacaagaaggtccagtgtgatcaactatgaaattgcagtcaataggcaatacttcatctgtcccctaatataatggattttgatattttggttacgttgtttgaccattcgtcttattcaataaattttgaattattatttattttatttgtgacttattatccaatgtactttaagcacaatttttctttttttatatttaaaaaaaaatgaataagatgagtggtcaaacagtgcaaataaaatgtcaaaatcccttatattaagggagataagatagtagatgagtagtgacctttcagcttggtcgtcggagagactcaccatatgtccatttcaacataggttagtaaaatataagcgatcgatatatgaagtcctgaatgaaaggaagtgttcaaacctaaaccatcccaccatgcatattctttcagagttagtacgtacaaacaactgagcgaatagaaaatgaggttgaacaggatattcgaatgaacctgacttttagcagccaaatgaaataa

SEQ ID NO: 68956 - DNA, 3280 bp, Oryza sativa
tactcttgcaaatggtggttttgaggtgttcggttcacttgaatgggcattctgttcggcagccccatctagacctccaagttgagcctcaacctcttgtagcgccctgagccagtgccttagcacctgaagcctatcctccccgcgtgatgaaaccgcggcctcttccaagcgcttcaccattttcttgacacttttgtagttttgagtgctctgtaatcccaaaaagaacacgttacacaagacgagttaggaggcattttgacccaaaaagtcaagccaccatcagaaacatagcatttggtatctagaaaccacaagactacactctatttacattttacactgcaatagcatcaagctaatctaaagccccttttccttcataacagtacaagacactgtcttactaccgtgcagcagatcatggacatgagatcatcccaacactataagattgcttaaattcatacgaattgaactcgaattatatctaattcgaacacatgtccaagaacaaactcgcatttgactaacttcccacttccaattgcaagtttggcacctcctcaacacaaaacgagagagcacgtcccaggacaaaaatcgaaaggggctttctgagagaagggggcgagggagggaaacggcgggggggcgggggtagaagccgctcaccatccggtcgttgaggatcttcgcgccctcggcgacggcctggccggcgtggtgggcgacggcgtcggcgtagcccagcacggcgcgggcgaggccgctccggccgcccgcctcgacggccttgctcaccgcgctccgcagccacgacgacatcggcggcggtcggcggcgggatcaatcaccacaacaacggcggcggcggaggtaggtgggggtgggatgccgcggcgctgtctcgagtctcgactggactcctctcccgcgaccggggcttcttcaggggagttccaagttctccaacactgaaagtttctgaactgaagagatttcgtgtacttttcgctctctctctctcttcttcttcttcttcttcttttctttttccctttattccttttctctttttttttatctggtaataaaatatttttttcttgtttggattgggagagctatgcggttctgttgtctgttctgaaatctgaatggacatgaaaagggatgaaggtcatgtactcatgtgactgattggtgctcaactattaatcaattagtggatcgttagatttgtcttgtactcgttatttagccattactctttcgagaactttttgtggactataaaacaacaaaataattgcagctaacatttttatctatatttcctggtcatacttatgcatcctatatggaactaaacatttggaattgtttgttgtggaaaagttatctccccaacaaacaatggattcatttatcccggcactaactttggagtaagactagtcaagcctcacattaggctatttgggttagattactcccactcttcagcgctcctttttgaaacacatggttttaaaaaacgcaagaataaaaaaaaacgcataattgaaataaggcacatgaattaaaaaggtgatgtgtctagatatctcaaaggaaaatatcacatgaatttgatagctttctagagagatgatgggaaaatatgcgttgtggaactggactaagggaaagcaatccaaaggaatttatcaacttctaatcctatgttccaaacaatcaagttagaaaatatttctatggatttaaatcctttaaaatcgtatgaaaatgctttaatttaaaggatttattagcccgcgtatctaacataacatttccaaatgaggcatttttcatggtagcccagcttggcccaaatcctctcaagtctaagctgctttctttcttagtaatttatattttctatatagttgatatccattagcaattacttcctccgtttcacaatgtaagtcattataacatttcccacattcatattgatgctaatgaatctagacatatatatatatatatatatatatatatctaaattcattaacatcagtatgaatgtgggaaatgctagaatgacttatattgtgaaacggatggagtatttttttcgagtaagagatacccattagtaattattaaaaactaaacttatcatacaagtatgtcacatcatcgttcactagcaattattatcttagaccattttaaatctcatgcaaatgtgacacatcatctagaatatattatattatagagctcaatatataagtacatatactatttctataatatttaatatatactcatacataaatcccgagcacagtgcaaagtatcacctactagtaaatggttcaaaccactttctaaaaattgttctttttcaatcaatcaaaaaggaaatgcagaggtcgacaagacaactttgcaccccattttcggctgtgtttagttcacgtcaaaattggaggtttggttgaaattgaaacgatgtgacggaaaaattggaagtttgtgcgtgtagaaaagttttgatgtgatggaaaagctagaagtttgaaaaaaaactttgaaactaaacaccgccttccattgacttcaacggattcctcattcctgtgaccagacacttgcttcctattgtatcactgtagttgcatgctaagatccaaatgccacatacttcttttacacaacggggtgagacggtcttcctttccactcccaagaacacgcaaaattgcaaaaatattttctgatataataccagcaactcgctaaacatacaggcgagtgggccgacgaggcattcagttcggtcgcatctgacagcgattttcgcgtccatggcagccgtggaaaacgaaggtctttctctgaacattgtcgtgttgctcctgtaatctgttgctcaggatacgcatgccgaattgccagccatgtgtagatgaccgcactgctgctccaagaaaaatctctgaagtttgtagtatcttgcaataataacacggcatcagtttctgagtgtatcttgtcagtattaattccagtcagccatgaattcccttttgttttcagagtacaggacactgactgcatttcttttcataccctcgagaggaaaaggccaccatgcttccgatttctaacacaaaagtctcaagaaaaaacgagtcttgagagaaaacgagttgtagcacaaggttttctccctttcttctccttgtgtttgtgtgtgagcttctcaaaacacgtg

SEQ ID NO: 68957 - DNA, 3887 bp, Oryza sativa
tgcattcatttttctttccctaagacgtactctcaatattcatcacgcataaaccaaaatgaaaaggggaggtgactatcagaaatatagaaagggagcgtgcaccaacaccatctctgacctgatactcagagaaagtgtcggtgtagaactgtgcaattccctcctgttcatacttcctgtaatatacagtataactttgcacaaagatgcattcagagcgcgtgaactagctagactctgatgcttctcatctgatacatcattgagtaattacaaatattgctgaccaaatgccataatgacacatagatcatgacaccttactactaaagttgaaaagatggttggccttgctctagagttccttggcagattctgcacaacttgaagaactatccccaaaaaactatgtatttgcacagtaacagtgcattattctgagacgtgctgattctaccagggaactctggaccagatgcatgtactcacttgattagaaaggaggcttgttcttcttggagccatgtttggccttgaccatctggttcagggcctgcacgcaccggcggatcactcccatcgacttctttcccccatcaggtcgctttatcaccatagccaacgtcgcgctggaggcagccggaggtggagggagtttacgatcagcaatggctttcttgccgtttccgagcttgctggtggccttggcttctccgatgaggagctgcttctcttgtatcagatcctgaagggagaaccggggcacatcgttggcacaaggcggcgtgatcagcttcgtcttcgcagttttgcattgccccggggccttccgctccgtgtcttggcattggtgttgtgccttgagtgacttgtgctcttcatcttgatacttctctaatgcattctcttcttcttcttcttcttcttctttgcattgtttagctattttctgctcctcatcttggtattgccctggagtattctcctcatctttgcattgatttggcaccttcttgtcctcatattggcattgctgcactgtcttctgatcctcatcaagatattgctttggtgttttcctctctccgtcttgatcctggaatggtttcttctcctgctcttcatctagataatggtgaggtttctcctcctgctcatcatggtatcgattcggtgtctcctgttcatcaccttcgctttgcagctcctgatcttcatatggatatggtggctgaagctccataccttggcgctggaacaatgtcttcagcttgtcatcttgacgtagctgctgcaccagggacggcgcatgttgatcttgataacaaacgatgagacttgttgatcttcgtgttcgcctcgacatgccaggatcgaagcggcgggatttgttcacaccacactctgtggccattgtcagtggtttggggagaaagatcaccggaatgagcaacttgcttcttctcaggggtggagttgttataggttgcctgatgtgatcagtagatgcatagtacatactgggaataggtgatctggtaaaatgtccttttcagaggtaaagtctggtttggtcatttggaagatcagtgcctgtcctagtagcctttaatccctacaagaagtgaaattaaagttagtattagcaaacaagtgatcaatattctgccacaagcccacagacatctataatatttgttctgaaataataaggttctagtacatcaaaattgtattttgcaagatgacagtatatatgaatcacgcagcataaggaatgctaggaagaaggggaaaagttctgaaataaagaaaattgctgtgtatttgaagctattcccaactacctaagagcggaggaccagcaatatttggtttcaagcaaaagatttgactgagtactgacacatcttcacttgctttgactggagtcgttaacctaaattatttgtttgaacaaattacactgacacctcgcgataggaggtaatgcccagttccaataaatagcatttaagaaacttactcataaattggaagaattggttctgaagaaatactgagggcagctttcataagtacaataccatcataataattgtctaatatagaatgcacaggctacatattatgtcacagctcaacctaaaaaaagtattggtcctttcccaacattttacatctcagggcacgccaaagatattcatttacagagtcagtgatcttgcttagatgcagatagaactgcctatcttgcaaaccccatcgtccactccacggctattttatcgtgcttatttctatcagtcaactataaacgtccaatgcttggcacaagaggaagttttcaagttgaaatgaagcaacaattatgtgtatattacaactagcttgaacaggactacatgttaagtaataaaagatagttcagaaacataactatcctgataatatgctgaaacttggaacatacatggatccgggtttgcgatgattgctttagtggcaagtagcacctttgaaatagtaaaagcaggactccagccttcccttaaaatgcccatactcaagttaccagtggagtcaacattgcagtagtaaatccttgtcttgaaagttacctacagtagtgatagaacagttataatcacaggttgaggtcctctaatgctaaaatatcaaataaaattacagcagggggatctcaattgttccatgcttctattatatatactgtattgaaattccaactcccttcaatattgagaagttaatacgttcaactagaagagtaaagtattttaaatattttttttaattattgaaacgtcaaatatgaagccacaattatcagcttacagtgtttttcttattataattgtgctatcaactgtctacaaaacatgagaaaattcacttgctattgccaaattatttggagggttatagtactatcagcatcaatatgtttgccatgttgaaaaaaatcagatagtttgcccccgcgtcgccccccgcgtcgggcgactcgggcggcggaaccctagccgccgccgccgcccttccccaccccttcctctgccttgccgccgcctgagcgagcggccggcaaagccggcggctcgcgaggacggcggcggcggggctcgcggcggccatctcccgagctcctggcgcgggtggacgcaaaggcggtggccgaccggagcggcgccggcgtcaaggctcatggcggcggatccggcatcgccaccaccagatctggcgcgctcgcagctggatccggtcgcggaggcgtgggcacggcgtcggcgaggcgtgggcgctggcggccgcgacaggcggtggcaggcgcaacggcggcgtcaggcgcgacggtggagcaggcgcgggcggccgcggcaggctcggaggcgcggctgctgtggccggcggctcgatgcttggcggcgacggcagcggtgcccccagatccgcgcctctcggccggatctggaggatgggagcagtcggcgacggcggcggtggcagttggtgacggcggtctcggccggatctggacgccggcggcagttggcgacgacggcgacggtgtggtgacggcggtggcggcggcactgggccagcggcagttggcgacggcggtggcggctgtggtggctgccgtgtcatctggcaacggcggcggaagacatggcgtcgggctactagctgtacggtggtggagggcgacggcgcaacagcgatttgcagaggcggtggttggcgtcggtggcagcggcgacggcggctgtgattctggaggcggtggcgacgtcggcggcggggaaggagtcgggggcgaggtggctgggtgttcgggagccaaggctgtggtggtggtg

SEQ ID NO: 68958 - DNA, 1852 bp, Oryza sativa
gtatgcgtggtgatttcggcaccttcgatcgaaggccttcgtaacatgcctccaaccgttattatgcatgatttgcttttcgttaattgagcttatattacactatgtgattccaatggcaagtctactgagtaattaatatagttaagttatttatgacagctatacaatagagttaaaataaagtttagggacaaatgtgatatctaattagtaagagtaagtctttaatataacgatctaaatagtaaatagtaagtactacctttgtttcacgttacaagacattttgagtttgaatacatgcatctatgcatgtgcttcatatataagtcaaaacttatatgaatgtcagtgaatttaaatgatggatagaaaggataaaacatatatattataacgtggaatggatggattgctctttatattacatgtttatgaaattgagtgaatttcttatatataccactgaaatttgatctgatccctttatatgtcacacaaaattgactatgaattattggttacttatctattactattcaggagatcaagagacatgtcgaaattcaagattaagcgaaaaagttttaggctttgctaccgtgaccaatatggtacgaccggtgcctgtgatgaatctttcttgctcagaatgacaccattgcacaaggaactatctttgcgcacagaagcgatatatgtttcagctttctacgaaatgttgaaggcaaacggtatgcaccagtgggtggtttttcatgagcataaaaacaccatcaagaaatcactcgataatttaaaacatgcgcttcgtagatataaaaagcaatcgaataaaattggggctattctacttggtgccaaggaaagacggcaagtttggattcatcgtccgtagtcctctactcgataagcccattgaatatcatggaaagagaagaataaagctccaattcaagaagagaagtataagcccgtcaatcacttcagcaaatgtaccagcagcgaatattttcactattgcttgctctttctttagtagtcacttggaggatgcaagtgaggttaaggacattgctaatatacacttgtactcttattttatgttttgttataatacttctataactgtgcataattaaattcatgtggcaatgtattcaagaatgtctatacactatgcatctcttctaattttatattgaaaaaagtggttgtaaacgtgcccaatcagctatggccgtcggccttcatcaggatttttttttcttgtacccgttgaatgaaacaatatttaaatatcaagcttaaatctttttatatgcacattcaaatgtgacgtactgaaatattttctgtacacgttacataaaaccatgacaataacaaacaaatagggaattccttgttaacttgggtgcattcatacagtaacacaatatcaatgaacacaatagaaagttctatacattcaactatacaactgcgggtagagccagaacacggcgaagtgggtaacatgcagtcattattttttattgcgatttggagatgtcagctctcagctcctcttcaagttcgtcaaactcccacccacttatctcttcaggtgagtatttgttaacttgaccaaattctaattctaactttgcaagttcagaatcaagatccagcggctggtcaggtttcgctggagattttggggagaccacagtttcagctttaggtgtagaaggtacctgaactggtgaagggcttgactcagctctctcctttgttggaacctttgctcggcggacttcaatgtctaacgtcggtcgttctacagactcgaatctctctctaagtt

SEQ ID NO: 68959 - DNA, 2671 bp, Oryza sativa
ccggtggccagcaggggagaagaacggcggcggtgctcggtgttgaagacgggctgaggtcggggagaccggaggccgccgcctccgccatgctccccctgtgctcccgccgccgccaccctccccttctcccgcgtcgccggctgccggacatcctctccagccatgccccggtgaccgtctccccacccgccggccggctgcccatggaggtgaaaagtgagagagaaagggggaagggagaggaggggaaagagagagagagaggggtgtgacgtggcagcctgacatgtggagcccacgtgggtcccacgctgactcagccgccacatcagacaaaatcgggatcaaaaccaccgaaggacctaaagtgaacggttttgtaagttgaaggatgtcaaatacccggttttgcggtttggagacgatttcgtaactcaatgacaagtcgagggaccttcggtgtacttttcccttcagagtatagtactcgacatactgcggacatctgctcctgcttccaatcgttcgctctatatgaaatcagtcgtagccaaaatttaattttaaagattttttattgaagtttatttttcagtattaactgttaaatcgctaagaacatgtatataaaagttttactcaaaaatattattttaaaatatgtcgtacagtttattatcagcatatcccaaccaacgggggccagcagggttgttgatggtgatagattgatttgttcttgtgagattgatcaaacggattccatcttatggatggagatgtttttgtgattgctcaccatattattttctctgaattgtaatgaggaaattaatggcattcatagaggactagctagtctgatttgagcatgcagtcaagagatagttggtgaccaaaccatctcaataaatctatatgtaattctaggttaagtgaactgtttatatttagttgagaggaggtacaagttcagttagcaagtgtgactaaaatatgacttttcatgtcccagaatcttagtgacgaaaggctctatactgacttgagttttttttagtcgaagcacaacagattatgccatttttttgtgcttatattctggttaattaggtaggtgagtagtatcttgcatatagttagattagtctggctggccaactccagccaaatgctacctgccaattcatagatttttaccagttggcttattaggttcatgcactatgttctatatatgcagcaggagaaaatgtaccagtgcaaggaaatagttttaattacttgcaagtgtttaattttatattcatacagacgtcatcagtgcaacggaattctaatagaaaaacagagtctctgttaataatgtgaaagtgagaaaaatttatggcctgactaattgtcgacagatttttttttttttacattttacaaggcaaaggaggtactgtttgtacataggtgtacccaacctttcacccccttcattttttacttaaaaaatgtaaattcataattaaaaaataatgggtgccaaaacactttgtagagtaaattatcaatgtatgtttcatgttcttattagaactatatgtttcatgttggtatgacacccaggatgaactgtgtgcattactgcacatagttaattagctatcactactatttgtgaatctagggaaacactcgaactgcttacgcgtatcagattatcaatcggattatccgtgctacgcttttaaaactactccctccgaggttaaaagatattttgattttgataatagtaatatttttaacccaatataaatttattataaaaatatatttaattattaatttattaaaactaatttggtaatataaatattgctatatttgtctataaatttagtcaaacttaactttgaccaaagtcaaaacatcttataacctgaaacggatggagtacaatttttatgaaaaaacattcattgtcagaaatgcatagacaacctttgtcaatcaatttctttcaactatttattttattatcccataaagcaatatatcatccatcaactattatccatttctttgtctaattcaaacgggccataggataagacacccataggtgaaacaaattgaactctcctcaatatgttctcataaataatatgacataatgaatacacaatcaagaccaattaagaaaaatacatcaagaaattcatggcacactcaacacacacacaatacaattaaaatagtgtaaaaaattcgcaacacaacaatgataaagccgattaaggacacgtggacacaaccaaatcgaacggcttaaattaacccatgcagaaattaatcaaacatggatcagtgcaaacgccactgaaacgacgacggtcgccatggacgccgccttgccgacgctcccgccggaagcactctgcccggtggtggtggtcgccgtcgtcggagtcgccttcgacccgccggttcccgccggagtctcgcttggcaccgccggtgccgccggtgtcgccggcgtcgccggagatggcatcgggacgccgacagctgcaagaacgacgacgacgtacggtcagtgatgatcacggctgcgattcgccggaagaatggaaggagatcgacttactgctgcactggctcgccgaaggggtct

SEQ ID NO: 68960 - DNA, 559 bp, Oryza sativa
acagatgtcggcttctacttctattgatgtcagcagctcgttctctctgtcttccccttgtctcttgattgtatgaactccggttgtcaagaccaggctctctgcttttgcttgacgaacgaccgcctaagcggttccaaagagagcgacttctatgcctccttcttgaacgctgctcgtggtcgtcttcatcatcagaccttctctccggcgccggaagggttctgcaggcttgaattgggtgagccatcgacctcatccgggtgacatcatcaggcactccatagtgccacatgaagacccgaccctgtcgagagaagaggtcctggacagtgtctatgtgaatgatgaccggataagtgaggcctttctttgtatcagttggagccggctgggatggctccaggtcaggaaaagggatctcagtagcccttgcttctctatctggccttgtgattgtgaactgggtggcctttgggatggtgctcaagtctaagctccaaatccaaagatcaaaagtacggttgaagttccggcgacgggagtattcttctatgta

SEQ ID NO: 68961 - DNA, 2760 bp, Oryza sativa
attcctgcaccccttatatagtgtggtgatggaatctagcttgtataagtctttgagagattggtgacctactctttcctactaacagctctgattagacatttattagactgatatttaactaactagctactaacttagtaatataatactgacattgcacaacttgatcagagcttgcatgaatatggtcaattaagatgtacacagatgatgatttttcctggtccagctgttcaattatgggaggattggtacttggtaggttagttgattgttttggcagataggcatgtacctgggatggcagataggcatcatatgtatgcttcccccttgtatatttctatatcaaatttgcatgtttcctctctgcaaataaaaaggggaactagtgatcggcctaaaagggaatatccttagaattcatagtttgaagataaaattttcggtatgaaagttgggagtattcatatggccaaatcaaagttcactgctattaggaagtgttgactagtccataatcgaagtttgaaattaatcagagctagagatcgttttcaggtgtaataatgtgtggattggtaggttttgttgattgttggcatccaccatgagatgtactaattttggctggccttctcccgtaagatgtactcttttttttctgaatagttgaatagttttatgataactactcgaggtacgaacaattatatataactattacaaagttaaaagaatatactccttccgtttcaaaatgtttgacaccgttgactttttagtacgtgtttgaccattcgtcttattcaaaatatttaagtaattatttattattttcatatcatttgattcattgttaaatatactatcacgtacacatatagctttacatatttcacaaattttttttaataagacgaacggtcaaacatgtgctaaaaagttaatggtgtcaaatattttgaaacggagggagtatttaacttggatggcaagatgtaatatatcaccttgccgccgtctacttgacggcatgatctatttctataaatattttcgctggtaatatatttctgtaaatattaaaaaattaaaagttaaaaatgaaaaaaaaaaagtcgacatcaagtatatgcggcaaccataaaacacggccaaaaaggagggatgcaaaatagacttataaaaaacacaatgggctgccacctttgggccagcccggcctgaccgttgagcgggccgtgttggcccgaccgatctcgggccatgccgggccgggcggcccatttagccatctataccctcacaccgctcggtcaacctacgggatcccccgcgctgccggtggtccctgcgcggctgcgccaccgagcggaccaagcttatgctctgcaaggtgatgccggagccaccggagatccgtgctaccaagggaggaggaagtcccatctccgcgccgccgcggcgacctccacacccgccgacctccgtgttgttgagcctgcgctgccgtcggagaaagggcgatatcgtgctgtgaactcacggcgccgtaggtggtaggaggtccgacgacgagcgatgttggagcagacccaatggccagccgtgttgtaagcttgaggattactagtgttttgtacaccaaagattttaattcaatgatgaatgatcgtgaaccaggactgcggaatgacggttccgtaaattgggagtttgtgttcactggttgttttgtaaatgcataatgaaatgcctgactgagtgtatgagtgatattgctgaatgttcagcattcagttcaatcatatgctgcgccggtcccttcttgcggctgctgcgccggctgccgcaatccgcgttgccggagccatcccaggctcccagccaatcggacactggagtcccaattgcctattggaggagtcttgtatcttggagatgactccttcggtatcactggcaggggaaacggcaagcacatcctcatctacgacgacgttggttaacacctcccaggcctcaccaaaggtattccgtattccccatcctggtggctcctcctccctcatccgttccacaatcgacaaggtcagatttggtgcctcagtagtggagagaagacaagggtgctggccttgatgatttgatctgaatttttcattgatttgtctagttttgcagttgctaggatgtaatgcagtgttcttgtctcaaatctcaacttttcatgcttcatgctggactgtcatgaaggcgcagaggttttcttttttactgatttggtctgaatttatcctgttttctagctccaatttgtgttttcatcagactattttgatcaatttgaaattttcggaccttgccaagcaggccctgatgattatttttgaaatataacaatttcgtgtatctcttggagaattataccgctaaagcgaaattccaacctgaattcccctgttccaaaatagtctgtcccaaaagagcatcactgaactgtaaagtacatcaatggcgatgctaacagctttactggtgattcagaaatgaattacaatctcattgaaatggaaataaataaagaaacacgaatattaggtaatgacgtaaaattaaataattagaaggggtgatgcgtcgaacccagatcgtctagcgcaccaccttgtgtagttaaccggaaaagtgggaataaatcaaaacacaagtttcacatatgtaatgtaacatcgtacacctgtagtttgaaat

SEQ ID NO: 68962 - DNA, 3075 bp, Oryza sativa
  unsure (1)..(3075): unsure at all n locations
accgacgacgttatcccggacttggccgatcgggagtcccttgacgccctctgaaaaaccccacgtcgctgacgctgccgatgtcgtcgtgccgaagtcgccatcgccatcgcgtcggaatccgccgccgtcgtcgtcgcttgagcagggcggagaggcggcgggatccgcacgaggaggagaggctaccggatccgtccctcccgtcatcgccgccgacggatccgcgcgcatcggtggcggagagacggcgggatctgcgcgggagggggaaaggccgccggatccgcgcgtatggtgggcagcctgcttggagatggcgacggccttatggcgcagaagcccgacgaggttgaggcagagcagcgtggtggaggacgggatgcgctgtggcgtcgcgccgtggttgcggtggtgcagcgtggaggacgggagcacgcggcgtgatacggaggctgcggctgtggcggcggggaggcgaggagcgctgtgcaatctggactgagattagggtttcttatgcgcatacaaaatgggccaccgttggtgtttagtttcttacatgggctttgaccatgttggaatgagtccattaaggtccctcaactatagccacagtttaactagcgtccttataaaatactccctccgttttttaatagatgacgccgttgatttttttttcacatgtttgaccattcgtcttatttaaaaaatttacataattataatttattttgttatgagttattttatcactcatagtactttaagtgtgatttgtaanttatacatttgtataaaatttttgaataagacgaatgatcaaacatgtgagaaaaagtcaacgacgtcatctattaaaaaacggagggagtatatacaatgcaactagtatagcagcaagcgcgctcaacacaaacttttaaaacaaatgttcatactaaagttatctataaattatataggcttgtatatacctcatttgttgttagacttgcccagttttatgaaaatttttgaatccgccactgcttggcattcagtccgagcgtgtaaggaacctcttgtttaagggtggtgacagtgtcatccttaacaaaacgagaggtgtagttattaggattttgctgagttctggtgaagccacgtcacccttttaactccagccgttcgatcagctgctacaaacggttagatgcgttcctcctccaagcgctgcctccctcctccaccgagcgccagattctccgccgctgccgccgggcgcgcgactcctcccttccccaccagtccgcgcgacgctctcgcttcctcccaggcgcgggcccgccgtcgaccgctctcgcttccttccccagtcacgcacgcgcgaggcgcgggcccgccaccggccactctcgcatccccgcgccgcttctcctccaaccccctccccccggcgcttctcctccccccggcacttcaaaaccgctgccaccgcaggcttcatggctgtcgagccccattcccttacttcaaatcgcttcccacggcttctccctcagcggaaatcatagttcgattggctttctcaacctctccctcctctgaaatagtatatcttatgctgctccttcaccttgaaaccgtatgggtgtatattcacctcccaaaggtattcttcttcctcttcttgaatcatatatatctcatccaaatatccaatctattggcttcttcttttagtcaagctagattgatatgtttctgttatctctcagattattgaagaattaattaaaaaaaaaacagagagaatggttttgttttggctcttctttaggtttttaccatcccgattgaaatttatttatagtatataaggagatcattcattttatgaggataactggtatgcataacaattttacattactgacgcgtgcttgcagttataatttgatatttttttttttctgaatttcggttgcagatcattgccactactagattgcttgctattgctgtagcagcagccagccagtgcaggtgctgtgatggcggtttcctaggtccggcgccgtcctctgaggtcaggattgtactgcttttctgaccttgcatgtgcctgtaactgcaagctcaatttcgtgtgtttcctctgaacgcgcgtggcgtgtttgtggaaatgcctctgtgggagtagcacgcagtacgcacacacgcacgcacatgtttgcccattttgctccatgcatatcattatgcctgcatgttgtgagttgtgctgctgactaaccactgcagaattattggtttatataagttagaaccatattttgatgtgttccagcctgctgtctgttgtttgctgaccattgcatttgctgctgacccaaacaagttttagggccaagaggttgattcagtgtggacttaattatggtactgaaagtaactgtacatagtagttgcaatgcagaccagctttgcactaatttcaggaagataagaaaaagagccaaacttagataggtttaataattactcaaactatttttcctccactggaaagataaggagatcattcattctatgaggataacgggtatgtataacaattttacattactgacgcgtgcttgcagctataatttgatttttttttctgaatttcggttgcagatcattgccagtactagattgcttgctattgctgtagcagcagctatgggctaccgctaagatcagcccccatgacattttccatccaaatcagccgctgaagcaatatattgggtaatcataattgcctcgcctcatgtttgtttatggtcatcacaaattttaggtacaagcagcgactttccatatattttattatatgcccatcctaagatatatacttgctttgcaaaggtcaaacagttccttctataactatactatcagattttagatacatattagaccctaatttttcaactgtccttactaatttttcattgctacatgatgatcgtatttgcattcatgtaactaaattcttcatatttctttctggctggagtataaagaatgttctttgtaata

SEQ ID NO: 68963 - DNA, 3437 bp, Oryza sativa
tcctttatgaaacacttccaaacctgactaaagtgaaatgcaaaagattttcttgtgcctcgcaaatgttgtagataaacgaataaacaatatgattcattcattgggttacattatttatggttcaacatgtgcagacaattgtcatccttgggttgatcttacaagcaaaacaagttcaccaacaaatatcagaaggcagaccaatttcttgcaaggctccattctaagctaaatctataaaaaaaaacacaaactaggttgtgtttcagatcttgtactgttgcaaagaacctgtgagcgttgaaaaatccttgaactttgaaaattttggcatatttaagcaccatggaaactaggggaatttacatgcatgcttggttcaaatcctgactcatattttgttgtcatcctggacaccagaagcaagtcaatatactctaaaatccaaattcataatgttgggacatttagaagattgaggcgattatagaacggaaaatcgagttaccgttaggatgcaagcgggccgacctgcgagttcacttatagatcaaataaatgataattcataggttttcggtttgtggtccggtttgctacatctagatatgcaagtgggtcgatccataaacccatttacaggtcaaattaataggtaacccgcgagttacatagaaattttgccaacaagtgggttcacggacaagtccacttacatccctagttaccgtcgcctccaaaatgatgccagtaccgtagccatggaacgaagtgggctaaagtagaaccctggtaatcttgacaaagaaaattgcatgacatatcctttgtcacagagaacagtagaaaataggctgacgtcaacacaaatcactaagcacattaataaatttatttaaattcctcagaaactgtaaatcaaaatcatagaacgattaccaaaattctagctaccaaatcaggagtcagatgagaactccacaaggataacctgcacaggaaaatttttgccttgaataacatcgagaaatcttttgcaaacttagtatcatgttttcttgtcatttttcttgataatgcattgattagcatcctgtacagtgaggaatccaaacttgccatctggaaaaatggttctttccatgggtactccaatactataaatacatgaaaggaaatgaaacagaaagtgccagtacaaatctgcatgatattaagggatataacagcagcaacacttcaggatcatcattggctcactgaaaatgaaactaaatgtaacaaatgggaatgcatgatccacggttcagtttcaaacctttttacatcacttggtatctaaaggagtgtctaaagttattcttaggaaaatatgcaagaaacaaaaatggtatgctatatcggtggagtttagttgatcactggttggtatcgaatagtattaagcatgtaaatttcacactgaaaaaaaaagttgaatttcagaataacttgaacaattttattgtgaagcacaaattaaagtgcaaaaccaattgagcacacgaaatggcacgtcatctttcccaaattagctattaaccactatatagaaacagatctaagagtgcaatcattaatctccaaatctgtggtatataaaaagtctcaggaaaaaaaattaaattaagttttcatgcaccaatgaaattacagttgcaaacagggagaagtaatattattatataccactgcatctaggaagataaattgaagaagaagcatgtgtaaacaacagggagaagtcacaaacataacagttatgctgaagaaaaggaggaaccccaaactgaaatgctatggttaacttgataaaaattatgagaccccagacttctttgatactgtcctagtcacctcgtgatccccattagtccagagacattttcctgaacaatatatgatcaaattcatgaaaaggcaagagctcagatttcaataatcccagatctttgcatttcagtatgtcgaaatgataaaattagaacttaatatttatcatccccatgaagtaaaaaggctctaaaagtgggtggtttctgattatagtgatagggaacataaagtagctagttttagtacactggtatttctcacaacatagacatatgaacaaaataaaaacagtaatagttactgctagtataattagcttgttaatggctcaaaatttgtaaagtgaagagaattgatgaaattgggtgaccaacagaacaacacattagtcaattgtttgtcggtgtgccagttacacttacatcaaaacaaatataagggaacgaaattttaggaaattgatggaattttacactgtttgaaccaaagaaaacaatcataagtaaccagaaactttgcactatccaagaaaaacatagagaaatgtagcatttaagtttgaaactagcattaatagctagttccaggactcacaacattttgcgctattgcacttcaaattatcggagtgcttgcaaataacatctcatcattggccaatccacaagatataacagaacagttgattttttttttagaataggggataacagaacagttattaacaaggaactaatataaattgatcattgatgcaatttctctttcatagaaaagagggtcagcacattggcataattaaaatgcattcagcattcatacttcaaacaaagtataacaaagaggatcacaatgcaggcacataataataaagtttccattgagataggtcgataaatatcagaagatcttgcactcttgataacaataactcaggatcacaactaaaatagaacgagacatgaaaggcaaacatactagctcaaacatttcttgtttccacttcttagttcccctcaaaagaaaaaaaactagctggattgcaggataaagataaatccaagacagaactcagacgtcaaaggggttgaaccttgggaggtcgatgaccttcaccttcctgaggtagctcagcgggcgaaggaccttcttaacgaggcggtgcatctcacgcccagtcaagccctttccctcgtggacagcaccgaggcaagcctcgacggtgctcatcgcttggtgagcgagggagagcgccatcagccgcacctccccgttgtcgaacacgagcaggtcagcggaggttatcacggctggtatggcctcgcgcgccctggtgagcgcctcccccagaagagtgttgtagaagagtatctccaatccctcctcgccatccgggtaattcttcagagtcttgaggacgcggcgcgcctgcagcatcatcttgcccatgcgcccaagagcatctgaggcggtcggacgtccttgaggccggccagatttgggatttcccaatccggccgcatctccatcttctggagctgctgcaccatcagcggggc

SEQ ID NO: 68964 - DNA, 2058 bp, Oryza sativa
ttgttcccccgcccccggagtccggtgataaaaaggttactgttacggtacatttaccacacgtttgtcactggtgtgtgtgataacggcctcctttttacagtgatcaactgatcatgcattcttcccaagttgatacttgccttactgtgtgtaggtatggggaaaataagaattactgtgccctttattatcaacatttgctttcttgctcttacttcctttctttttttttcttttcattttatttaatcgccctctcatctcacctcgcttaagtatatctttaatttttctaagaaaaaactaaaatgtattttgccattagcctaggcccagtgttaagcaaatcaaaatattctctccttatgttcgaactatttgttttcacttttacctaacatatttacaattttccacattgttaactgttgacagggtagcaaccaaccaattacacatgttggcatcagttcaactatttgatttaagatcggtatcatctctcaggttctcacaagataaggtccacagcctcatatgaaatttaacattttatctggtagggttagctagttatgacataaatactgagggaagaaaattctaaacgtacaaagagaaacagaacatcggagtgtatacacatgttctatcccactgcaaacatcatattgctgttatcactgctattacacctcccacgaatacacatgcaaagtgtatgcgagtgttatcttcttgtgccgtcgatcacaaaataaatgtactgaaatgccatcaaatgcaaagctatgttgtgatttgagatgatccattagcacattgacctgtaagaaccttggatatattgtgactacctacagatgcatggatcaatcttttttagagaatcattcttcaaaaaggtccttgtacatccagtggcggacgcaggatttcgaaggtgggtattcaaaaatttacatggcgaatttgttttttaaaaaatatggttaatatcatcaatgcaaatactatttcttaattagaaaagttataaactatagaaaaatattgaatgaaaacatttatcttgttgggttaacatgattttgaaatataatcgatgtatgcttaaaaaatattgtgagcttatggaagaaaaatccaaaaacaggattgaataatcgagaaaaaacgagaaggaagctaggaatcgaacctagcacctgttgacccaccaaccatttgggcaggatatacttgatgatatggggtatagctactttgtaaaaaaaatgggtattcagctgaatacccatgaacgttgtagcgtccgctatctgaagcctaaactattcactttgtgtacgaagtgatgttcttactatcttcattcactggggttcttcaataccgcctcctgctaacctgcaatctgcaaaagagaacatacataagtctacaatatcattcaatttcaccctactagttggtggctgaattcctacctaattggctatccattttgtgcacagtaactggcacttgtattgcaaattgcaacgtaaacattgtcctacagtatcaaattagcataatatatgcaatcaaaagatcatctggagttctggatgatagacaaggttggaaccttttactttaagaaaactaaaggaataatgaatggttggtaactgggtcagcactatcaaggaaatgaacccatcaattttacatgacgtaaaagggggaattagtcagcacccagagagccactgaaccaaatactatcagaagcacatatgtagtaaccaagtaatatttcacatcaacaaccttgattagttagaaaaacatggacgaaatagaactacttaaaacaagtaaaagacctagaagttctaagccagtaaccaggcccaaaataaagagtaacagaatgtgaagtaatccagataatggatggaacacttccatatggatgggaggaacaacgtaagagaggtaaatcctaactaagaaagttacactaatattagcacagataaaatatcacatgattcaggcgttatt

SEQ ID NO: 68965 - DNA, 1801 bp, Oryza sativa
ttcctgcagcccctaaaatttatttacgcattttaggcttttaagaaatatacaaaaatcctccaagccttatttgacttttagctttgcacattttaattgttggaggctttcacatggattttacttattctttgcataatttcgaggatgtattttagagtcgttttgggacgtgacactgtcacttcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaaatgatacaaagaacagttcagtaattatttgatcaataatgatctaattataattgttaagttcttttcttgtttaaaatccttaaattataaattgttgtttaaaaggaattattagaaataattttaaaagcttaaaagataagacctaattttaatttgttaaatctcaatataaaaatgagctagataaaattttattaaatactttgcttgttcctctattttctagaattttctaggaattgtttgagcaagggaagtattttaataaatgaaacatcatttcacgaattattttaattggaaaagtttttaaaatcctcccctaagtcgttgggccgatttcggcccaactcttctcttccccgcgcggtcgaaccggcccaagccggcccagccgacgccgcccgccccctcctcctcgggtcaccgacatgtgggacccacatgtcggacccatcttcctcctccagccgccggccaagccgagcccgagccgccctaccgcgccaccttgtgccctcaaatccgcacccaatccgaccccgattcttccgatttttgaggggtttttatcctctcatcctcctctatctttcccctcaagaatcggagcaaatggttgggtattttatccgaatcgagttcgtttcgattttatccccaaaaaccgagtttagattttcccgagccgatttcttgcgggaggagtccgatctctttaatccaaggctataaataggaccctctagttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagataactggagctaatccttgactcgaactgcagcgggaacaccactccacaggcatcctcgacggcacggacaaagcctactcctcggagaacccgccatcggacacatactcgagctctgggattggggaaaatagagcaaggctgagtactacccactgtactcagcaagtcataccggaacgggggtatgatgcagggattccacaagggatagctaagcaggttcatttgcataaatactggcatttataaacaggaattgaatgcgaaaacagttgtaataattaagcagtattaatcatccactgtccaacgctacaccacgttgcgacaggcccaaccatccacctaaacaatccaaattcaaaagattacactagggtgagactaatcacggtgaatctggttgactgcccataaccgcgggcacggctattcgaatagttttactctgatcagaggtgtacaaatgtacccacaagacaca

SEQ ID NO: 68966 - DNA, 4851 bp, Oryza sativa
ggttaaaattatttctagagctctgaaaattccactaaaaatcatgttaatgaatttcgacctgtagaactcaagaaaaagtcccacatgtcaaatccgattattatttgcattactttcttagggttttctcctgatttgcaccggtattttcttagggtcatttataaattacaattttggcttgggagggaaacttcgtggtgtgacactagtcctcctctttcgtttgccccttttcccgagctctctagtgcgccgtagagtcgccgccgcgtcgctttagccgccgccgtcgccggccatcctccggccacgctgcgccgccgcgtccgccgtcgttgccacctctcgttgccgccgttaggtgcgcacgggagcggggaagctcggccaccccttctccgccgtcgccggccgtcgtagcgccgttcccgccgttcaaccgagccgccgccgcctcttgcgtcgtcgccggccgtcatcgttcgtcgttggacgctttggtgagtaccgttgcgttcgtgacgtcgtcctctacgtgtagatgcccttggatagcccggccgatctctctatcgccggcgaggtcgtcgcccatgtcatgccggcgatgatgacgtcagcatgacgtcatgattcctcttttccagtttttttctaatagattaaatcttcggaaaatcataactaaataaccgtagcttcgtttcaggtggttcaagttgctaaatttttctaaaataaagatctacatattaaaattgtccataaattgaattaaatttatttaattctttttaatgggctttaattagatttaatcttgtaaaattcatattaaattcatttgaagtcagaatagggccgttcaagtctcataattcatctaaaatcatgttctacatgtttgtttattttatatgtattgtttatttggtttttattagtcttttactttgttttgcgtgttagcttgtcgtttccgtcgttgcgaaggttcgtgagtgcgctggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgtattggatgccctattccttgataccttgggtaataaattgattagcttgaaccttatatattggattggttcagctaaatgctatatgtaagtttgcttagctatgcttagaaacattagctaactaaaggggttaattataagctatgttatattattattaattatggttacattaaatggtagctcacgatggttaatcgtgcgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacaatggtacacctctggccagagtaaaactattcgaatagccgtgcccgcggttatgggcgagttaagcaatgtttttcgtggttagtctcacacctctcacaataattatagatgttatacctggtaataatttgcttagctcctggtttggagattagatctgtacagccgggtatggttgttcaggatggttgggcctatgcagcatgggtgtgatgttcagtgttgattaaaatttctgataaattactccactgttttacttctcttaaatctttgctaaatgctgcttttgcaaaagagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgatgcctggacgaggattttatgcacaaattagttcggaaattattagtgaatttccgggcgtgacatctgccccgcgtgcaatcaatagggggaattattccccgggatcccctccccctttccccccatttttccctccctctctccctcggattcgtttggaaacccctcccctaacctcgccggaccgtggggctgccgcgtgggccccactcccgtggacccggtccgcgcgcccctcccctcggctgacgcaataaatcctttttttaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagacccgctcttcttggaagttgaagcccacgtttgggaaagcgagcaaggcaagtcacatcatctttgaacatattgaatcccagtttgtaaaattatgttgatttaaattattgcattatcgctttatttaaattcccgccgcccgtcagcgagggtggcgggcgggcccgcccgtcagcggcgcgcgcgcggggaggaggccgatgggtcgcgggggagaggagagagagggagggaggtgggccgagccggcccaagagggggaagggggggaggaaaaagacttttagggtttttctttttataaaaccactttaactttgtttatttcttcttatttattttttgtgctctgaaaattccactaaaatttatttacgcattttaggcttttaggaaatatacaaaaatcctccaagccttatttgacttttaaatttgcacattttaattgttggaggctttcacatggattttacttattctttgcataatttcgaggatgtattttagagtcgttttgggacgtgacaaacctaccccccttaaacggaatctcgaccccgagattcggaagaactggcgaagagatcgggatgggctgtcttcagctcgtcttcgcgctcccaggtagcttcttcttcggcgtggttgctccactggaccttgcaaaaacggattacccggttcctggtcctgcgctccatggtgtccaggatttttactggcctctccacgtaggtcaagtcttcgcgaacttcaatttgctctgagtcggcctgctcggatggcactcggagacatttcttgagttgtgacacatggaacacatcatgcacgttgcccaaggaggcgggcagctccaactggtaggcgacttctgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtcctttttcccccttcctctattgggccggctcggcccagctccctccctctctctcctctcccctgaggcccatcggccttcccccgcgcgcgcgtcgctgactagcgggcccgcccgccaccctcgctgacgggtggggcccacccgtcatcccctacctcgtgccgcgcccgccgcctcgcccgtgccctagcgccgccgccgccgcggattccgccgcatcccgccgcccccgcgcgcaataaagaggggggaaatcactccccgtgattccctccctctttccccccacttttccctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctccccgtcggaatcgagctcgcgccgtcgtcctctctctccgccgttgccgccgagcttcggttcgccgccgtcgtcgccccggacctcctcccgcttcggcatcgcctccttcggcttcgccgcgtcctcgtcgacctcgtccaccccttcgtttcgcccgccgaccgccggaacgccgccgtcctcgtcgacccgagccgcgccgccgcctctctccgcttcggtcgccgttcccgtcatcgccgtcgacccggggtgagccgaggaccgccatctcgcttcccccttccctcccctctctcgggcgccgctccgtcgcgccggaggtcgccgccggcgaccatcggggcgcgggcgcg

SEQ ID NO: 68967 - DNA, 12538 bp, Oryza sativa
ttcctgcagccctgaaagagcatataaacttcaaatggccataacttggccatttgaactcggaattggactgttcaagtctctaatttttccttaagaagtcaagaacccattttgtgctttgtttctacttgttatatggagtttattagagtaaaagccttttcttttcggttggtcgtgtagacgctgcagcttcggaagatccgctcttcgtggaagttgaagccggcgtttgggaaagcgagcaaggcaagtcacatcatctttgaacatattgaatcccagtttataaaattatgttgatttaaattattgcattatcgctttatttaaattcccgcgttttcactgttttatttagccatgcctatttacctttgttatgaccttaatattgttattgttattatttccttgttcaccctagattaaacaaaaccccaactagtggacactctactcatggtaccactagtatgattttaggtagatgcttcgcttttaattaggtaacattaggcggttttacaactctagactttgggaatattcatatcacctggacactgtggaatggtttggttattgtggaattggattcacaccgcccccactattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatagaggtggatgaagtcgggagtcaatggacattctccagggcaaatgaaggctacacgagctgcggcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatcttgtatagttctagaatcgtgcttacaaaatagctttgagcaactaaatagctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctgcaagatgaaggctttggtgtctagctcgtgcctgccgtcaagcgcctgtggtcgtcgccctagtcttccgttgtttctcgtttgtctttgtgtgtgctgggccttcgtcgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacagaggttcatggagaacttctccaaaatcgctcgacccatgacacagttgttgaagaaagaagagaaatttgtgtggagcccgcaatgtgagaaggcgttcagaactctcaaagaaaagctggttgcctcgccagtgttaatcttgccggatactcgcaaggacttcatagtgtattgtgacgcttcgcgccaaggattggggtgcgtgctcatgcaggacggtcatgtggtggcctatgcctcacgccagcttcgacctcatgaaggcaactaccctacccatgacttggaattagccgcggtggttcatgctctaaaaatctggcggcactatctcattgggaatcgctgtgaaatatatactgatcataagagtttgaaatacatcttcacccagtcggatctgaatcttcggcaaaggagatggttagaactcatcaaggattatgatgtgggaattcactatcatcctggtaaggccaacgtggttgccgacgctctaagtcgaaaaagccattgcaacactcttaacatccgtggcattccaccggaacttaatcaacagatggcagccctgaacctaaacatagttagtcgcggattcttggctgcgttggaagccaagcctaccttgctcgatcaaatccgcgaggctcagaagaacgatccggacatgcatggactcctcaagaatatgaaacagggtaaagccgctggtttcacagaggatgaacacggaaccctatggaatggaaatcgggtatgcgttccagatgtcagggaacttaaacagttgatacttcaggaagctcacgaaagtccttattccatccaccctggcagcacgaagatgtacttagacttgaaggagaaatactggtgggttagtatgaagcgtgaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatagagggaacaaactagccgaactctacttcgctaggatcgtaagtctccatggcgttcctaagaaaatcgtatctgataggggaagccaattcacctctcacttttggaagaagctccaagaagagctgggtacccgattaaacttcagcacagcgtatcacctgcagacagatgggcagaccgagcgtctaaatcagatcctagaagatatgcttcgcgcatgtgtcctggatttcgagaagacctgggataagagtctcccctatgccgagttctcctacaacaacagctatcaagccagcatacaaatggcaccttatgaagcgttgtatgggcgcaaatgccggacaccgctaatgtgggatcaagttggggaaagccaagtgttcgggactgatatcctgagagaagctgaagctaaagtcagaaccattcgggataatctaaaggtggcacggtcccggcagaaaagttatgcagataaccgtcgccgtgacctggaattcgcagtggacgattttgtatatcttcgggtcacgccattgcgaggtgtacacaggtttcggacaaaagggaagctcgcacctcggtatgtgggtcctttccgtatcgttgctcgacgcggagaagtcgcttaccaattggagctgcccgcctccttgggcaacgtgcataatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggaccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtcctttttcccccttcctctcttgggccggctcggcccagctccctccctctctctcctctcccccgcggcccatcggccttcccccgcgcgcgcgtcactgacgggcgggcccgcccgccaccctcgctgacgggtggggcccacccgtcatcccctacctcgcgccgcgcccgccgcctcgcccgtgccctagcgccgccgccgccgcggattccgccgcatcccgccgtccccgcgcgcaataaagagggggaaatcattccccgtgattccctctccctttcccccccacttttccctctctctctccctcggattcgtttggaaactctcccgcaaacttcgccggcgcatcaatggcggccggatcttccacgaccgattccccctcatccggccgctctctcctcctcccaacactacataaacactccccatgcctccctccttcgtttccgccactcgccgctctctctccccgtcggaatcgagctcgcaacgtcgtcctctctctccgccgtcgccgccgagctccggtccgccgccgtcgtcgcaccgggcctcctcccgtttcggcatcgccttcttcgggttcgccgcgtcctcgccaatctcgtccaccccttcgtttcgcccgccgaccgccggaacgccgccgtcctcgtcgacccgagccgcgccgccccctttctccgcttcggtcgccgttcccgtcgtcgccgtcgacccggggtgagccatggaccgcccatttcgcttcccccttccctcccctctctcgggcgccgctccgtcgcgccggaggtcgccgccggcgaccatcggggcgcgggcgcgccgcctcccgtcggctgtgccggcgaggccgccttcgggcgcgccccgcggctgccatgtggggcccggtcgtcagccgcccgcgtcctcgggtgcggctgacgcgtgggacccacggcgccggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttattgttattatttctttgttcaccctagattaaacaaaaccccaactagtggacactctactcatggtaccactagtatgattataggtagatgcttcgcttttaattaggtaacattaggcggttttacaactctagactttgggaatattcatatcacctggacactgtggaattgttggagtattgtggaattggattcacaccgccccctctattcaaaatccccaaaaatggtttaggctgggctcggggcgcatggttttgatagtagcacctcggccatataaggaccggtgttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaacccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttggaaataaaaatcctttgtatttgtgaaaatcctctagtctctctctgtcttgctgcttcatttatcgccaaaatctgacctttaaaattttgcttttctttttgtttttgtttgtagatggccggcagcgtcagccgtcgtggtttggacatgactggcttcgtcttggagctgcggggcatgtgcgtggtcctggggcatccacatggagtggactaccaggccaggccgcttccggagcaggagggtgacgatgcggagccccacgctgcttgggaggtcactgcagtgatcctcgctggctctcccgagcggacttcgctgacagtcaccgcgggtggggattccttccccgccgcttgccagagcgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccatcagatggtgcgtcgtgggatggtcgagaacaacatgaagatcctggagctgcgtcaggagaacctgcagctcaagaaggacctagatgcggtggaggcgcagctgcatcagctcaagatcgcccagggagagatctgccgccccaagcatcgccgcgtctaccgcagccagaagatcaccgcccgcaagagcacctccaggcccgagcttgttcgtcagtccctggcgtggacttgcttcgtggagacccctcgtgccgagcccgcgcccgtggttccccaggagggggaagcctccggcgttggtagcacggaggatgcgctgttgctcaccttccgtcctggcccgtcacagcagtagacgagcagttagtaggcttgcgcgtgtgttctttctcgtttgtcttcttgttgggttgtgtggggcacggttatgccggtgtgtggtgtaactttgtcggagcctgtctttattttatttgtttaagcaacttgaactttaatgaaccaatttaatagcagtaataaattcaagaattatggtagtcgtgggtggttagctttaattgtcagctctctctgtttgctggttctatgtggggttttcagatggtgatgaccaggagaaatgctgccaccagtgatggcaaccaacccgaagacagcaaccacaacaaccatggcagcccacctccacctcctcctccgcctccaccaccaccaccagataccaacgccattctcacccaaatcctcgcccagcaggccaacatgatgactgcttttctccaccacctccaaaatccgccacaacataatgctccaccaccacctccccaacactctaaactcgccgagttcctccgcatctgtccacctaccttctctagctccaacaaccccgtggatgcgttggattggttgcatgccgtggggaaaaagctagacactgtgcagtgcagcgatgaggagaaagtcatcttcgccgcccaccagctgcagggacccgcatctctatggtgggaccatttccaggctacgcagccagagggacagcctattacatgggctcgcttcaccgccgctttccgaagaacccatgtgcccgccggagtcgtggcccttaagaaaagggaattccgagagttgaagcaaggcaaccgctccgtgatggagtatttgcacgagttcaacaacctggcccgttacgctccggaggatgtgcgggaagatgaggagaagcaagagaagttcctggcaggaatggaccctgagctgtccgtctgtctagtctccggggattatccggatttccaacgtctggtggacaagagcatccgcttggaagccaagcacaaggaactggagtcgcacaagcgccgcttggcgaatttccacaaccaacagggtgctaaccaaagggtccgctacaccaatccctatccagggggatcctcctcgcagcagcaacagcagcagcagcaacctcgctccgcgcctcgacctcaattcgtggtgcgcgtcccacagccgcagcaggagcagaatcaacaagggactcgtgcgccccgtcctcctccaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtggtaaggacgtcattcggggtcgtgtgaaccatgtgacggccgaggacgtgctgacaactccagacgtcatcgttggtacgttcctcattcattccatccctgctaccattttgttcgactctggagcttcccactcatttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctaggcaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaattggccgaagttaagaaacagttggaagagctgaaagaaaaggggtatatacgtccaagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcaatcagcttaaaggtgccactgtattctccaagattgatcttcgttccggatatcaccaattacgtattcgcgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgtggtggttttcattgatgacattctgatatactcacaatcagaggaagaccatcagcaccatctccgtctggtattgggaaagctgcgggaacatcaattgtatgccaaacttagcaagtgtgagttctggttgtccgaagtcaaattcttagggcacgtgatatctgctaaaggagttgctgtggaccccgaaacagtgatcgccgtcaccgattggaagcaacccaagacagtcactcaagttcgcagtttcttaggtttggcaggatactaccgaaggttcatcgagaacttctccaaaatcgctcgacccatgacacagttgttgaagaaagaagagaaatttgtgtggagcccgcaatgcgagaaggcgtttcaaactctcaaagaaaagctggtttcctcgccggtgttaatcttgccagatactcacaaggacttcatggtgtattgtgacgcttcgcgccaaggataggggtgcgtgctcatgcaggatggttatgtggtggcctatgcctcacgccagcttcggcctcatgaaggcaactaccctactcatgatttggagttagccgcggtggttcatgccctaaaaatctggtggcactatctcattgggaatcgctgtgaaatatatactgatcataagagtttgaaatacatcttcactcagtcggatctgaatcttcggcaaaggagatggttagaactcatcaaggattatgatgtgggaattcactatcatcctggtaaggccaacgtggtcgccgacgctctaagtcgaaagagccattgcaacactcttaacgtccgtggcattccaccggaacttaatcaacagatggaagccctgaacctaagcatagttagtcgtggattcttggctacgctggaagccaagcctaccttgctcgatcaaatctgcaaggctcagaagaatgacccggatatgcatgggctcctcaagaatatgaaacagggtaaagccgctggtttcacagaggatgaacatggaaccctatggaacggaaatcgggtatgcgttccagataacagagaacttaaggaagatgtacctagacatttcgggtatgctgatacttcaggaagctcacgaaagtccttattccatccaccctggcagtacgaagatgtacctagacttgaaggagaaatactggtgggttagtatgaagcgggaaattgcagagttcgtggccctctgtgatgtgtgccagcgtgtcaaggcagagcaccaacgaccggccggacttctccaacctctccaagtaccagaatggaaatgggatgaaattgggatggattttatcaccggacttccaaaaacccaaggcggatatgattctatatgggtagtcgtggatcgactaaccaaggtagcacggttcattcccgtaaagaccacctatggagggaacaaactagctgaactctacttcgctaggatcgtcagtctgcatggcgtccccaagaaaattgtatctgatcggggaagccagttcacctctcacttttggaagaagctccaagaagagctgggtacccgattaaatttcagcaccgcgtatcacccgcagacagatggacagaccgagcgtctaaatcagatcctagaggatatgcttcgcgcatgtgtcctagatttcgggaagacctgggataagagtctcccctatgccgagttctcctacaataacagttatcaagccagcatacaaatggcaccttatgaagcgttgtatgggcgcaaatgccggacaccgctattgtgggaccaagttggagaaagccaagtgttcgggactgatatcctgagagaagctgaagcgaaggtcagaaccattcgggataatctaaagatggcacagtcccggcagaaaagttatgcagataaccgtcgccgtgacctggaattcgcagcggatgactttgtgtatgttcgggtcacgccattgcgaggtgtacacaggtttcggacaaaggggaagctcgcacctcggtatgtgggtcctttccgtatcactgctcggcgcggagaagttgtcacgaccggaaataacccaacgggcattccttacgtgggtgcattaatccttgt

SEQ ID NO: 68968 - DNA, 586 bp, Oryza sativa
aacctggagaaacaagaatcaggcgtcaatcggcgacacctccgcatctctctgaccctgctccagcagacaaggtttcctccccctgcaaacctttcagccattcaagagatagcagccctgaaaatgggcattgctctgcagttgcttctcctcctctcgaacctctctcacctgacatattgcctgtgtcacaggagcaaggggcgttgctcatgcttaaaaggcacctagatcctatgctgcatgaggctatggtgggaggttcaatttattcccctgacactactctgccacgccctgcttcccctgtttttgttctttcatctgctgcagaaccacaagagaacttagtggatgaggcccagcatgatgtggagacattcctagcagaggtgaccacgcccattcagcagccactgctgtctgcgccaggaacaaagctgcgtcgaccctgccgcaataaggtgaccactcctattcaaaggcatagtgcaagattggcactgaaagtcagacgcagtacaaagcttgaattaattgcacaagaaattcttgcaaagcaatttggtgttcttgatgataa

SEQ ID NO: 68969 - DNA, 3826 bp, Oryza sativa
gtagaaagatcattaccagataaattaggcaaggtaaattcagaaactgcgaaggaaaaaaaaaagatgaaaagttcagagaatgctacttacaataggctcaaactgaggggataacaggttgtcttcgagatttcttagcaccaacagtatctgcattaagtaactgtattacttagaaggattcatttttaatcatagaaaattatgacagtacttatctccagtcaaaaaatcgggagaaaactttgttcagaaagctagtattgctgtacttaccgtcttcacgatgatatcatccatgctcttcagtttctgaaggtgtgtttccactggacacggcgagtctggatcgaaaatgtcgccgatgaacctgtatacttgtgcaaattgcagatcatctgaaaacagtgaaaaaaaatcattcagcttacagtttttcagcagcaatgcattgttaatccctgattccctgagaataattttgatctttcaagagacgacgtagaattattaccaggtgatagtggaagctcgatcgtttcatcctgcacaatgctggctgttgccatttcacttgtggtgccagtccagtccatgctcgtattactgaaacttgctgcccccatgaatgaactttcacctgaatcatcgtaaagaaaaagttatttctcatggcattttggttgcagctccgtgactaagatcgaaaggcgatttgttgaccggcataattaccaggaaatgaaacaaatgctgctggtggttcaatcaggccgtgatggttcccccaggctgcagtgcctgaagtacttgcccattccaagttctgcatgtctgaaaaaagaattaccacaaaacactgtcaaatcactagtaattaactatcgagtgcatctttgatgatgacatcaccgatcgcaatttgaatctagatcaactgacaattgctaatggtgatttggatatgtgcacttgccattggttgcaggaggaagaactccgggacactcccaaccgatggagctctgaacagcgacgttgtgatgcggcggcaagcactgcggctgcccgtggaggatcgccgtcgccgccaccgagctgctcaccgccggcgagctctgctgctgctgctgctgcatgacgagcctccgcctcgggtactgcggcggcagcccggcggcgagccccatcttctgcaccttgaggaagtacttctgcgcgtggctgcggatctgcacacacatcgatcaatcgcacattgtttcaatcagcattgcaatcttcatcagaaaccaaatcgagtagtagcttaatttgagcacgattgtgtccagctacgtacgtacctgtatggtggtcttggtgccgacgtgctcctcgatcttcttccagtcgcggccgtacatgatgagcgcgtcgaggaacctctcgtgctcctcctcgctccatctctcccgtggcttcgtgatggtgtacggcttcctggccttcttccccggcatctcgctgctgctgctgctgttgctgttgttgttcgtgttcctatccatcaacacaactccagtccccaaatcgaatcgagcagacgcacacatggcacatatatatacctatgcaaagccaagaaagaaaccgaagatccctttgtgggtttggaggttgacgacgatcgaagatgaggaggaggaggaggagggctggagtggcctaagaattaggcgcggtttagcgcgtacagttggcgaggttgcatggagacggcaatgcgcgcgtagtagctttgggtggaggaggacatcgccgggttggtgcaagcgactactcctagctagcttagctctcgcttgctgcgacggatcgcgacgtctcgtctcggcgagggggcaaagcagcatgtgcgcgcgcgcgccccgtcgccgtgtatggcaacgcttatctgctgggcgctttccgtttccggaaagtcggcaaggcccggaccctagcttgggaacgattgctagtggtaacagattaacagattagtacggagtacaaatttttgtgcacgctaacctgggtttgttctgagtaatttttaacctcgcaatttgcaaaactacgaaaaaaaatgaatctcgagttatttgagaatcttgttcttttagtgttttttagccatatagttctcatgatatgtaccctctccatttcatattataaatcgttttatattttttcaagtttatagaaaatttaacaaaatctaaaatatcatattagttttatcaaatctaacattgaatatattttgataatatatttgttttgtgttaaaaatatcactatattcttttataaacttgattaaacttaaagaaatagtttgattagaaaaaagtcatacgatttatattataaaatggagagagtatgaattatcaaaatggatacgttggtaggggtatatctttcttatagacgtataggtaagccttacatttccacgcgtcgaattgtgtggttaggcttgaggagttaattaattgcttcgttcttgggaaaaagttgtatgccaaaataggaaattttcggtaccgcatcggaattgccaatgtaatggcacacttcactgtacggcaaggcaagtcttgatcaccccagccagcctcagcctggatggaacagcacgtgttatacgtggccaaactcggccaacgaaatagcgcatatgtttgttgtgacttgtgaaaaatccatggatgaacatgagttttaaggacacgcttctctaatgaaataacagaggaaatggagaacaaaatcaggacggccacatgttcctggtgctgtatggtgtaacctttgcgtgtgtgtgtgtgtgtgtagagagggctaaaagtatatgcatggagtcaaaataactctgattaaatatagcacacgttaattcaaaaaaaaactcgaaactattttgttttttttactttgcacgttcagaaatttttaatcaaaatgaattgcctaaaaaataaaaaatagtttttttttttactgacgttgtctattacttatggtcaggatgaatccatgcttactgcgagcccatttaagagcccaaatactcgaattggtatgaactagctaacggcccatttctggccatggttgggttccatgatttgctacccactcacttaatctctgggtgcccagaccacaaatggctcttaacggtatgcatccatgctaagttgctaaccttgcaaaaagagcccaaataactagaatattagggaaggacctaatatcaaataattaggaggggtgaggctttgaacccaggtcgtctagcccaccaccttgtggagctagccggaagacccctgggcaaaaagagcccaaataaattgattcattactttttttgtttgaaggaaaatgattatgcacattggctggctatgtacacacaattgacctgttatgaacatgaggtcttgtcacaccccaatctgataccgccgtacaacggcacctgacaggagcgtgtcgtagggaaaacggcgtgaaccgcttcctatgaaaccgcgatctcggtaccagtcccaggacatagtgctggtacccacggtgacaaatatgaatcatagcaatccttaaaatatatagaggacttatttaccttaacttaggttgcagctcggacagcccgagaatacaaccgacgacgcggacgagaaaacaccaacagcagcagcagcagcggaaccaacggtctaacacccaacaccacaggcgacggctggggaccaggacgaaaccctaatcttcacttcacttc

SEQ ID NO: 68970 - DNA, 9884 bp, Oryza sativa
caatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacgggcggcggcggccggaccgaaatcggcccaagtggggagcgcgcggcggcggctttcccggcccaggcccaggtttcggcctgggggaggggagggggcgctcgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcactggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacgcttatggatatggtgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgacgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttatccaaagtttaagaatgggagatttattttcctaattctgtatgtggatgacattctactggctagtagtgatgtcagtctactgcagaaaacaaagaaattcttgtcctcaacttttgacatgaaagacctcggtgaggcttcatatgttttgggcatagagattcaccgagatagaacaaagtatgcattggaactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacacttatatgtggaataaaagtgttggtttagtaaaaagaaaaaaactaacgcttcattggagccaagccgagctgagcgtgagcatgggagaagagaaaaaaaaacatctttttaagtctcatccctatcctcccaacgctatcgtcatcaatatccaattcttctctctcgttcgctctcatcattttgtccttgctccctctctctcgtctccccacccgagcttggttggtgagtggcggccggacgcctctgctaggcacaaccaccataggcacggtgatggtttttttcgctctccccggtgcaacagcgactgcgtcttcctccgtcgtcttcctctcccctatgcagcggccatccgattccaccaacacaaaaggttctccactcgtgcctccctctcctctcctctactctcatgtcccgtgaggtggagaaggatgcgcgggggctagatccggcagcccccgagctcggcaccaccacgacggcgaggaggaggactggcgaagagtggcgatggtgataggcttggccttcggtgagcaactaatggccgcgatagcctcggtggactatgattcggtttttgtagttaaccttttgtgttgaatgttgatattctatatatcattcggtgattattctaatttgtgatggattaggattaaatttttgcgttggatttgtaattggattgggattaagtccttggctcaaaacatgtgctcaattcgagccgaagccgatgcgtcgagccacattattttttcatttctagaacctcaaaggtgcaccaacatctatgattctccacatcagtgtcggttacgaagtctagtatctatgtgggattctcaaatggcacccattaggtattctatagtaatgaggtggtttgttgttaaatatagtttctcagtataagaactattagcaatactaaaaaagagagatgcaaaatgcatgagccaataaaacttgcatccgagtctcaactgttcggctgctcagcttcttcatgacatacttgaggcttcatcggttggtgagtgggtcatgactatagatggccataaggcccgcccggcctaggcacggctagacacggcccaccagctatcggaccagcatggcccggtcggcacttcgtgccgggccgtgctggcccatgggctacacctccagccctgccacggccccgtgtcgtgtcggtccgaagacacgggtggtctatcgtgcctttttttaaataagtctattttctctccctcctcggtgggctgtgacatatgtatatatatagctaaaataagtccatttttcctccctcctctttgggctgacatattatatatatatacccaattcaaatgagtatgaaactttttcaattacttaggtattaacattaactactttactaactagttcaaagcatgtttgtactgaatttgaacttgtttttgttagattttgattctaggtatatagcatccatacatataattacttaggtacgtaatcactgattgtgaaataaagttaaatttgagttgttttgttgataagtataggtatgaatcgaattattataactaggtatatactcacaatttaaaaattttgaaaattttgagtgattttgtgcattagataccatggtgcccgggcaccatggtgccccatatgagtgtcctatatatatatatatatatatatatatatatatatagctaaaataagtctatttttagtccctattctttgtgtgtcgggcctggcctgtcggcccatcgtgccgtgccgtcccggtcattttgggccagcccaacgtgccagtggggggcctaggcacggcccggtggtcgggccgtgccgtgcttgggctgggccaaaatgtcatgccgtgggccaggccgtcgggcctcgggccttttggccatctatagtcatgacatgtcgacgtgttgtgctcctttgatggccaatccaaaaacccgaaagttttggccgtcttaccgagtctctgaaaatctcgacaccgcctatctataaatcttggcttcgcctcttatcacaagcatcctcttaattttaatggtgcatgaaattttattaccttaaaaaatattaatatttatgtgagggtgattttgttttatttaaaaaaagcacattcttttgttctattttgaacttgttaccttttcttctcaacggttgtgattttttttgaaacagggtacagacacatgcgcctatataagtgagcacacttgcacaccctatcttataagtactctaaaactaaatcggcatgatattcacaagtcaccacaagcgcatcaatagtgacatgtaagtcgtttatcgctaaaagaataaattttaattaccctcacaacatatataaattggagttctcattgttaggtgtatcttgagattcacgaagtcaactattatgatctttttctaattaccctcacaacatatatagatttaaaggtaaataaattatttaaaccatggaatgttgaactccgtggtatatcttcagctcaccaacaaagtatgcatgataagcaacatatgcttcattagcagactactgagttatctatctcatcaaatattttctttgttcattgtccgacactgaaagtattatatgggaagacattaaaacatacatggtcatgaccgtgtgagggtaggtggttactatgtgtgtatggatctcacctgcctagataccgtggagatactcattggagtactactgcctggcggtataatatttgtggtgtagctcatattttttttttagattttcaagcaatttttctttcataggatgcatttttaggcctagtttagttccgaaaacaaaaacttttcacccatcacatcgaatgtttggacacatacatggagtattaaacgtggaaaaaaacctaattacagagttcgagtgtaaattgtgagacgaatcttttaagcctaattgcgtcatgatttgacaatgtggtgctacagcaaacatttgctaataatagattaattaggcttaataaattcgtctcgcagtttcctaacggaatctgtaatttgttttgttattagactacgtttaatacttcaaatatgtgtccgaatatccgatgtgacaatcaaacccaaaattttttccaactaaacaaggccttaatgaaggggagagcatttctgtattcctatcttactataaagttatcccccactaactccttaaacttaacatgcaaagataccacatcatcatccactaattaacaagatgccacatcatcatccactaacaatcatcacattaaacatcatgcaaacatgctatatctttattctttttataatttaagagcttttcaaatacaaacatgttaaattatcatccaacataattcacataatgtttcaatgaatatctttattatgttttatgatatcctatatacttatttagttcatcctcacttagttagtgcttaaatgattaatctatggtccaaattatctttttcctttttttcctctaattaagtcatatcacataaattgtttttagcttttagatgattaatctatggtccaaactatctccctacttttttcttccataaagtcataccacctcactttttacgtttgaatcaccattctacatactatttaaatttaaattatcataaaccacattaatttacttaatctgatgttatatagctatcttacacgttattttttttttgttatcatactaaattcccgcagcaatgcgcggagtttcacctagttgttttaattgaaaggctttaaaaatccatcttcttgctttgagccaaaagtcgtcccatctcccttctcttcccttctcctcgcacgctactgattcacttccttctttttcttactccctctgtgtctcattttaagtacaaccataagttttcgcgctcaacttagatcgtccgtcttattt

SEQ ID NO: 68971 - DNA, 1468 bp, Oryza sativa
  unsure (1)..(1468): unsure at all n locations
tttttttttataatatatataaaaaataaatgcatgtntacttttattatagttctttaaaanacatatatatatatatatatatatatatatatatatatatatatatatatatatatatatatatatatatatatatatatatatatatatataatgttctatttcttttaaactaaatatttttaaagttattgatggtcaaagttataaaagtttgaccttaatcttgtctaaaacgtcaattaatatagaatcggagggagtacatctttgaagtttggagtattcagattaggtagccagttcttttttttgacgcaaaggtagccaattctggatttctggtctgtgccgtgttggaagagattagcaacggtatgcgtgtcataacatgatttcttgtccttttaatttggatggtttttacggatcagtagcagtaattactggcctggaaaaatcgtatacttttctgcctgaaaccacaaggtcaaagtttggaattactgtttcttctagacgcacttccgtgaagaaacaagagcaagtgatttgaatattattaatatacaggatttttcaggcattcaggaaaactgaaacccttcattaatttccttttctaaaaagaaacaacagctagcatacaaaataaagctcccaaatttgctagtagtacttttagttagggaggctggtcgtaaagcagacaataatttttacacaaactagaagccaatcatctttacagaaagcaggcttatcaacttatggctagtgtaatttgtcttggtttagtcataaagcaccggccattctggaagttgcacacaaaaacatatgaaatgtgcaaagtcactatataattcattcttttgttgcagtggcatcacatctcccatgttttcagttggtcggataaatcattcatgtgtgttcccttttttcttcttcttcttcatgatactacatccataagcagtagcagtagttgcaacgtggtttgcttttagagcagtagcattctcatattcttgttctttctgtaatttgttcataaggttaccattcacaacggacgcatcggatgatctctgataattcttggtgtgaaataggagtatgaaccatgttgacatcatctttttttctgtacataaaaatgcagtttatatttattagaaaatgttcaggtttctactgggtattcattcttctgcgtgtaaatttcagggtagcagatgagccgtgtgcagtcactccagtggattgttcttgctatgctgaaaagcagcatgggaatctcactgttcttttgctgttatgtttgttgcaaccactaatttgactcgaccggatggatgttgggggttgtttgtttggttccaaatctaatcttacaactcaaagctttaggcagcatcccattttcttaagcaagtactcactccgtattttaatatat

SEQ ID NO: 68972 - DNA, 3563 bp, Oryza sativa
  unsure (1)..(3563): unsure at all n locations
agagagctccacccagctcctctcccagttttagtggaggtgaaactgtttggctaagctccagctccaggaggggtggagctggagctggagctgtgccaaacatgccctaagtgttcgattataattaactccacttgatcgtgagcttgatctgatcaagtgataattaccttcttttttttctcatggattatgcgcatgaataatgatgaacagattgagatttaaaaccgagaaccatgggaggcgggcatgacatgcacggcggcggccagaacggcggcgtgaaggggctggtctccaagctcgtcggcggcggtggccatggcggcggacacggcggcggacacgggtacgagcaaggctacggcgggcacggttaccctccccacgccggcgccgcccacggcgcgtaccctcctcagcacggcgcgtatcctccacagcacggcgcctaccccgggcacggttacgtgccgggagcctacccttcgaacgccgcgccacatggaggtaatttagctttaactgaacagtttacagtgagttttaacttagagagctttagctccaattccacgtctcataaaactgaaacccaacaaaacggttttaattttacccgaaacaagagaggagctagctagagctctcataaacttaagtattctcacaaaataaattagggatgtggagctagatcttgaatgctccgatccacaacttcattccaagaagtttaaagttaaatttaggagttataggtagtgcctaaaagacccttaaattttgcacttgatttctgtggatttaaacggggaatggtatatatatatatatatatatgcagggcacatgggatcgtaccacaccggccatggcggcggcggcgggcgtcactacggcggcaagcacaagggcggcatgttcggcggcggaaagtggaagtgaagcggctagctagctctacgtacactatacgtgcccaccagctttctgccctgctacacctacgtataatatctgcacgagtatgagtatcaaccatgtggcgtacgcgtatatatacatacctaattaagaaataaataaagtgcatgcaggcagacagatctgtgtgtatacatgagcttaatgatcagctgatgagttgtgcaaattaagcatgtggtgacgtatatatactttgtgtgtactgatatacgtacactttgcataatactacttatatactagcctctgttacgtgtgaaattcaacggttttccggttcattaagatataaggccgcgatttgggccaaattaacctaccgatgattttgctatatatttgtcgacaaattttttccccaaaatttgacagatgttgtcggtgacatgggaccgggagtatcatgacttagagacttgaggcagacacgatcacccacgtggccgggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcatttatccggtcagtgaccagtcacagaccgatcagatcgtgggttaggtgacgacaggcggtctgacgcacgcctcgccccatcccgtcaggacgagagcctccaagcactcatccctagccggagccggcgtgttagcttctggagatggcacgttggttccggtcagatatatgccaggcttcatcctaaccattacaggcaagatattgtatgaagaagggtgaacatgcagattgttgaactgacacgtggtggacaagaatgaccgatttgtgaccagtgttttggnaaccccaanccntggngnnttcatgtttcgtcagncagacagccatgttcccacgacgcgcctgcttccggcggaagtggaggtaggtatgggccgtcccatcagaaggtcattcggacggcaatcatacaaatcttcgtccatttatgaaaagataggataagtccccacacaaaaaagagagatggtgcatgtggtatccccttgagatataaaaggaggaccttgcccacttagagaaaaggaggacgatcccagaacgatcggggactggctcgcactttgtagcttcttcatacacagatctaccaaaacacaggagtagggtattacgcttctcagcggcccgaacatgtatacatcgcccgtgtcttgtgtgtttccactctcgcgaactttcctcaaaccaagagcttagaacctcacccagggcccccggccgaaccggcaaaggggggcctgcacggtctcccggtgaggagccccaagctccgtcagatgtaattacagtacaatcgtagtgtaattacactgtaacttgcatataattacactgtatatgtaactttcaaaaatctctccgtaacatgttatttcggtaaaatggaggtcatagaaacaaattctttcatatatgtgtgtgctatgatttgttttttttctcaccaaaacaaatcttgtaatagatctaatgattcaaaattatgtgaaacttacgtaagttacactatagttacatgcaagttacagtgtaattacatataagttacagtgtaattacactacgattgtactataattacatctgtcaaatttttgaggaaaaatttgtcgacagatgtataggcagtcccctaccaaatttacctgaaaaattaatccatcaaattatacacttcggcaaaaggaaaaaaaaaaaaaagaacgcagagcccagccctggtccagatctttttcacgttggcgatctgggcattcggtcgtgagggaaacgaattctgacttagatatataaacacgtacgcacgttttctcgtacacctaatctaaaccgtatacagaatatagattgtatctatggcctttttcatggaaagttggaaaccatcatggttgagcacgaggcaaaccatcgccggcgagatccatctgatcacggcggcggcggcggcggtaacgacctgatcggctacctctgtgacgacgtccttgtacatgtcctcagctccctgcccaccatcaccgtatcaccaggtacatcgtcagccgttcgatgacgcctaatggacggttgagatttaaatcctatacttttcgggtaatttatccttgagaaggtatcttgtaccatattttctaagaaattttaaagttcttgataaagcaccttaatatacctaaaatttacactaatttttttataccttaagatacttattagaacctatagataccaaatttttacaccaaaattttacactaaaataagtactactaaaatttatagtatgaaatcttcgtacctccaggtactctaaagcactataaaaaaaaaccaggtgttccatgatgaaatcgtgcgcaaattggttacttttgttgtggtctcgtgga

SEQ ID NO: 68973 - DNA, 22959 bp, Oryza sativa
ggaggccgccatgtactcggcttcgcagctggacagggccaccacctgctgcttgaccgactgccagctaacgaggcactcgccgaggaagaagataatcccgctcgtggagaaccacgaccaaggaccacaaagacttatccatcaccgagggcgtggaatgccaagttggattccacgctcaagtggatgggcttcgagcaaagcccgcacgaggcggccatctaccggcggggcaatggagaaaatgccttgctggtaggtgtctacgtcgacgactttgtgatcaccggcaccaaggatgcggaggtcgcggcgttcaaggaggagatgaaggccaccttccagatgagtgatctatggcctctctttctacctggggattgtggtgcaccaggacgactccgggatcacgcttcgacagaccgcctacgccaagcgcgtcgttgagctggctgggctcaccgattgcaacccagctctcactccgatggaggagagactgaagctgagccgcgatagcacgacggaggaagtggatgctacacaatactggcgtcttgtggggagcctgctacctcacccacacacggctggacttggccttctccgtcggctacgtcaatcggttcatgcagcgaccgacgacggagcaccagcaggctgtgaacaggatcattcgctatgttgcggggactctcgaccacggtctctactacccgaggtgtcctagcaaggcacacttcgtgggtacagcgaccacgctggcgacatcgacaccagcaagagcacaagcgggattctcttcttccacggcgagtgcctcgttagctggcagtcggtcaagcagcaggtggtggccctatccagccgcgaggccgagtacatggcggcctccgccgctttgacccaggcgctctggcttgctcgactgcttagtgatctcctcggcagagacactggagcggtggagctcagggtggatagcaagtcccccctggccatggcaaaaaaccctgtttttcacgaacggagcaaccacatccgggtgaggtaccccacttcatccgagggcttacttggaagggagcatcaaggcgagctacatcaacaccaaggaccagcttgcggacttgctcaccaagcctcttgggaggatcaagttcctcgagctctactccaggatcgggatggcccaacttccccacaagacgacgcacaagacttagggggagaatgatggataagtctttgtggtccttggtcgtggttcttccttttcttttgagtagtttcaccttttcaggacagcatctacttctttagcatattttcagttgctaggacagctgcggttagtaggacagcagcagttagcatcttctttatacctcctttatgctttattcaatttggatgccctctaggacagcatcccattcaaatttcgaattttagactaggagagtgcagcgataggcttgcagccagctatggctatatatatatgtatccaacctctctcgggtaggtatggctttgagtttgtgaatgaagaaaactggaaaattgccccatcctgagtgccatcctcttctcaatgagagtaaccattgaaattctaacactcggtgcctgccgcaagctgtagagagccttgtgcaagcgtagcaccttgcattccttgccggggatcacaaatcccggcggctggtgcacgtagacctcctcaagtcgccgttcagaaacaccgacttgacgtccatgtgatggacgccccagccttcctgagcagccagcgcaaggagtcgcacggactccatccgtgccacgggagcgaaggcatcgtcatagtcgatcccctcctgctgcacgaaaccgcgtgccaccaagcgagccttttgcttgacgatggctccggcttcatcctcttcagcttgaacacccacttaagggtgatcgcacggtgaccacgagggaggtcagcaagctcccaggtgcggttctcctgaaccgcgtccatctccgacggcatcgcggcacgccatgccgcgtgtttctcggcctctgcgaaagaccgaggctcaccgtcgtcgcacgcaaggtgcaactgcgcctccaggtcgcgaggcaccagtcccggcaccggctggtcgccgagaagatcctccatcgtacggcaccgtagctgctcgccgtcgtggtacgcatcgatgcactccccgtcgtgggagagcggagtagcgaactccaccgggctgcactcaacacgagctggcgtcggagtagacgtgcccggaggagtggctgttggtgctggagcgcgtggtgtcgccggctgtggtggtgtcggcgaagagctcgtcgtagtcgaagtcgtggcccgagggtgtgttagtgtcggagttcggtggaggctcgggaactggggtagacacgctcggtgaagaagagctgcctgctcccctagctccctcgaagtggacgtactcgacggtgaagtcgtcgtacgtcggagtcgaaccatcgtccactgccttgtcccatacccaccctcgcccttcgtagaacactacgtcgcgcgctgtgcgcacacgctatctccgggtcgaggatgcggtaggccttcgagccctccgcgtagccgatgaacacccctggggtgctcctgtcgtcgagcttgccgatgtggccaagctccttgacgaacacgaggcagccgaagatccgtaggtgggagactgccagcttgcgcccatgccaagcctcgtatagtgtcctgccatcaagggccttagtaggcaagcggttgaggatgtagacggccgtcaccaccgcctctccccagaagatggccggcatccctctctgcttgagagcccgagccatccccacaaccatctggttgcgccactcgacgacgccgttctgctgcgggctgtacagcacagtgtagtggcgctgaatgccctcatcagcgcagtacaacgcgaattcagcggccgtgaattcgccgccgttgtcggtgcgtagcacgcgcagcttgcagccgcactccacctctgcagcagcctgtgcgcgcctgatggcgtctgcagcctctcccttgctgccgaggaccatcacccacatgtagcgggagaggtcgtcgacaagcagcaggaagtaacgtcgtcctcctggtgtggccggtgtcactgggccacacaagtccccgtgcacgagctcgagccgctccttggctcggaaactcgtctgctggggaaaggggagccgcctctgcttcgttaggacgcagacgtcgcagagctgctccacgtggtcaaggcacggcaggcctcgcaccatctccttggcgctgagccgcttcagggcctcaaagtggaggtgcccgaaacgctcgtgcctctgccacgcctcgtcccgacgagcggcgaggcaaactggttgtgcgacctgcgcactgaggatgtagagtcgattagtgcctctggttaccaagaaggtgacggcggcgatcccaaatcctcatgactccgtgctcgaccaacacgcgtgagccgttctcatccagctgccccacgctgatgatagagttcctcaacacggggatgtagtagactccggtgagcagcctgtgctcaccggacttggcggtgaaggtgacggagccgacgcccttgatctccacgcgggaggcgtccctaaacttgacggagcctcggacgctagggtcaagctcggtgaagaactcccgtcggccggtcatgtgatgggtggagccggtgtcgaggtaccacccatcacccttgtcgttgctggagccgttgcagagggagacgagtaccttcggctcatcaaggtggaggaaagcctctgcggccggtgccgctggaggtagctcgatgcttgcgtgtgccaggagcagagccggctcttcctccacctgtgcgacgtggacctggccacgtcgtggctgtcaagagtctttggcccaatggccaagcttgccacagttgcggcaggtgtcgtctcgtgtcggcttgtggttgccggcggcggcgccctgggcacctctgcgagcaccaccctcggcgcgtcttcgcggccaccgcagctggacacctccacgcgccttgcgcggcttgcggccgcctgtcgagggagaagactcccccttcctcccgtcactctgagaggcatcccactgctcccgagtgagatggagcttcccgccgatggtgataggccccaagagaggttgtggctcatcaccatcgacgaccttgaggcgacctaacgcctccttgatcgacatcgtggagaggtccagcagactcgatcgagcgagcgatctgcctatacttctctgggacgcaacggaagagcttctcgacagttctctcctcatcgtaggagtcgtcgtcgtactgcaccatcttctgcaaaagagtgttgagacggagggcaaagtcatcaacatcctcacctggcttgaagaccaggttctcccactccttgcggagtgcctgcagtgtggacttgcgggcgcgggcgctgccgatgcgtgccgcatcgatggcgtcctaggcctccttggcagtccgcttctaggaaagcgagaaccgcatctcgggagggactgcggtgatgagggcatccagtgcccgccgatcttcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtttggacaccgtggtagccatagcgccggtcaggggagggagagtcgcactgcctgcgatggccgcgctctccgtcgaaccagccacctccaccgggagcgccgccgccacgcgcgcgctccgggctgccgccggcactcccgcgcccatctgggttcccgtcgacaggcgcgcggtcccttgggccgccgccgccgccgtgggggtgggctgctgcccaccgctctgcccgctcccgcgcccttcctcttgccagctcctcaagctccctgtcggcggtgatgtcgctggcgatggagccgttgatgctgctgcgcaaggtctcaacctctacctccgccgcacgtgccacatcttccgccgcctctgcttccgcctccaccctggctgctgccaactccgctaccgccagtctggccgccctccctgctgctgctacggtctgagccgttgctcgcctgcgcttttctgttgcggcgagctcggcgtcttgctgacgccgagtgctcgatgcgaccgaacgccgagaccgaacgtccgacatggcgcgcctccggggggctgctgcgtggagagggggaagggaaaggggaaggagtagccggtgctgctcctgctggctgagagctcaaccgagcttgggaaggggtggaacaagagatgtttagcctacaggaaagtgtggctctgataccagatgttagaatttcaatgattactctcattgagaagaggatggcactcaggatgggggcaattttccggttttcttcattcacaaactcaaagccatacctacccgagggaggttggatacatatatatagccatagctggctgcaagcctattgttgcaccctcctcgtctaaaattcgaaatttgaatgggatgttgtcctagagggcatccaaactgaataaagcataaaggaggcataaaggagatgctaactgctgttgtcctactaaccgcagctgtcctagcaactgaaaatatgctaaaggagtagatgctgtcctgaaaaggtgaaactacccaaaagaaaaggaagaaccacgaccaaggaccacaaagacttatccatcacgggaagcatatagctgaatccccatttttaagagataaacagcaattttcagaactcaatcagttcaactagattaacagttttacatgtaagaattcagcattcacaaagttttgctagcccatgattattgtttttcagataataaaatacatgcataagaatttctgacacaaaatgctatggatttgacataggatagggaagactgggggatagggcaccccgctctctacgagggccagaagagcttctccccatcatgatagaggctatgaggaatactgaattaaactttgtagattcattgcttatttcataatggattgcatgggcccttttatagggaggatgtcagtgctacataaaccataaattgtcactcgggaatgcttcctagtaaaccatatatttaacttccctaactaacagtgaggatatgtcataggtaggggccgaggggtcgaggcccatgggcccaacccctggcgagtgaacagtacccgcggtactgtagcagtaggttgggtgataggataggattaagaaatagataaatctagattagatcaagttagttacctaggggttaagtttctccatctatataaggatgggactatatcgttattctaattaagcaatgaatcaagattagtctcccctaacctaagtccccctctcatccctagcagccgtcaccgcccggctatcctcccagtggtgtttatcacctatgaaccataacccataataggataacaataaactaattcatatgcactaatcccaatgtaacacaaactaacaagattgatggccttaaagtaacgaagtatttaagcaagttacagtactgaaataaaaagcaataagcaatgctactaggtggacataactatcatcctgtatatatgtgagcaagtgtccaacctaaggaatattccaattagactacaaagatttgagtcagtgatatcaaacttcaaacctcccttaattattacatttctcatgttcctagaatgcaaatgagagaaccaaaaaaaagcttgcatgcaaattacagcaaagagagagatagagagagagacagacacacacacacacacatagagacagagagagagagagagagagagtcaggtgttaatccatgccaactgttccaaacgaaaagagtcagcagcagaggctcaaagggcggtggtggctggcactatggtttgagagataagcgtgcagtgatgtgcagtagccctggcggtgggaagtggtggacagctggatattgggctgcctcttttcctttatttttttctctcttgcatttataaatagcaccataatttattcaacgaccaaggctcattggcacggatttatttgggttgcctccggtatcccaggctatcatcacaaagaatactactctagtttgacccaaagttttagccacccataacccaaatccctcaaacccattcctcaacccaggttcctggtgctggtggctttgatctatctgctctgcgaactgtagttgcgcaataatctatttaactcacgagatatgcaaagagaagtgcaatattgatagtcccccaaaaacacgaaagttacaaatacaaacatcatgtctagtcccatttcacaatcatgcatataaaatgtaaataacccgataaaacaggaactttcttataaaaagaagtatactgacctactaataataacaaagtaggatatctctacacagatgtagggtagatagcacatataaagtcacatggttctatcaaattagaacttacatctgtttagttccatagaagtacaccagtatcttctttttaacagacgtctggccccactgctctggctcacttatctgcaacattatacaaattcatgggatattaagatgatttcttagtatgtaatctccatgttcattcaaactgatgtgcaagacttaaaataggcactaacaagcctataatagagcagttccacacttccacaggagttatcctttaaccaaaagtaaaccattgtgtggtgacacagcaaaagatcagatcaatacaataaatactatatgcaaagacttgcacggatgttgatgtgattgtcctaagttacatctaattcagaacttagcagcaaagaatgccagatatgatgtgaaacgcaatgttccttgctaatccttgtcctttttttaaaaatgaatccttgttcttttgttgtaatgaaaggacaaatacatcactaaacactgcactgctattcaatacatgtatgtagcctagcccttcataggcctaaacctaataacaaatttagaatttgcaccatgtatatatcgcgcttaaccctaccaatcctggaagaattaattaagcaaaacctacaacaaaagaatcttttaaaaaatagccaaatgttgaaaaggatcgtggctcaaaataaaatcaatcagtgatagatcaaacgaggagaataggagagtaaaggtctactaaatcaaatgctatctgcacatttacgcatcttacaaagtgtatagaatattgctcccattttgcatattagaaaggtcagccttaagtcctcaagcatactaaaccacctcccaatatgagaaaagggtagtctgttcatgccagcctacctgtgtatggtccaaactaaaatcaaattcaacatgcaaggaaatatgtagtgttgtttccctttgctgatgtgcacacaaactaagaaaagcaaacagatagcctatcattttggtttctggtgttcaggcactatgtaagaaaagttagataacaattttaagagaagaaagagtacgattatgattaagtagtgcttttcctaaatagtaaaaggaaacatctcttcattcccaatgaaataatcagaaaatcctcattgaaacttaccgaaggtaactaactattaactcgatgacaaataattaagaataaaagatagaatcacatctgtaaccaacgaatagagtgcaggtaacatgatatcaccctgttcatcctaatcccaagaccatccatgccctaaatcgccggcaacgtcaaatctcagcaataaagcagcagctaaacctagaaattaacaggaaccggggcgaactagatcatatttacagtacaaattatcagttaatctgaagagctcagcaggaagtggcacgaagaaggcttgtttcggtcgaagatccaatctttcttaagtacatgtacctgaaacccccacatacaccaaatcgcagtgacaagcatccgcaaaaccacgaagctagcacggattaacagctaaaatagccgaatcggggtagggagaccatccaagaacctaagatttatcaagaatggacatgccgcgtcccaaaacctggcctcgcacgcccccaaacgaaaccctaacctgctactccccagaatcccctaaccccaaggcaccccccctaagcaaagtatacggccatagatcagagagaagaagagcaagcagccgcgaagcatgctagcctaagaactcaccatggccggccacgccgggaagcccttcatcttagcgagcacgaggtcccccaccttccactgcgccgcggccgccgccgccgccgccgccgccgccgcagcagcagcagcagcagccgcgcgcttcttcctcgccggcgccatatccgccaccacccaaccgtctccaccacaccccccgccgcccaaaccaccggcgatcagcaacccacggggggaggaggaggcgcgcccccaccaccaacgacgacggctaagctaccgccctacgccgccccgcgaggcggccgcgccacaagaggcagcggcgggggcacccggctgccgtcctcctcctcctcctcctctcctcgggctccgcggcggcgatggcggcggcggcatgggagggggagggctgtggcttcgacttggggatttttttttccacttttgtttttctttttttcctccgagttttattcgtgggctttttttttctttctcttggctgctctctctctgcgaagaagagaagagaagggaggagaagagggagggtggggtggcgcagcgtgtgaggtgggtgggtgggtagttcggcggaagaggaagagggagagcgtgggaagggtgaagtgggggtgggggagtggcggtgcgcgtgacgaagaggaagaaagggggttatgtggatggagtggcttgccgccgcttgccatctgcctctgcctgccatttcccattatttcctttttttctcataaaaaattgctgttcttgttaggaggataatagtatctatttgttttgttgcatgtaagtaaattttgcttaaaattcacttaaatttttatacatgcagtatttgtttactatataaattttgttcgtgtagctatttgaaatatcaatatgcgtgctgtccaaatgcactacttggcttatgagcctagttcctcgaggaaatatgggttgttgggttatgtgggatctagagcatatggcacgagtagaaaatgtggagagagattatcatgctcgttagatgtaaacttttgcaggcggtaatttgtatagggaatttgattttctagatgtattttgtgtgcatattatgcacccaaaattgccaatttgttccctttcggataagaattgagatatctcatattctaataaactgattcatattcacaagtgttcaattaatatatcttttatccctatatataatgtgagaaatcaactgctatattaaatttactgctccgtttcctttcaaaaaaaaattactgctccatttggcaaaacaattgtatgatatttgaattattttaagtttatgaagtgtgtatttgatcataattttatattagggagaatagccattatggtccctgaagtttcgctatgagatcattttagtccctgaccattgtccaagcaaacccttaaactttatcatatggacatatatagtcattggcccatcaaaaattgccatgtgggcatgccatgtcatctttcgatacaaatatatgataaaatgcccaatttgcccttacacatatcatagggaaaaaggagagaaagatgaggtaggtgatatttgattgtctctgattatactatattttaagtatttgtggtccaccgaaaatgagacaatcaaatacagtcaagcagtttcagttccactaaaaatgggagcggagctgggtgaagctctctcacaaaataaactagagatgtgtagctggatttagacaactctacaactccactccaaacacaactcctggagctaaatttaggagttagagatgtaccaaatatgcccttaacattgaaatgcaattacgtacatagaaattatttggcatggtaattatatatttagtggctgtagctaatttaactttgtattagcataatccagtgaaaaaagtttgtcatatatccatagtcacattggacaaagttcgtaaatcattttcattatttttgtatggtatatggaagtgtaaattggacatttcgcgacatattttgcatgagaggataacatgacatgttcacgtggcgatttaagtgagcccaaggactatattagcctacatgacaaattataaggactcgtttagacaatatgaatggtcagggaccaaattgatcctggagcaaaacttcaaggatcatgttggctattctccttttatattacatgaagtttacagtaatacatttataagaatatgaaatgatttttgtgccaaatatgttacagtaatgtatctttgtttagttttttggtcattgggatattggaacttatttgccaaaattatacaatatcttttagtatttgattgtctcatttgcattctacgggaggtagtttacggaggaaaacttgagactttctggatattttatttgcaaattccacaccaaaaattgacatgatgtttccttttggacaagaaatgagacatcctatattttaataaattgctaatgtgcaaatattcactttaatttatcttcgtgcatctacataatgtgggcttagccatgagattaaattcactacttcctttgggggagaaaacaatgtttgaattatattaagtcttcatgaatttgaccataatattttttttatattacagtaagtttataataataaagttataagaatatgaacctattttttgggctcaatgagtacctagtactaatggtaacgaaatggattaatggaatggttaagttgatgataagaagtgggagggaagccctaagaggagaggccaaaagcgagtgtttttctctttgtttttatcatatattgatagcaatagttataatctatctattatattataaagatagctcgaaaagaagacactatatttctaaattttatctaggaaaagataataaaatatatgtcgttatatcatggtgagaccaaataaataacactgtatactgatagcaatagttatataaaaagtacaattgcatatgtaggaatagagaataagagttgtatattaaaatataattctatatatgaaaatataagctaagaattgtgtaccgaatccaattgaactagtctgcacaaaagaagtgttgggaatcctctaattatgacaataaagattccacgcatcctatcttactataaagttatcttccattgactccttaagcctaacatgcaaagatgccacatcatcatccactaacaagatgccacatcatccattaacaaaatgccacatcatcatccactaacaatcatcacatttaaacattatgcaaacatgctatatctttatagtttttataatttaagagcttttcaaatacaaacatgttaagttatcatccaacataattcacataatgtttcaatgtatatctttattatgttttatgatatcctatatacttatatagattatcctcacttagttagtgctcctatcttactataaagttatccctcactaactccttaagcttaacatgcaaatatgccacatcatcatccactaataagatgctacatcatcattcactaattaacaagatgtcacatcatcatccactaacaataatcacatttaaacatcatgcaaacatgctatatctttatagtttttataatttaagagctttttaaatacaaacatgttaaattatcattcaacataattcacataatatttcaatgtatatctttattatgttttatgatatcccatatacttatatagtttatcctcacttagttagtgcttatatgattaatctatggtccaaatagaattatctttctccttttttcctcaaattaagtcatatcacatcaattgtttttagccttttagatgattaatctatagtccaaactatctccctacttttcttcttctataaagtcataccaccttactttttacgtttgattcactattctacatactatttaaatttaaattattataaaccacattaatttacttaatatgatattatctagctatcttacatgttattttttttattgttatcatactaaattcccgcagcaatgcgcggggtttcacctagtaacaagaatgcttgttcacaaagaataacattatccctaactggttgataaagattttagtagtataatatgtgaaggaaaaatcaatagattgatattacctctttaaaatattcattccttagtgaattaagtctttgtcatgatcagggtccctcttaccgttttcggcgcggttaccggaccacgcgtgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtcgggttgcgtttgctccggccccgagggccggggcacccccgaccccttaaagaagtctgcgccacgtatatgggataagtgagcacagctgtgctcacctaacagcatttattgcagtctggtcaagcgtgtcacgctgcatgcaacgcagtacagcacgctcttttatccggtctgtgaccggtcacagaccggtcagatcaagggtcaggtggcgactggcggtctgacgcacgccttgccccatcccgtcaagacgaaagcctctaggcactcgtctcaagccggagctagcgtgttatttcttagagatggcacgttagccctggttaaatgaataccaggcttcatcctaaccattacaggcaaggcgttacacgaagaagggcaaacatgcacgttgttaaaccgacgcgtggtggacaagaatgaccggtctgacactggtcgcatcagcaacgggcagccacgatcccacgttgcacctgtctccgtcgggagtggaggcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatttagaaaggggttggttggttggttgattttttcccggattgagagctgagaacgggggagaagtcagctgacactttgtgactcgttcatacacagatccaccaaaacacaggagtagggtattacgcttcgcagcggcccgaacctgtatacatcgccgtgtctcgtgtttcttccgggcagacgatctttacacatacagagagagagagagcttgagatctcaccctaagcccccggccgaatcagcaaaggggggcctgcgcggtctcccggtgaggggccacgagctccgtcatctggcgcgccaggtagggggctcagcgtgtgttttctgagctctcagactcttccgtgggagccaagtttttcttgttcagcctaatggccgagcaaggagaagcgcacgacctctctccgagtgtgagcggcgacgacggggagccgaatccacgccgtcgagctcgtactcccccacctcctccgcgccaaagccctaagcagggggaggcgcttgagaaggtcgacaagtccatggcatcaccagttgcgggtggtgcaggaggacggcaagatggggagcgccgcctcctcgtctacggcgacggcagcacgcctcagggtgcgcttcaggctgctggcgcgctcttacgacacccacctgtcgtccatgacccggagtctccagcccaacgatggctggaagatgtggccaacttggtcatgacggctcagcagcgcttgggtgctggtggacggtccgccaccaccaagacctccggcgccgccaccaccggttccgtgtcatcaaggcggagggcgcggcgagcggcggcggctgcacgtcattcggctgctactccctcgtcgacgccttcgactcgggaggatcagcatggggagccggatgcccgcctcaacatcgagcgccggcgtaatagccggcgtaccccccgtgcaacggagggtgcctcctcgtccagagtgtcacctcgacatggacgtgaagatcagccctccgtgcctccggctggtggtgttggctgtagagcctttgtggcgagtcttcggaatgtccgttggcccccaaggttccggcccgccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatttacgcgttcagggggggtgtgcggcacaaccgcatgctcgaaaagattgcctccaaagagccccagactaccgcggaactttttcagctcgcggaccgagtggctcgtaaggaggaagcgtggacatggaactcctccggttccggagtggcagcttcggccgcccccggatccaccgctcagacagggcggcgtgacaggaggaggaagaagaggtcggaccgttccggcgacgagggtcatgtcctcgccgtcgagggcactccgcgggccacccgaaaggggaggcctgcgagcgacaaaaagaaagaggctggtactcccagcagggagcgtcccgccggcaggtggtgctccgtccacaacacctccctccacgatctcgcggactgtcgcgcagtcaaaattttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctgaccatggcccctactcatgaggcgatgcgtcgggcgcggtggtcggaggtcgctctcactttcgaccagaccgaccacccaccgtgcgttgcccggggagggcaggttgcgatggtggtttcccccaccatctgcaatgtgaagttggggcgtgtcctcatagatggaggagcggctctcaacattctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtaagcttcgatgtggcggacctcagtctgccctacaacgcggtcctcgggaggcccgcgttggtgaagttcatggcggcggtccattatgcctacctccagatgaagatgccgggccctggtggccccatctctgtccgtggcgaccttaaagtcgcgcttgcttgcatggagcagcgcgcggaccacctcgctgccgcgaccaagcccgagggtggtgacgagaggcttggcacctctgcccccaccgccccgaggcagcggatcgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgtctcgcatagatcagatcgtcgactccactgcggggtgcgaccttttgtgttttctagatgcatactctggttatcatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccctagcaaacttagggatgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagtccctgctactttacttagcagcgaccccccaagtagttagtgcagcgttggttgtggagcgcgatgaggacaatcctcattctgcgcacccccactctgtgccgacttggcccaggagcaggcagggaggagaggcccccgagtcaaacggtggcctaaggcccctgacgaccggagacggccctctgcccgcttgtcaaacggtgctgggtgtccccgaccctcaggaaggccccgaggccactgcgggaaggccgcacttaacgccctttgaccccgaggctaaccctgtgctgagccgacccgggaaagagcagggagaagaggcccccgagccgaacggaggccagaggcccctgacgaccggagttggccctttgcccgcttgtccgacgatgccaggagcccccgacccccaggacggccccgaggccactgtgggaaggccgctcctgtcgtcctccgaccccgaggtcatcggcacagaagacgagtgcgccccaaggggccacttggacgaagaacgccccgggggtacggcccctagcaaagaggatcggccccaccgaagggtgcagcggcctgtctactttgttagtgaggccctccgggacgccaagacccgatacccacaggcccagaagatgctttatgctattctgatggcctcgaggaaactgcgccattatttccaggcgcatcgggtcactgtggttacgtcttaccccctcggtcaaatcttgcataatcgagagggtacagggcgagtggtaaaatgggcaatcgagctttctgagttcgatctgcactttgaaccacgccacgctatcaagagccaggccctcgccgattttgtggcagagtggaccccggctccagagaccgtctcaatgcccgaggccagtgcgaacccctcacagctgcctcatgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccgggctcagggtggcagccgggctggggatccgccgcctcctggtgttaggcgactctcagctggttgttaaccaagtctgtaaggagtaccggtgctccgacccgcagatggacgcctacgtgcgccaagtacggcgtatggagcgccattttgacgggatagagcttcggcatgtgcccagacgggataatgtgattgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtcaaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgcagacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatatgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgaactcttcggcgactactgcgaaaacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcttgcggcgctaccatcagcgccacgtccgggcccgatcactctgcgtcgacgacctcgtcttacgccgcgtccaaacgcgtgctggattgagcaaactctcaccaatgtgggagggtccgtatcgagtgatcggtgtcccccggccgggctcggtacggctggccacgggcgacggcacggagctgccaaacccgtggaacattgaacaccttcgtcgcttctacccctgaaggggggggtcgggtgtcaggttttggctcgggctaaccccacacccccctcgggtgtgccgggttagccgggggctaccacacatgcacatatattcctttttcctttatttcagcatttcaatagaagcagtttcaattttctaaaggttgtgtctgagccgttttttccttttgaggaatcttgacttgaaataatgtcattcgtgctcaaccccaccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactggccccgacccgagccattcgaggactgggacttgggcacgagcccttatttcaagctaaggcgcaaaaggaccatggcacagatcatcctcatcgcatatgtatagcaaaataaaactaacacaaaaattttttcatcatttcgtttctgattgcagattgagttaatttatacaaaaaagaggcatgaaggccttagaagaaagaaaaagaaaaaaagtaaagattggcgggggctcgggggctcattccgatgcgcccgggtagccggcctcgtcgccaccgtcatcctcaccgctggcgtcgccctcctcgtcggagctggagacgaacgcgagccgaggggccgacccctcgaagccgttgacgatgtggtcggcagcatccccgacccgcgcgcgcgcgtcgtcctcggtcccgggagggaactcctccagcgccatccagggagagaaatcggggtcccgggcctggtaactcgctagcacgagttcgaccgccccccgggcgaggtccctcgaggatgacttgatggtcttctcgagctcctcggggagtcgttcgaggacccaggccatcctgttgaggtgcggagcgaggccttccaggttgcaagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgcggagggagaggctgttcgccagccgttgcgtcgtggcctcggcctcctcgagagctcgctcccgctcagcgagtacatcctcgcgaaggcggagcgcggactcctcctcggcgcaggcggcctcgtgcgccgccagcgtcgtctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcaagaaccccttgggcggcgtcgagcttgttcttcagctccgcctcccagctcccgtgttgaaggcggagggagtcctgcgcctcaatcatcgcggtggtggcgacaagggcggctctcgctccttcttcacctctcgggcgatctccgccagcgccgcttgcgggcttcaagctccgagatgtg

SEQ ID NO: 68974 - DNA, 1160 bp, Oryza sativa
gcataggatatattcccttatcccccttataatagttccaaatccccagtttaactgtatgattgttgctgggaactggcgatcctgctgtcactgggaaatgcttttttcttagagacctcccattttagatgttttcaattttttactctatttgctttgtatgtcgaaatctgttgaaattgtaactaaaaacgagaaaataaaatgaaatgtgacaaggactgagcttggtaactgcctcctaccaggccctgtcccaagaaacttgtcctgaaggggccttgctgtcttgaaaacttgttctaggtgaacatcattatatttgttgtaactgttatgtacgtgcaaaactatatatgtattctcttatgtcttttaaggtaaatgaggtgttgtagaaaggtatgaagtattacttcagttttagctgatgatgataaagtgatacttcgcacttagttgttcgctttcacttgaagctttagcttcatgtttgagttgtacaaactagattttgatattgttgagcaatatttttccttgtttgttttgatgtaccagtgttttctttgtttcattttcggacgagtttctaatattttcatgggtaatttattgttttgtaggccctttcctccctgaatgttcgaagactagaatacctgccatacctgaattgcaaaatacctggactactgtttttggttttaaacctgttgaaccttccaagagacaaaaaatcaagtctctgaatatcttgattatccatggcactggtcttctagagaagcggttgcttgcaacaggcactattaaccaagagaacactactggtacaggctaccataccaaattatcatgagaatattccttgaattctcttgttaagattattgtaacaattcaattttatatctcaaacactctttgtgtttatgcagttaatgatatgatggatgctcaaacacatgttgaagcaaccggatcccggacacctgttcatttttcctgtgaattaccagtgggtggtgatcctgatattaagcatcatgatgactctcatcctttagttgggaactccaaaggcttgacacttaatctgccttgtgttcctgaagaaaaaactgcagaattgacatctccagtattagatgttg

SEQ ID NO: 68975 - DNA, 8688 bp, Oryza sativa
atctccatcacctctgggctaaccggtaagaagacaaacaccaacaacccgacagcaaccatgattaagctggggatggcaaatgaccagccccacccaaacttcagcagaaatgcagccagcagtgaaccagatatgttgccgacagaagtgtgtgcattccaaatgcccataatcaatcccctcttgctttttccaaaccagtttccaacaatcgcgacaactgaaggccatccaattgcttggaataaaccggcaatcatctgaatgaccaggaaatagtagaaattgtggatatttagccaatatccagcaccaaaaagggcagtgaacacagcagttccaaacatgccaattgtcaggaagatccttaaatccatgcggtcaccaagatgtccagcaaagaacatcccaacagaataaaccgcaagaaacgccacatctatctcaccaagcaatgctgagccatcaatggtgttaaacggcaaccaaccgatgttaagagtgttttttgtgtgcagtcgtccccatggagaggaccccaactttgtctgtggatcaagcacgctcttaacaatactcggtatcttcctagtcatatgaaagcaagtatacgcgacaaatgtaagcaccaaaacaagtgtctggtacgtccgtagcaccgtaatgcctccgaataatcgaataccaggaggtttcctactcgtcatttcatgagaatgagccatgagaacaccaaggttgctagttactgacaaagcagagacagacttcttggtccaagaatgattaacacctgaaaccatcagaggaggatgtaagtaagacaatggactaattgagacattgagtgcattaatttgtgtttagatagacgatcttagctacacatttatgaaccactactgcatcaagaaagcgatcatgctgttcaaaagacaagaagctactaatccaaaattcagccttacacagtaccaccaatcaagttatccatcattataaatcactgtctaaaaagttatcatgtaaacatgggcaaatttgatgatctaagaacatctcaaatttagtatttcaggaaacaaccaaattggcccatctatttacttggcaatacaaccagtgggccagagtgggaaaaaaaaaggaaatattctgtactcttacttctctagagcaaaccaagatcatgcgtgctacctgagaccttgctgatgcacaaaccactacaagattgtcctcttttttttttctcaaaaagtaggtaaaagctgcctttccagcttccatcttggtgcaaatgcgtcacttagcaggcaaccgacttttccttgactctaacaccatctttttaactattaaccaggacaagtaaaaaggcgaattgacctcaatctcatgaccaattaattatttttttcacaagctccacaaacgcaaacctttaactcccaaacaattccagtttcaacccaatataatcgttactactgaatattgtcgttgaatccacctaataaacttcccaaatcaacgaacaaaacgcataataagaacatctcgtctctgaactctgaactctggactctcctgtctcaaaacattgaccaaatccataaactccccctaaagctaaacccatttagcacgacatacaaaaatccacccaaaaataaccaaactttccctaacaacgaacaccacaaagcaccagattacccccaaaatccgctccacacagtacaaagaacaattttcctttttttaaaaaaaaaatcaagaacagggattggcacctcctccgcgaaggggacgacgatccgcgccgggcgggagagggatcggcgaggcgactagccggaatgcgcaatgggaaggaggaggatgcgtgggttttcaatcaaggagtaggggagaagagaagagaggagaggagttcttgtgctgctcgtggtgagattttttctttttttgccttcttttttttgggtgtttgggtggttcgaaggcttcgagaggggggaaggagggcaatttatttagacgccatgttggcctttttcgtaggtatttacgaccctgcccttggaccatattgccccttctttgcttctctctctttgcaaaggtaaactacgaaattgaccttgacatcaacaaaggctttggatttttgtttactttggagtattcaggtatctgacaccacaaattagcatgtggataatggtatatttgtccctttgtaaaaaaaatgagaaatatattttttggtgaaataagtgggaaattgttttgaaaccaaagtttaacaaggattaacttatcatatatggtattattttctgatggaaaagtttgctttgtcgcatttttttttagaaaaatgccgccataattttttataaagtgatagtttttataagatagtagtataatattttttccgtcccataatataagaaatttcaggtggatgtgacacattctagaaaagtaaatctggacaatggtatatcaccataattactacacatgctttacattaattagttaaactaagacatagagacgctgagagataaatagggagagaacaacatgcattggcatattattgcataagttggtatttcaatttttcatgcgtcttttatttgcttccatggtatctttgaccttaaataaagtactactagtccatatacatagtacttatatttacattaaaaatgaattgactagtattaaagatacggaccatgtgatgcacacgctgaaaattacactgccaacttgtgtagcaggtgcaccgttggccgttgctttctagttgtactagagtttgttccctttcataccaaaattagcccacccaaattttagcaacaataaaatttagcaaagttcaataatgccaaaacttttttttaagaaacatgttagagacacagatgcgctgcactcgcctaagcacattcgaattgaaacattgatccggtatattttgagattgacgaagtcaccgtacgagcgtctcgctatcgatggttatatcatctatcactgagaaaataattagtcataaatgcaagcacccatttttaagtctacaacttgaatctggataggatggttccaaagaaaaaaaatctaaccaattaaactacattcacctagtagtgtagaagtaaatgggtgctgtttgttttgctaccatgccaaatattcttgtatagtgttgtgtagcaaattgttactcccttcataaaaaagcaacctaggttactttttggataaccctatgtccagaaaagagatcacatccccttgtagattattattattttttttttgagcgagggagtaagtcttaaggtatactgggtggagacagacaagtggcagggccgtaaatacgccagtcaagtcaggggcagaatcgggaagcgagagagtagcgtcctgtttgcggccaaaaatcaaatgaaaaccagtcggccaagaaggaaggaggagggtatcccaaggaatattcggttcccgccatgggaattatacctcgcgtgccgtgtgcacgttccttccttccttccttcccgccgcgtcacacgtgtccggctcccagtgggcccccggccccggccacaggagtggccacacggatatggatgcgctatctttaaaacgacgaggtggaatgacttggactttcctcttgatctgatttggatggaatggttttatctgtttatctgttttaaaatgttgctaggaagaatgggatttagattcattgttctaaaataaaaaaaaaatatttatattctagatagcaatattttgcgcataatgaataagattgtcatgcacatgacagagagagaaaaaatggttttgggattgttccgtctgttttcgtgtacaaggaaatttcttgaatataaagagaacaggcagtggtcttttaggattggttgagaactcctccctcctcacgtaaaacggagcaacagattaacatatggtaaattaagtattcactccgtcctaaaataagcgtaaccataagtttccacgtacaacgttgatcgtccgtcttatttaaatttttttatgattatgcgtgacttatgttttttatttttttttaaaaaaaaagttaaataagacggataattaaagttggacacggaaactcatgactacgcttattttgggacggagggagtattaagtttaaatcttgaaaaatagattgatatgattttttacaacaacttttccatagatttttttttctaaaatacaccgtttattagtttgggaaacgtgcgcatggtaaataagtgagtgaggttgggaatctaaagtaaggtcggataaaatacaatgttttaaactgtttgaaaaacatgctaatggaaatagaggaaaaatctttataaagtaagaatggccatagtatttcagaccaaacaacaattcaacccaacccaatttagcacaatcaaacccatgctgaagttaccgggtcgcaggagggaagaaaagcggttgtgaagacacggaagctagccattgtttacaaatgtcacgtctccggtttccttctggacttgtgtatggacacatatgcagcagccacatagtggagtatgtcggaaattgttgaacatgagcgatccaaccaaatactagtattatactatactctctccatattttaatgtgtgacactgttaatttttgaacaatatttgactattcgttatattcaattcattttacaaatataaaaatttatgtcatgcttagaaaatatttgatgataaatcaaatcaaaataaaataaataataattatataattctttttaataagataaatgatgaagcattgataaaaagtcaacgacctcgtacgttacaataagtagattgttcagctagtattttgttgcgtcaagacgtgtgtttcgttctcttggagtcaaattttctggtacgtcctgacatcctgtaaatctcgatcaagactttctttgttcagattgatacgatacattcggatttatttatttattttgttcttctagagctcacatgaagcccactatggttggccacagcgttcacaatctcaataccagatcaaattccgcttaccagtagtaccgaaacccaataaaaccctgttaattatttttttgtcgaaagtttaaaaagttttagtttcattttatttgacataagaaaagcgagtgacttgtgttttcgacttggctgtcgacgtcgttaacaaacgtcatcgacatgacatgatatgtcatggcatggaatccgtttttctattctactaactccgtttctaaataagtgcagttttacactgtttatgtccagcgtttgatcgctcgtcttatttgaattttttctatgattaatatttttgttgttagtagatgataaaatataaatagtattttatgtgtgactaacttttttaaatattttcataaaattttcaaataagtcggatggtcaaaccttcgacacggattctcacagctgcacttattttataagggagatagtattaaaaaaagaaaaaaattggaagcagcgaagaaagcagaagtgggcggcggcggcggcgaggatcagcggcgcgccgctctacggcccgcgttatctggtggggcccacttccagctccacggcggatattctgggaatcatcccctcggaagatgctgatgctcccgtctctccgacgtggacagtaatcacgaaaacaaatgtaccagttttcctccgtctttatttttcatctcctcctatctatttcaaaataaatttactttttttcaaataaacattgcattgaagttacttatttcgtcccaaaatataagtacatactccctccttaaaaaaaaatcaagctaggtggacatgaacttcgttgtcctctgtgtttatcgtcctacgtagtctcatcctcacttacattttctttactagtgaatctaggctatcataataatctaaatacttatattttaggactgatgagtagtaaatagatgattttcttttaataatcactacatgcattggagtttatcctaattaaccgttgcttagtttcccggtctacgtagtagaaattataaggcacaggtcgctcgacttattatcactcttcaggctttaagaattgatttattgaatttttcatcatgcatgtatgccttggatttgactagcaatggatatgtcttaccttaaaagtattgttattgcatcagtcatatatgcttcaacatataaatactctctctaccccaaagtatcatgaactccgtcataaaggccctgtttagttcacacgtaaaattttttcaccctatcacatcgaatgtttaacacatgtatagagtattaaatatagataaaaaaactaattacacaaattacgtgtaaattgcgagacgaatcttttaagcctaattgctacatgatttgataatgtggtgctgcagtaaaaatttactaatgatggattaattaggcttaataaattcgttttgcagtttataggagaaatctgtaatttgttttgttaatagtctacgtttaatacttcaaatgtgtatctgatgtgacacgccaaaaaatttcacccctggatctaaacacagccaaaatctttagccaatactgtgaataactataatgtcatcatcataaagcactttcaaatcgaaaataatctaataatatcatacatatgataattaaactttcatattattagtttattagtaaaagtttataaaaaagtattttaaaattaaaaatatattatattttaggatagatgggtacttttcaagccagcgctattgctagagataacactttgttgtcattgtgttgacagcagctgatgaatattaacatggcgtgtgtagtacgggtgctacaaaagaatcgatcaatcggtcgagtgaattctctggatggatggatacaacacattgcatgcatggtagttgcttcaaagaaatggactcgtcacattcgtcagatagctgccagtgtacagtgtgcatgaaggagatgtgaagatcgatggtggagtgcaagagtgtacactactgtatttttcagaagaacataaaataaagagtgcactccactggaatcgcgagcctgcaatgtagagtatgcgtgttacacattagagatgcttttccttgatggtctccgttttgtacattattagtctttttaatttttaaaagtcaaatttatgtaagtacatgtaatcgagtttatagaaaaacaaagtgccaatatttttaacacccttttaatctaattaaactcagacactcgcatctggctatcagtttaaacttaatctaaagtaaagcaaagcgagagagcagcatttttctccatttaatttagttctagctccatccagggtttaccttatcgtttgggtcggggttatcgccaccccgcggtagcgcgataaccgcgataatcgcacgataattgtctaaaatcgcacaaaaatcacacccaaaaatttgaattcaaaactcgacggtttcgcggtttcaccgcgataatcgcacggtttaccgtgataaccgcgatattcgcacggttatcgcgggctgtgtagctgaaataatgtaaatgtaaaataaatagggtaaaaaaatcaaaaatacggttgaatatgtgtagaaaactataaactgagaataattggaagaatatgcaggatacttaaggcccaatatcctcttcctttttcaatttgtaaactatttttggttttgccctcaaatttgaatttagcttactctatttaaaaaaattcttcaccattagcaattacaaatcaagaactacatccatgaattttttcagtttttttcgatttttttctggaattttgaatttggtcaaaattcatccaaatcatatcgccggtttccctaccgtatccccgtgataatcgcgcgattatcgtgcgataagtaaaaccctggctccatcctgatcatgatagtacaccacttgagtgttaccactagatcgctccttggaagctgaaaccaggatggttggaccacaagctagttgagttggatgaagaaaacagaggccgcatcctgaactcgccctgatctgctctgcttttgttactggattattgtcgcggccatcatatatagcacttggcaattagcaaagcggacacaaaagacaagctcacaacgtgaggccaccacccaaaaccgggggcacgcgagtaccattaagtagttgattagtaaatttcataaaaccacacttattatatggtctaagttacacagaaaaaaaacttatatagatgtaaagtatcatggttttaaagttttgtaaaatcacaccattaactattcggatatatacatatattgagattcaaaatagttgtgctttcatagatgtaacatttatatgattgataaaaacctataaattgaaactgtgatgatagaagttaaaaatacaatagatcaaagtcaaaatgataaataatattatggttacgagtcacgtgtcaaaacccgagtgattttgtgcaacttaggccccgtttggcacagct

SEQ ID NO: 68976 - DNA, 701 bp, Oryza sativa
  unsure (1)..(701): unsure at all n locations
ttttgtaagacttcccttgtgcctacgttcttgtggggatacactacattctacatttcttttgcattctctggtgggtttattttaactataaacagtgacaattatgaaagtacaactctattgagtatcataaatatatatctagtgctttttggcggtaggtctaatcattctgcagtgaatttttgaaacttcttcaaataagagcttcatgttccccnnnnnnnnnnnnnnnnnnncttnnnnnnnnnnnnnnnnnnntttgaagccaggaatgttctatgctcttcctcaaagccctcagctgttcaagcaaatgttgatggtctctggctttgaaaaatattatcagattgcaaggttagtaggtacaacattttgaaggatgtttgtttcttggatataatttttcttccagttatcttacaactctgcatgagttgctctatattctctgttgcataatctcttttcccctgtaacctgtttagctgggttcttgatttttttcctgtttgcatgaatattctcaatataaattgctcactgtacactgctcagttcctggaatatattactccctcactcctaaaattagttaacctagtactacgaatctggacatgagcatgtccagattcgtagtactaggatgtgtcacatcccgcactagggtaacttatttcagaatggaggga

SEQ ID NO: 68977 - DNA, 3593 bp, Oryza sativa
tataccagtaaccatggaaccttgtatgcagctgattattccaggtacagtcatcgatactacacatatgcatattgcccaatatttatgaatgttgctctactgttcattgcccgactcaacatttagttaagagtgctctgttcattttcaaccatccaagacctgagatattcatctctgattgcatgaatctctgatgcagcatctggtaacagcattcggtctctgggttgttgctttgagcaggataagccgagcctaagaacggacaccaaacactgttgaataattcttctttttgtgcttgcatttgtcccatctgtatcatttgcttcttcatgcagccagattgttcgatcagctatgttcatggcgctctcaagaaaagaagctgcaacaaacttgtgcagatccattgaatccctgaaaatgtcatcagtgggacttcttccattaaacatctcaagcaacaatatacctaagctgtaagtatcacctgctctggttactgcagaaccttctccatactctacaatatttgcagttaaagttagtttttcaccgtactaccgacatgtaaaagatacaaagttccagtccaacccccacccatgagggaggaggtggagaaattgtaggatataatacaaaaatataatatttttgacctacctggtgcaatatatccaatggaacctcggattccaattgagctttttgaatattgaaagttctagttgtgcttttggggaggatttttgatatgccaaaatctccaacctttgcactcatgtcttctgcaagaagaatattacttggtttcaggtcacaatgaatgatcggtggctgacaactgttgtgaagataatccagtgcgtccaagatatcaaccacaatgctgagtctctgcagaaaggctcagtgtattgctgggagtgggattgcttgacgtgggatggagccaactatctaagcttccgttgggcatgtactcaaaaactaatgccttgaactcctgaccctgtgggtcaatacttgaacaacacagtgatgatctttgtcagacaccgatggcgaactcttctcaaagcctcacattcagcctgaaagctccttgaagatcctaattgtttaaggtcgaacacttttatggctacaggttcaccctcatcttgtaaagtgcatttataaacagaaccatatcttcctttgccaagcaagtttgcttctgaaaattcattgcttcctcttgataatgcataatatgaaatcctctgatattgttcctctataaccggagatatctcttggctattttgtcttccttttagtttcctgtgctgtaacataatcagaacaatagctgaagctaacaccagaattgctcctgttgttatgaaagctactttaagatatttcatccgttcttttctgtcctttcttacagcaggaattggacatggagccaagtgaagccgaggtattccaccacacaacttgtcgttccctgcaactgatgcatacgtaaggttcctgaaagcaccttcatctggtactttgccttgcaaattattgaaggacacatctaagtgccacagctgtgtcaaattttgtagggtttctgggattgatcctgacaaattgttgtgagctagacacagctgttgcagattgcccatgctaccaatggcattggggatgctaccagaaaacttgttcatggttaggttcagtatggcgatcccttttagttttgtcaaagattgaggtatgcttccttcaaacgagttgctatctagcagcaggtattccagcacctcacaatttcctatactgtcaggtatttgatcagatagctggtttcctgacagttctatactgtttaggttaaccaaggtaccaacttctgatggaatgggtcctgagagagtattatctgacaagattaagaaccaagaaagtgacggcagctcaaaaatttcttttgggaccgaaccgttcagatggtttatggacaaatctagagcaaatagcttctttagcttcccaagggttgcaggtattgggccttccaaatgggcatcgtatgcggctagtatattcaaattggtaagatttccaattactgacggtatgaggcctgacaatctagtgctgtacagagtaattatggccaagtctgctagcttccctatgctctcaggaatcactcctgacaaagaagtggaccctagatcgagcgtgtccaagccaatcaaattgccaatgtctgtggggatgctcccggagacgctattaccacgtaagaagaacttttgaagtgttgtcgacaggttaacaatagagattggcagctgcccaatgaaagaattttctgcgatatctagctgttgcagctgactgcagttggcaagtgaagttataaattcccagcccttcatgttatttgcctcaagtcggttgctagacaaggatagacgcacaagagatttcaaccttcccacggtaggaggcacaaatccactgaatttgttaccatcaaggtatacgtctgtgagtgatgatagattgaataaggaagaggggatgactccgctaaactggttcacagacagaacaaagtgttgcatgttaggtaatttgtcgccaatgttggcgggaatgcttcctttgagcttgttctcatatacttggagaacagtcagttttgacagattccatatggagggcgggaattcgccagagaggctgtttccgtcaagaccaatcttctgcagatttgggatgtttccgaggcttgacgggatcaggcctttcaggtggttgaagtccaactttaggaactcaagcgatgataggtttgctagcgaggctggaatcggccctgtgaagctgttgtttccaagatggagcttctggagccacgtcagtgtgttacccaacttcaccggaatgtggccactaagttggttatagcccagggtcaggtttatcaagctgatgcaggagctcagattatcagggaacgcaccggaaaacgaattgcttccaaggtcgaggatccgtagatgctggaggtggccgaggcttgggggaatctccccgtggagcccattggagctcaggttgaaccaccggaggaaggtgaggtttccgatggcaggagggagcgttccggcgagattactggacggcaggctcagccccaccaccctcgtcggcctatggcggctgcacttgacgccctcccagttgcagaagctggtgctgctgttccatgaggtgagcgtccttgagctgagccccgccttgaaagcgggcagcgtggcctcatcggtgctgccaccggcgatcgtcaggacggagatgagggacagtaatacaagaagcctcatgtggtttctttctttggttccgtctgtgagagagagaggagggagggtctttggagcataacatcagcttacaggctgagatattgctcctatcctatgatcctatttggacatctccagtgtttgcttgacttcattgaccgaatggtctactgttcaatgattacttggctgggactggttgacttgacctaa

SEQ ID NO: 68978 - DNA, 3296 bp, Oryza sativa
aacctcctcctcccgttctctctccttctccgtcttcctcccgagccctaacaaatgcaggcgggggcattggcatcggcgtcgggcagcggcgggcggcggcgacggcaggcgccacggcggcggtgcgcggcaagcacgcgggaggaagatgggcggcgcgcggcgacgacgcgcaaccgatgggggacggcgcgtgcggccgccgggaggtgcactaccgaggcgacgaagctcggcgggcggagggcggcgtgcggccggcggacggctggcggagggcggcgcgcggccggcggagggcagggggtggcgggcggccggcgaagagcggtgggaggtgggcggcgcgcggccggtggagggcagcgcgcgcaggggatgggggtggccggcggagagcggtgggaggtgggcggcgcgcgcaggggatgggggcggccggctgctgggatttttgtttttattttattttcttttttttttgcagatctagagctgaaatgtagccaaacacttttgatgagtgtccaactctaactggagctagctcccactagagtaggagtttggagttaggagttggagtttggagccctaccaaacgagaccttacataataagcttgcataactctttaccctaaactaaaaaacgagctattaaatatacactccgttatagggaacatgtttgacggaattactagaaagtatacaacactctatcctcaaaatttttgaatttgtcacttaaaaatttatgtaaagcataaaactaaaaatacgtttaatttgtgacccacgatgtgttgagatatcaactcctaatgataaccttctgaccaagcaaatgttttccaaaaaaaatacaaatagttactgtcgacgtttgatgtcgtgattccggtatttgcatggtatggggatcgttggtactagggtatacgcgagactgaggtaaaagaaatggagacagggatttttttatgcatgttcgggcccctgaattgtcaggtaataaccctacatcctgttggccgaagccggtattgctcttattcaccataatcacaccagtacaatatttgggatagcctatctaactgttgtcgacatggtggtctgaaggtctgactcgtagttgacaacagggtagtcttcctcctcgaatccgtgcccggcgagatcagagatagcgcaatgtctctcttgtcaatatccggagataccgtaggggactagccgtgcctatctctgaagtcaatatccggcgtcttgtcttggcgtatgttggcttgtgtgttgatcttgtgtgttgatctatggtgggtgtgtggattgtctgttgattgtcccccctctcctcctagggggtcttgtatttatacccataggtgtccccttgtcgaagtagaactagggaaaccaatatggatacaatccgagtagtccttgtcgtttccatatagaactctggttgtctttccttatccggaactcttcctatatccgcaggttgtttccgtataggacatggtatgtggtgggtcctgccgagatttagtcaactactattaggtatgtggtatccataaccctgacagtagcccccgacttcgatgcaaatgaatgaattcgtattctcaaccacgcgcagatcttggagtaactgttatcgagctcatgtgaccgttctcggtgagttcagagataacgttagacttcctttatcagcctcgtgcgggcacctaaagggtttgtctgagtcaatctccgacgtcaaccaagaaagttcagagcatacgactaagtctcccgtcttgctgtaatcgagaatttggattgaagtcaagaaattttatctcgccaggtacaccatctcttcattccgtattccttgacgatatccaccaactgttctcgagtaatcgagaaggcgcagagtctgcgacggagccttgtcaacatttgtcgcactcgccttagtcgatcttggtgtagaaccatagagacatggagtcttcgataatgtcgaatagaattttcctgaaatcaatactcagaaaagaatattagatagaaatagcccccgagtgaacgctcaaagggtgacatgttataatatgtatggaaaattgaaaatcaaatttacagaccaatgttttatatatgagcgtatactcttttaccgacttcgatcagtcagtttgttgagttatacactctccctagcccccagccttgtcgtcggagaatcgttctaggaggataaggctcttggacctttgacctgcctcggttgaacaagcactgatcctagcccccagccgtgaagttggaaaacccaatttccgattacacggcttggttaatacgcacggcaagaactcttacacgaccagatattacatggtcttttgtctctacaggatccgacaaggtcttatccgctctggacgtccccagccgaagttcccttaggttcctcagaggtcttgtcaagacggcataaaaggacattaggataggtttcaacgctaggtgtcttttgtggtaagggatctctgggtaaaacacttggcgatattgtgcacctgatatcacctttgttgaagtagaggtaatgggagaatcgctacacctctggtcaagaaccaggtagtagtcataactcaaccactagaagtaaatgtataagaaatcgctacaatttactggttgaggaccagtgagtaggtgtctctcgatcatttgaagtcgtggtgcgaggactgctgcgttattgctgtagtcgtacctcgaccaatggaagttgcagtgcgggagattgctacgtactggttcgagaaccagcgagcgagtagaatcatctctcgaacaccaatggaagttgcggtgcgggagattgctacgtactggttcgagaaccagcgagcgagtagaatcatctctcgaacaccaatggaagttgcggtgcgggagattgctacgcactggttcgaggaccagcgggcgtgtagaattatctctcggacaccaatggaggttgcggtgggagagattgctacacactggttcgaggaccagcgaacgtgtagaattatctctcggacaccaatggaggttgcggtgcgagagattgctacacactggttcaaggaccagcgaacgtgtagaattatctcccgaacaccaatggaggtgctagagttggtttatatgtgcgtctcatgtggccagcatgactcacacacccaacttgtagcatatccggatgtccattcgcgatcatgt

SEQ ID NO: 68979 - DNA, 7813 bp, Oryza sativa
atggtcatcataacttgacagaaacgccgctgtaactaatattgttgcgtttctgattgcaggtcacataggcgaatatggtttgttgatgatcacaagtctggtgaaataatccttgagtttgatggtagactgaacaaatggggcgtcatcagcttccgttctgatgttaaagtcaagaaattgagtcctggaccgcaggtctctttccctacacaccaggttagttcatacaactatcaataacatatctggaaatatcacttagttaagatgcttctatcttttagcaagatttttcagggtacttcattattttcaaagggctgaaaaaaaactcgtttagctggcctggttcaaaattgctctgattgatgtgattattcttttaaaatgaaaactagtcaattttgaatgaaatgtgtttttattttggctcggctcattaacaagaaattatagaaaaataattttgaagaaagctcgataaaaagctgaccaagctttttcccatccctttattgttgtgctgtttgcagtctggctacatgcctacatcgccctcactacttctgccggtaccgtggatcatgattcatgaaagaggcaaggagaaagcatatgggagaaaatgttctgggattcttctaacagagagatttatcttggatgatcaatagaaaaagacttgctgtcctcaagttcaaggccactagtatcactgtatcaggattcgtatacatgcagtgatgctgtagatggactcaaagctagcagcagcgtagaagatggtgtagatacgtgcctatatgatttatgaattgttcctgttttggattctattgtgccgtctatttagttttattgcccattgatttgcactcgttctgctgtattgtctgtcaatgaaaagttgccggatgttatagaacgtattttctgaagttttagaaaagcttcaactctatagtatatttctaccaggctgtgctgatgcagtgatgcttctgcgagctgagtagctgactgctgttgattgctgatgatttattcggtgctttgagacgatcggcctcatctttcgcttatgcttatactccctccgtattttaatgtatgacgccgttgactttttgacaaacatttgatctttcgtcttattcaaaaaatttatgtaattataatttattttattgttacttgatttatcatcaaatattttttaagcatgacataagtatttttatatttgcataacatttttgaataagacgagtagccaaacgtacgttggttaaaaagtcaacggcgttatacattaaaatatggagcgagtacgtgaaagggcatgtagcctagtggttacaagagcctcagtagcacccgaagtcctgggttcgactccccgtggaagcgaattttccaggatttaacggcgttgtgctttcagtggtaggcgacgtacccgtcgacagcgaggcacctgtggtgacttcatcaatctctccaggatttattaccggcccagtcttcgaagatgctcataggggtgagtgtgcgtgcgttgtgagtgtctgtgttgtactgtgtaattctcaaaaaaaaaaggaggaagtacttatcagtcaaaatttaaattttcgatgttaaatttagagttgattttagagctttttcattaaagtttttttttcacctttgcttttacggcccgtttggttggagggaaattttaggagggattgtgagtttagagggatgaggctattaagagcatgcccaacagattacttattctattccctatcctcgaattaaagaaattttaaccaaaattctcatccaacagattccctaacctacctcccaataatgcaggttcccatatccgtatatctcgttactcatttgcagggaaccactttttcttcccaatcgcggtggtcgctgcttcgcgcgcgtagggggaaaatgttcccacgctccttttctcgccctactcaccagcaacaaaattcctcttcctcccaggcgtcagcggcggctttccaggcggcgaagcaacggccaaccccttcctcgcaggcgtcgtcgacggagttccacgtggagatgcagcagtcgtccccttcctctcagtcacaggggttggcgtcgatgttgctccaggcagcgatgtagcggccatacccctcctctcaggcgcaggcgccggcgttgctccaggcggctatgcagccgccgtcctcttcctcgcaggtgtcggcgtcggcgttgttccagggggtgcccgcacgtcgaccaccgctgccggcgcaagccccaccacctcctcgatttggggccgacggccctctgcgccccgcaccgctgcctcgccgtcgtcttcctcaacctccctactccagtatgcaggcgagagagtccatggggggacatgctccatgggagacactgaatcccctctcatacgaagctcctggcatcgatttctccacagcttattctgtgtgtgatgaagaattcctccatatgagcaatttcggtaaggctgtccctgattcgttcgatgtttagattaattttcagagtgttgcagcctgatctgatgtccattctatgactgacttccccggctagaattcaggaattcaggattcagaacacttagaggaaaatgtcagaaagtctgaaatttgtaccgtatcgaatggaagtctgaaatatgcaggatatgctctaaatctgaaagtctgaacacttataggaaatcaggtttcagaatatttagtaatgaaggatatgctctaaatgtgtggtatgctctgaaagtctgaaatatgctgtcaaatatttttgctatgtcaaatgtactcccaaagtctgaaatatgctctgaaagtttgaaatatttttctctcatcacagcatctttgaaatatgctctgaatttttgcattaagataatgttgttagataatttgatagataatgcaacaagatgcagtccatagtctatttttcaagataaaagaaccacctgcttttgccaatcagactttcagtttcatgaaagctgcaactacagaattataagtacaacaacataagtttagtaggattataataacttatacagttcttagctctaagtacaacagctgcttaattgaagtgatcatctgcatttagtatgcctcactttttagattagcagatgaacaaccacatgcttgtgccaaatattgaaaatagtgtctgaaagatgcaatttcagtatgtatgtgcctaatcactcactgtcgctgacatttattcttctttagttcccttctctgatgccatcatagacagtatgtgctctgaaatattgagaaactacttgctctgaatttttgctatgctctgaaagtatacaagtctgctttttttttttcctcaagtacatgctaacaaggttccccgattaattactgcatgacctataacagatccaccacgctttggaacttcatcatcgtcgaactcaccgtgcactatatcaaccgccgaagaaataaattcttcgtcaccatccgatgaaaactcatccaatagcatttggaggagggtgcttcgacgactcatctcctctttttgtttgccacggtgttggagcgtttaccacagggatgaagtgcaatggagggaactgatggcaggaatagaacaataatcaatctgcaaaattaattatcagatcaaacttaatattttccaacaatatatatccacatcaaaatactgacatagagattgactacggcacaagagattaatgggatttgctaaggattacctccttgatgacacgaattgctacgacatctccttggtgttccgttttttaacaaatcgcagcagtcaggacactggttggctggctggtgatgatggcgctaggtcacggcggcgcaagtgtggggaggaagaagtcgatcggcgctggtgcgggagggagaagacgtgcgcaagtaccgaactgggccccaccttgcttatgtggcaaactaacaaatgatagggaattgatttttgggcttctcttggaggagggggtcattgttgggcccaatttttattttggtattcctaattcagattttttgggaatcaaatattgggtgattgttgggcatgctctaagtgatttgtttggttgggagacatggaaaatttagtgggatagggatggtgaattgaggaaggaactccctccttttcaatacctgggtaggggcaggtaattgggagggaattcctcctttactttttctaagcaaatctgagccatctgtttttattaatgacttaatctccaactaaactccctatcaatttccattacctctaccaaacaagatattgagattaaaaatcaaattcccatcttaatctcattatcaattccctcgtgtaaactcccaatctccttccctcgagttaccaaacaagccgttagatcactaagaatacgtatataaaagttttattcacaaattttttccatttacaaatatgccgatgggtcctggtgatttacttaacaaatgtttgattagatcttcagttttatatacaaattcgttttgtctaaacagataaaattgacttattaatcttgggaaggccgttactcactctagactttactcctccttatctttttttttcttgaacgaacatttcatttcttatatttttgcatagtttttttaaggtagttatagacaaaagtgataatgattgggcttctaaataatgggtaagacttgtctccaacaagtgacccataagggcacctaaatctaaaatgggtttccgatagtattatttcagcctccaacagagtacctatacagaagacctattttacgtgctataagaggcataacctaaatctgagtatcctctctcctgaagacctatttgcagtaagggttctcttttaggccttattgttggagaagaccaaaaataggtattgaactcttttactgtagcgctatgcaaacgtgaaatgagtcttgtattttgggtttcattgttggagatagcctaaccaccacgcgccggaagccaaacccagttctccccgttcccgcctacattttcgccacgtcagcgatccgcaccgaaatgcatcgcagccgtttacggaaacagcatcgaacgtcacacgttcgtccacgttatcgatccgtggggaaaccactccaccaatcagcgcccacctcaagttcgctataaagtcgtcgcccccgtccccattctcttccccacatcgcagtcttgcaaacacacgcagcaaaatccacaccgcttcccctccccgagaagaagagagcagcatccatggcgcccaaggcggagaagaagccggccgcgaagaagcccgcggaggaggagcccgcggcggagaaggccgagaaggccccggcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggtccaccccgacatcggcatctcctccaaggccatgtccatcatgaactccttcatcaacgacatcttcgagaagctcgccgccgaggccgccaagctcgcccgctacaacaagaagcccaccatcacctcccgggagatccagaccgccgtccgcctcgtcctccccggcgagcttgccaagcacgccgtctccgagggcaccaaggccgtcaccaagttcacttcctcttaggctgcacctggtgctattgtgctagtagtaatattagtttgatctatttatctactagctgtagtgcatcaatgatgggaaatggatgttggggatttagtgactgtaagaagaattaggtggggctgcttttgaggaacttctgtttcatggattcgaaatacactagtaatgcttttgtatcatgtgaatatgtgatctctcctatgttgtctttggttgccttgtgctgaacttgtgtttgttttaattaatttatgtctaattttggggaactaatctttgtgttgtagtaactatttgcattgtcttgcaaattcctcgtcatgttaccggaattgattctggagcatgcatgtttggagtttggaactgctgatgtgctcatgtagacgttattatggaagattgctattatttttgtttctgattaccttaattagctaatgtcactggccacaagacgaatttcactgggctccttttggggaactttttttttttctcatggatcaggaatactctttgatttccttgtgcttgaaggtgaactagtgatgcttatgtctagttttgtggaattaatcttcatgctattgctatttttcattgtctagcaaatcatcaaatccctctgcttgttactggaattttatttcttgagcatctattttggagtttggtactgctcgttggattatgttagttttagatttatggactggcactacttttgtactttggaccgtttgtggactgagcatttggagttcatgatgtttgcattcgaaacaaaacagaggttgttagaagagattagaactttgaaaattgtagtaaactttgttttagcttcgtctggtactaattcaaagaaatctaactcaagtggaaatagtactgaaactccacatatattgcctttgctatttcactatttcaggattatgcatgcctgcccgtttgctacatttctgtcctgaatgtcttatggaggttcctctgttgaagattagctaacaacaaatatgaggtatgcatcttttatcaaaccttgctttgggctgttctgttctgtgcaagatgtgctgactgaagagtgaagatgggactcttgtgggacttcttgtaatgcaatccttttattttctattcagggagattatttgaggtgatcaattatctttaaggttctacagggagagcatcctgaatttctgtttggcttgttcaaattaaatattccatgccaaacaactttagctttaactgattactgtggatatgtactagtatctttttctcatgaaaaagctttatagtggctagtacaaatccacagcgactgaaatgatggatctcatatttcttgggtgaacaatccttcattcctatttggttaattgtttgggctattgttcttctattctataattgtcatggatttggtatcctgtgctagaactgtttagatgcgatcttttttgctgctttgtttatgtcgaatctgaaaactggttgcctgggtatttgagtcagggagttaggaaattttgctgctatggttctgtaggtaactaggaattggtattgaattattattggtgctgcgtaacctttatttaacctctaaaatgcacgaccagtaactatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccggcacggtcgggccggcccggcacgatgggccggcaggccaggcccggtacataaagtatggggactaaaaatagacatataaatgtaactgtctaaagaatagggaccttaaatagacttattttagctatttatataccccagc

SEQ ID NO: 68980 - DNA, 3615 bp, Oryza sativa
cattggtacatatatttctctccatacacttgggaatgtctcttgggtgatatgtgggcctcactctcatcttggttcatgtagtagggctccttcactttgcaattactttcctgtataattattggtgtaatcagtgtttgactttttgtgagaaaggcaactaaggaagaaggtcaaaacaatgggcttagtggtaaaaataatgcaggtgggggcccagcacacgttgcacgggcacttgcaatgtggggccgggcttgggccggcagttgatgacggcaggtgctcaagtgtatgggctgggactctttcggttggcaattgccaaaatgaaattttcagcatatgcatggacaataacaatccagggcctaccaacttagtagtatataggagtacttactagccatgggatgcaccaaccatcaaccacggtggtatatgaaaaaaagaaagaagaagaaaagaaagaaagaaaggaggaggttgatgaagttggatcatactacgtgcattatattagaaatatgcccttttcgttttttaaagatgacgccgttaactttttgacacacttttgaccattcatcttattaaaaaaaattatgcaaatgtgtaacatattaaatcatgcttaaaatatttttagtgataaaacaactcacaataaaataaattataattatataatttttttaaataaaatgaatggccaaacatgtgttcataagttaagtcttctattaaaaacgaagatagtacgatagtttggaaggtatcgatatactccgtacacccaagattttatttttatttgagagataatctattctatgctcataagtttactcttgctcaacgatttgacaccaaatttatttctttttataatgtctttcaagtctttcaaaaacaatatctaaaatacacttcaaagcgtaccaggattgcaaacaataaaaatatagagcctaccaacacagtattaatagtactagctatgtggtgacatatgacacaactagtagaatatagtatcatcaaccagggtgtagtgtaacggtatctggaaagaaaggggggaaaaaatagaaaaaggttgatggcgttggatcatcatacgtgcactattgcgtgcgtatggttatcaagtcaaaacgttggtttatactcgtgactacgcttttatcctctcggtatctttataaaaattatgtgtatctcgtggcactgatttgggtgtgttcgcaccttctggttgggaactctccctctctggtacgaaaaacgaagcagtcgtgattaattaagtattagctatttttttaaaaaaaaataaatcaatatgatttttttaaaacaacttttgtatagaaaatttttctaaaaaatacaccatttagtagtttgaaaagcgtgcgcgtggataacgagagagaggagttgggaaaactgtgataagaacacagacacgtttggaatgctgacagcggctggctgatcagccatatcatttggtttataagtaacttaaaaatatatataaaaggtttacctatcatattcacattgcttataagtaacttaaaaaaataatttagagcctcatcggttgctcatattacctaataagtcaaaacggtttatttaggaataaaagaataaaatttaatttataggtaaaacttttatatatttgttcatagtggcttaaaagccaatgctaaaaataaattacttttaaaatcaactttagaatcaaatccagaaatataaattttggcttttattttagcttattaggtcaatcgatgggactcttaataattcaaaactaaatatttcaaaataaactacgaattaaaaagcgtaaataaatattacaaaattaactagcaatttaaaagcgagtataagcaagatgatggaatatttttttcttagtggtgccgaccgtctcatgtttgtggccatacacttgtcgatcgcattgttccccaggcagcgtctcacgtgtcatgtcctacctttttaatttcaccctcactttttttgacatataattgacatataagttaattatcacgaataggtcgacgaggctattccacaacaataaagtacatggaaaaaaaatcgccacgaaattacacggaagcaaccaaaaaaacacaggcagctgaccaccccacaagaactgtatgcaaaacatgttcatcaacatttgcgagcacaggcgaaattccacaagtataacatgccaaaagtccaagacagcaattcagagaagatttagctctaatggcagacaagagtcttacaactttagcataattccatcgagccatggcactcgatggatattggcattgagtcctatgataaaaagagcagcttcaaagcatgcgtaaaagttaaggtcctttctttggtggacaagtcatacatgagtacatgagaccctcgctgctattagcagcacaaggaaacttactattgagataattcatcaaccaaacaaaaactggaaaagtcggtgcagcgcgcagcggattcatccccagcaaatcaccacccatccttcttcagcggcttcattttgccttctccttgtccttgtcggcagcttggggagagaactgctggccggtggaggatggtgagtagcccggtgcagtgggggagtagcttccgctagggctgtacatagggtagataattgagatggtgagaactctaatgaagccttgggttcacaggaaggatagattatgctgaaaaataattttggcccctttgaatcgtaggattgaaaaaacagaggaataggaaaaacacaggattttggtaagaatgcaagtgtaaaacagaggattgcaaaacacataaaaaatataggaatagccgtttgattagaccgcaggaaaaatgcaggaatcagatgagagagatagacttaaggaaagttttccaagagattagagtgaatgttaactttcctacgtttttgctctagaattgtaggaataggaaagtttactacgtttttgctctagaattgtaggaataggaaagtttactcctacgaatcaaaggcatgaatagtgtaggatttcaattcctttgtttttcctccatttttcctccaattcaaagggggcctttacctgtaattcggagatgttgggctataatctgggctgggccctccagatgtggtgtatgggctgaaaacagaaaagagcagcacattagaagtcatctcatcgtctcatatgacaaggaacattaaaggattactgcaatagacttatatggaacttatctggagaataccatatgcctctgccatggcttacagtcataggttattatttatattagttaatcttggcttcatttgaaacaattaactgagaaaattgttgttatttagcatcagtgttttgtatctagaactaactctacatgcataactcgtttcagttttcactcatcagttaacagaagtcgaattgcaactttggtcttttggtctacatgtcaaattgtcaataatggaaaatctttctaacgacatttctaggacggattttggattttgaaccaagg

SEQ ID NO: 68981 - DNA, 1409 bp, Oryza sativa
cagtttctatacgtatggatactgttgttatactaatgtgagtcaagttgggacgaacttgggctcggaatatggtttcttggttgttgcatgtgcaggtgttgcttaaggccttgggagagtgttgccggtgatagatcgtagtcaacttgggagaagttgatgtccagggatcaagagatcatgcgggatactaaaggctagaggacaatgcacgtggtgatgaagaaatccatatggtatacaagaggaattgtgtacgtatggaaagaggagtcgaatttggaagggagtccgaattcgggaagtttgattgagataaggaaagagataagttgtttacttgcaaaagagggtttcctacgtgggttaggagtcctaagttatgttagattcgtgggctttgcacagcctacctcatgtataaatagagagggagggtgaggcctcccggtatcgattgtagagagactagaattgagagcaagttagggttttgagtttagttcgagattttggtgaggagtgttgttggtgcactttgtaaacactagttgatgcaataaagtcaaaaagtttcaatctacatcttcgagtttgtcatctaccggtgtttctgggtcccgatggtctaaccataggtgtacgcgcagtctgactggtgggatagctgcggtctgaccgcaggtgtccgggcggtttgaccagcgaggcgttggcggtctgaccggcggcaggagggcggttcgatcggcggcaataggacttcatcatcgtcttcgttcgagggtaatctttaattgcgcaaagattttcgggtttttggttttccctgccattcacctcccctctggtaggtttgtttggtcttgtgtgatcttacaagtggtatcagagccacgttcttctatttgatctttactggtctttagatttgttgccatggctgaaaagttttcaagcaaacctcatatttacaatggagttgattttgattattggaagaaaaagatggagtcttacattacatctcaaggctatgatatctggatgaaagttgctacagtctatgagattcctggccgtattgaaactgttgcccagaaaactgattttgaaaacaattgtaaagcacgaaatattcttcttagtgggatttctcgttctgattttgatcgtgtttcacatcttgcaactactaaatgcaattaggaacttggtgcaatatcgatctacatatcgaattaaatactcccgtaattctattatatatacagagagctcagtttatttgaatgatcatcatttcatgtgtacacatattatggcacccacctacattattcaaatattttaatatttgataaaataggttaataataacttttcttttatttgattttaatatc

SEQ ID NO: 68982 - DNA, 2550 bp, Oryza sativa
tcctgcagccccggccgattcttggcccaatgtggtgaggcatcggctgttgatgctttgagggtcatattgtttcctttgtctttgtctgggtcgacattcacgtggttttcttcgttgccttataattctgttcatggctgggccaatttggagaaacagtttcatagttacttctacagtgggaaccatgagatgagctttccgatttgacagcagttagacagaggcatgatgaaactatgcaagattacatccagaggttcagagatatgaggaatagatgctatagtttggttttgaccgattcctagttggccgatcttgcattccagggtttgataactccgatcaaggagaagttttcgtctcaagattttgaaagcttgtctcatcttgcacagaaggtagccctacatgagcaaaggtttgcagaggctaagaaaaactttaaaaaggtcaaccatttttatccttatatgtatgaatatgaagaagaatatgactctgaggtagcagcagccgagtgggcgaggagctaaaaggttgtgacatgtcagtgggttaagagtcttggaaaagaggaaaaatatgattttgatatcaccaaggctgacaagatttttgatttgctacttcgggagaaacaaattcaacttcctgctggttatataattccattagctgaggagctaggggagctagggaaaaggaaatattgcaaatggcataattctgggtctcatgctaccaatgattgcaaagttttccggcaacaaatccagttggctattgagggaggaaagattaaattcgatgattcaaagaagccgatgaaggtagatggccatccttttcctgtcaacatgatgcatatgtctgggagagtagtcgatgggggaaaaatcggagttctcagctaaattcagctaggattatcaataaatattaaagaaggcatgataagtagcaggaaaggtattttgagcaagatgatggtggctttgacccacattgggattgtgagatttttaggttttgctggaacgaagggatgagactgccatcgatagaagattgccccaggtgcagtgacaatgcaggggtccaagccgatcttacaatagaggaaatcggctgaatcaaaaaatagtgcctgttcatcagaggttgggtccagtacaccaggatcgttttcaagatgaggatgaagacgggaaatcacatggtgcccttctggtatttttactaagaatcagaagagaagtgtccagaggatgaggaacatggagcgttttcaagaagtgcaacaagaaatcaaccatcggctgaaaaagacaaaacaagaatggcgcattaagagcaaagttatagcaaccgatgaggttgaagccaacaaagcagagtggttgctcaagggcaaagctgttgcatcttcatcggtgaatatggtttttatgttgcctgtggaatatgaggctaaacaagccgatgttgatgtggaggaaacctctactagattgattttgtcaccagagcaagcaatctgtgagaagccagaggggacagaaaatcggcatctcaagccgttgtatgttaacagattcgtcaacgggaagccgatgtccaagatgatggttgatggtggagcggctataaatttgatgccatatgctacattcaggaagctgggtagaaatacaaatgatctcatcaagacaaacatgattctcaaagattttggtggcaatccttcggaaaccaagggagttctaaatgtggagttgacagtaggcagcaaaactgttcctacaacatttttgtcatcgatgggaagggttcctatagcctgttgcttggaagggattggattcatgcaaattgttgtattccttcgaccatgcaccagtgcttgattcaatggcaaggtgacaagattgagatcatgccagccgacaggtcagttaatgttgctagtgccaatttagctctttgggcgatggatgggattgattgcctgtctggaaaagtttgggaaggagattatctaaaagtgtccgattgtgatatacagccaattgaagatggagagcccaaattattactttgaggacgtcgtggagggttcaaatttctacaccaaggacacggtggatgatctcgatggcaagctaggacagggtttcatgttggctgacaatctggaagaagttgatataggtccaggggcgataggccaaggccgacatttatcggtaagaatttatctgcagaattcagaaccaagttgatagagaatttgaaagaatatagagattgctttgcttgggagtattatgagatgccaggactcacctgatcgattgttgaacattggcttcctattaaaccaggatacaaaccatatcagcaacccccaaggagatgtaaagccgatatgtatgatgctatcaaggctgaaattactcatttatattatgctggttttattaggccgtgccgatatgctgagtgggtttccaacatagtcccggtcatcaagtaaaacgg

SEQ ID NO: 68983 - DNA, 658 bp, Oryza sativa
actagggattactgtgagtagactgggatttgtgccgaccaacctacgaaaaattctaggagtgctacacatacaattagagaaggtcctgccttagagcaagtttaataatatagccaactatttgcttcaattcatttataaccaatttaatagcttattcatacaatagttacatactacattattattacctggttccacctgtcatacacacatcgcgtcttaaagtccgtgctatagctggctacaaatctgtagcccactactcttctctctcctcatttatctttttaaaatatatttgcagctagcttataacccgctattgtacctgctcttatcattgaccaccgttttgccgttttggccagatcaaactggtgtggtccgatcaaccgacgtggcacgacggctggggcagcgcaatgattctaccggtgataaatccacatttaaaaaaatcagaaatggaaaaaagtgaaacttatcaaaagcagcaaatctcaagtacaagcaccttttcttcagatagtaaaatcatgagttcgaccacgaagatgggtgcccaatattttcccaaaaatgaaaccgtcgagcttaccgatcactgtttctcatcgatctgtagtagtactccttagtggtgctctgcttg

SEQ ID NO: 68984 - DNA, 37409 bp, Oryza sativa
ttcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattaccctcgccgtccgaagcggcgttaccgtatctccaggcgagacaaatctgctcacccagattcgcgcgctgctcaagtggtgtggcagtcttgaatagaccgcccattatggacaaccaaagttatcaataccaatgtgcatggattgagaccgttgggcattttgcccaactacggagaccggtcccacctgtcaccaggctttaggggtggcgtcacacttgaccgcttcccttgggaaaggaaattgctctggcataacgccgggggctactgtcggtgatatgggaccgggagtatcatgaccagaggcttgaggcagacgcaatcgcccacgtggcctggcaccttcggggacgttgggcccgagggtgaggtgtccgccctcctcgtgatttcccctgaggggggggtcgggttgcgcttgctccggccccgagggccggggcacccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaagggttaggtggcgactggcggtctgacgcacgcctcgccccatcccgtcaagacgaaagcctcaaggcaactcgtctcaagccggagctagcgtgttatctcttagagatggcacgttagccctggttagatttataccaggcttcatcctaatcattacaggcaaggtgttacacgaagaagggcaaacatgcacgttgttaaactgacgcgtggtggacaagaatgaccggtctgacactggtcgcatcagcaacgggcagccacgatctcacgttgcgcccgtctccgccgggagtggaggtaggtgtgagctgtcccatcgaagtgtcatttggacgacaaccataccaatctccgcccattaaagagaagaagaacagtccagtttggaaagggaagggtgcatgtggtatccccttgaagtataaaaggaggaccttgcccatagagaaagggttggttgattcttgccagatttagagcctagagcgggggagaagtgggctctcactttgtagctcattcatacacaaatccacaaaaacacaggagtagggtattacgcttggcagcggcccgaacctgtatacatcggccgtgtctcgtgtgtcttgccggcgagcatctttccacatacagagagagcttgagatcgcaccctaagcccccggccgaaccggcaaaggggggcctgcgcggtctcccggtgaggagccacgagctccgtcatctggcgcgccaggtaggggtctcagcgtgtgctttctgagctctcagactcttccgtgtgccccaagtttttcttgttcagcctaatggccgagcaaggaaaaacgcacgacatctcgccgagtgtgagcggcgacgacggggagccgaatccacgccgtcgagctcgtactcctccacctcctccgcgccaaagtcctaagcagggggaggcgcttgagagggtcgacaaatccgcggcgtcaccagccgcaggtgatgcaggagaacggcgagatggggagcgtcgcctcctcgtctacggcgacggcagcacgcctcagggcgcgcttcaggctgctggcgcgctcctacgacacccgcctgtcgtccatgacccggagtctccagcccaacgatggctggaagacgtggccaacttggtcatgacggctcagcagcgcttgggtgctggtggacggtccgccaccaccaagacctccggcgccgctaccaccggctccgtgtcgtcaaggcggagggcgcggcgagcggcggcggctgcacgtcattcggctgctactccctcgtcgacgccttcgactcgggaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcccccggctggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgataatgagtcgcttcgctcgtacattcagcggttttgccaagtccgcaatactataccatgcatccctgcacacgcggtgatttacgcgttcagggggggtgtgcggcacaaccgcatgctcgaaaagattgcctccaaagagccccagactaccgcggaactttttcagctcgcggaccgagtggctcgtaaggaggaagcgtggacatggaactcctccggttccggagtggcagcttcggccgcccccggatccaccgctcagacagggcggcgtgacaggaggaggaagaagaggtcggaccgttccggcgacgagggtcatgtcctcgccgtcgagggcactccgcgggccacccgaaaggggaggcctgcgagcgacaaaaagaaagaggctggtactcccagcagggagcgtcccgccggcaggtggtgctccgtccacaacacctccctccacgatctcgcggactgtcgcgcagtcaaaattttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctgaccatggcccctactcatgaggcgatgcgtcgggcgcggtggtcggaggtcgctctcactttcgaccagaccgaccacccaccgtgcattgcccggggagggcaggttgcgatggtggtttcccccaccatctgcaacgtgaagttgggacgtgtcctcatagatggaggagcggctctcaacattctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtaagcttcgatgtggcggacctcagtctgccctacaacgcggtcctcgggaggcccgcgttggtgaagttcatggcggcggtccattatgcctacctccagatgaagatgccgggccctggtggccccatctctgtccgtggcgaccttaaagtcgcgcttgcttgcatggagcagcgcgcggaccacctcgctgccgcgaccaagcccgagggtggtgacgagaggcttggcacctctgcccccaccgccccgaggcagcggatcgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgtctcgcatagatcagatcgtcgactccactgcggggtgcgaccttttgtgttttctagatgcatactctggttatcatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccctagcaaacttagggatgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagtccctgctactttacttagcagcgaccccccaagtagttagtgcagcgttggttgtggagcgcgatgaggacaatcctcattctgcgcacccccactctgtgccgacttggcccaggagcaggcagggaggagaggcccccgagtcaaacggtggcctaaggcccctgacgaccggagacggccctctgcccgcttgtcaaacggtgctgggtgtccccgaccctcaggaaggccccgaggccactgcgggaaggccgcacttaacgccctttgaccccgaggctaaccctgtgctgagccgacccgggaaagagcagggagaagaggcccccgagccgaacggaggccagaggcccctgacgaccggagttggccctttgcccgcttgtccgacgatgccaggagcccccgacccccaggacggccccgaggccactgtgggaaggccgctcctgtcgtcctccgaccccgaggtcatcggcacagaagacgagtgcgccccaaggggccacttggacgaagaacgccccgggggtacggcccctagcaaagaggatcggccccaccgaagggtgcagcggcctgtctactttgttagtgaggccctccgggacgccaagacccgatacccacaggcccagaagatgctttatgctattctgatggcctcgaggaaactgcgccattatttccaggcgcatcgggtcactgtggttacgtcttaccccctcggtcaaatcttgcataatcgagagggtacagggcgagtggtaaaatgggcaatcgagctttctgagttcgatctgcactttgaaccacgccacgctatcaagagccaggccctcgccgattttgtggcagagtggaccccggctccagagaccgtctcaatgcccgaggccagtgcgaacccctcacagctgcctcatgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccgggctcagggtggcagccgggctggggatccgccgcctcctggtgttaggcgactctcagctggttgttaaccaagtctgtaaggagtaccggtgctccgacccgcagatggacgcctacgtgcgccaagtacggcgtatggagcgccattttgacgggatagagcttcggcatgtgcccagacgggataatgtgattgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgcagacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatatgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgaactcttcggcgactactgcgaaaacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccgtggaacattgaacaccttcgtcgcttctacccctgaaggggggggtcgggtgtcaggttttggctcgggctaaccccacacccccctcgggtgtgccgggttagccgggggctaccacacatgcacatatattcctttttcctttatttcagcatttcaatagaagcagtttcaattttctaaaggttgtgtctgagccgttttttccttttgaggaatcttgacttgaaataatgtcattcgtgctcaaccccaccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactggccccgacccgagccattcgaggactgggacttgggcacgagcccttatttcaagctaaggcgcaaaaggaccatggcacagatcatcctcatcgcatatgtatagcaaaataaaactaacacaaaaattttttcatcatttcgtttctgattgcagattgagttaatttatacaaaaaagaggcatgaaggccttagaagaaagaaaaagaaaaaaagtaaagattggcgggggctcgggggctcattccgatgcgcccgggtagccggcctcgtcgccaccgtcatcctcaccgctggcgtcgccctcctcgtcggagctggagacgaacgcgagccgaggggccgacccctcgaagccgttgacgatgtggtcggcagcatccccgacccgcgcgcgcgcgtcgtcctcggtcccgggagggaactcctccagcgccatccagggagagaaatcggggtcccgggcctggtaactcgctagcacgagttcgaccgccccccgggcgaggtccctcgaggatgacttgatggtcttctcgagctcctcggggagtcgttcgaggacccaggccatcctgttgaggtgcggagcgaggccttccaggttgcaagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgcggagggagaggctgttcgccagccgttgcgtcgtggcctcggcctcctcgagagctcgctcccgctcagcgagtacatcctcgcgaaggcggagcgcggactcctcctcggcgcaggcggcctcgtgcgccgccagcgtcgtctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcaagaaccccttgggcggcgtcgagcttgttcttcagctccgcctcccagctcccgtgttgaaggcggagggagtcctgcgcctcaatcatcgcggtggtggcgacaagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcaacacgcgcccatgcggcctcgagctccgctcgttctgcgcgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttgatcctgggcgtcgcccggtgaggtaggcccaggcgatgcgcccgcggcctcgtcgcgagccgcctcggaggatgtcgcctgagggccgcccgagggagtgggcccaagtgacgcgccagcagcggctgacgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggacttggggtggcgggaggaatgcgacgggacatcgctgaagcagaaaaaaaaagccagaagacgaacaaagtgagcaagaaaaaaacttctttttggagaaagatggttgcaatgagagtgagacgaacctgcgagggggtcggttgaatgaccaccttggaggggaaatcaggtttccccggcacggttccgtctcccccgtcttgcggagccgcttcttcttgcgcaccccctcgggctgcgacgtcggcgcggccccctccgggcgccgactgctggcacgcgccgccctgccccctcggggaggagatgggggaggtgtacctcccagcttcctcttcccctgggcgtcggcagggcggctgctccccgagcccccgacgcggggcccagaagcacgaccccctcctggggcaggttgttccctccggcgtcgctcgcccgcgccgtcgtggcccttaggggctctctcctctgaggccccgacccccaacataatggttagaatggagacgcggtcgggatctatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgacgacggaggtaatcgccgaacaccatggccccggtgagcccctgggatcgcaggcccgccaggcggtcgaggacggcgtcgtactcctcccccagatctaccggcgcccgccagctggagacctgcgccgggggctggcttggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgtgtgtggcgaaagtagggcgtagcagagaaagagttagagctcaggcggcgaaggcaagaggaacaatggcgaaaggaagggagcaaatccttttctcgatgcttttatacccttgcaatcgctgggcctggctcctcgtttctcgcgcccactacttcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattacgctcgccgtccgaagcggcgttaccgtatctccaggcgagacaaatctgctcacccagattcgcgcgctgctcaagtggtgtggcagtcttgaatagaccgcccattatggacaaccaaagttatcaataccaatgtgcatggattgagaccgttgggcattttgcccaactacggagaccggtcccacctgtcaccaggctttaggggtggcgtcacacttgaccgcttcccttgggaaaggaaattgctctggcataacgccgggggctactgtcggtgatatgggaccgggagtatcatgaccagaggcttgaggcagacgcaatcgcccacgtggcctggcaccttcggggacgttgggcccgagggtgaggtgtccgccctcctcgtgatttcccctgaggggggggtcgggttgcgcttgctccggccccgagggccggggcacccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaagggttaggtggcgactggcggtctgacgcacgcctcgccccatcccgtcaagacgaaagcctcaaggcaactcgtctcaagccggagctagcgtgttatctcttagagatggcacgttagccctggttagatttataccaggcttcatcctaatcattacaggcaaggtgttacacgaagaagggcaaacatgcacgttgttaaactgacgcgtggtggacaagaatgaccggtctgacactggtcgcatcagcaacgggcagccacgatctcacgttgcgcccgtctccgccgggagtggaggtaggtgtgagctgtcccatcgaagtgtcatttggacgacaaccataccaatctccgcccattaaagagaagaagaacagtccagtttggaaagggaagggtgcatgtggtatccccttgaagtataaaaggaggaccttgcccatagagaaagggttggttgattcttgccagatttagagcctagagcgggggagaagtgggctctcactttgtagctcattcatacacaaatccacaaaaacacaggagtagggtattacgcttggcagcggcccgaacctgtatacatcggccgtgtctcgtgtgtcttgccggcgagcatctttccacatacagagagagcttgagatcgcaccctaagcccccggccgaaccggcaaaggggggcctgcgcggtctcccggtgaggagccacgagctccgtcaatatgtaataaacactagcccaagatgcaattcactctttaaatagtttcataaaaaaaatcaaaacatcgtatatataatataatatgaaaaggagaatatatgtaattaacaagtaaaatcttttgtctactcccttcataaaaaagagtcgatctacgtagtgatgcgactccacctagaacaacgagtctaaacaatgaagtagatctttagactccaagagaggaagcaaacttagcgggagagttgatcgacgacgagcggcgagttgttgacggctgcagctaaccgccgccgccgtctgattcgccgacaagctgtgctgctgggcagcagctagcaaccgggatcagacactccctgaatcggattctccggaccagagtcagactcggattggcttctccggaccagcctcgaatcggacaacctgtagctgaatcgatcgcctacatacgtataccagtactactatatattttggtttacccccgtacgcacgtagagtcaattgatcaatatcgatcggcactatagcgagcgagagatcgatcgatcaagatgagtggatccgtgatgatgatgcagcggttggcgcgtcaagcggcagcacgcgtggtcacccagcatgccaggagcggcagcggcagtggcctcgcgggagcagttcgcggttacaacaacgtctcggcgtcgcacgcagctgctgctggtagtgccagtggttcagccaacaaacaggcggcaagggcgatggcgacgacggcatcgcggcagcggcaagtaacagaaacggtaatggcggcgtcgcagaataatgcagcaaggatacgcaagttagaggaggaggttatgttttacagatccttcgccgctttcctactcggtgcttacgtagcagccaaggtgatggaaaaagcgtaattatgtactactccatttgctattttttcgctcggtttcttcaattcgatttgctatcttaactgtacaagtgttaagatagggggtcaagggaccgactttaatttgtatagctacgctacagtacttgtggtaattagataatacgaaataatattaccccgtccattgtataaatccgtaatactaagacgacaggtaatctagcataagcatccataggctcgaaccgctccatccatttaattttcttgtagttgattgaagtggcattgctatgactgcatcaaatttgctccaccgttaaactataaaagatagctcatgaaactattgcatgagagccccctccttccatggccaaccccaccggccaagggggtatatctaccagggggacagcaagggttcaagccttctactaaagcaagaactatagaaacccccacaaagctcccactaatttattttgtcatacataaataagaagggaaagttgtagctctgtctagttcattcagatcccttgctatttattcctggatccattggctggccacacttcatgacagctgccactccagccccgtcatccacctctagcatcaactattgcttcagcctcgtcacccaatgtcacttgctccttacggcgccattaggctgtgttttgaggcgaaggttacgaactccaccaccccgcacatagaatagagcgatccattcgtatataattaattaaacattagcaaaaaaataatttgaaaatggattagatttcttttaaaaaatattgtttagaaatttagaaagcgtgcacacaggaaaaaagaggaagtataagttgaaaaaggtgagtgcccaattcagccttagtctaatttccatctagcgttcagccatggattccctttacctatgcgaggtggcaagagtctcccaactctggagcttccaaccagacctgttgaccaatctcatatgtccagtagtggttttgggttttgggttctttagacctatatcatctcgtcttgattcctagtaccgtctcgtaaagaagtcgaaggttctctatcatcctacctagcccaccatccatctctccccctccttaatcaagtgccactgcaacctatgttagtcatgtgctccgatccagctccaacatcgccgcctcctactgagcgcgcctcctttagtcactgcctctggcccctatctcactgcttggccatctcatccccacaccaacaacccatccctccatcggatctagaaactgtcatgacaaccaatccctcctgtcgagcacccgtgtgtgttgaccctcgccggtcctcggagtatgcatcctaaccacatccacttctaccagacagatttgtaatatttcgacgctttagaaattagaaattaggccttgattatttgacatcctaggcaaatcaatccacagcacaaggcataactctccatatagctccgcctacaaatcacctctaaataaagtaaaagaaaaggagtacatactctatggacttcactggagataactcatatgatacgtacctgttatctatatttttaaaagaagacgtcacaaggatcaatcgaggtcagggagcgtcttttttccttgttaatctgtggattcttgcacacgtacccttcatccttcgagttttggctatctcaagaagccgtagtgtactgcacgactcatctagtcatcttgtgtccgatattagttagcagaacacgagtgcacaacatcttaactaccacgcatccaaatttaaggagaaaaggtcgagtactcaggttaccatttatagggatgaaaacggtcggaaacgatcggaaaacagcctcaaccatttccgtaaccatatttttctcggaaatgaaatcggaaatggtaaattcggaaacgaaaacgatatcggaaatatcggaaaaccgaaaacggaacaatacggacggaaacatgtcggtacagatcggaaacaggtaacaaatacggatacattaaactataaaaacatatatttaactttacataagtatgttatatgtatacataaattcaagcttatactatataaattataaattaacttcattttagccatgtacaaaagttagagatttgattgaagagtcagtcaatatgtaagctgcgggtcaagtatagacatgctctataaatatcgacatatttagaatatggtaattaccatattataagaaacggtaatttccacaagaatacggtaaatacggaaacgatcggtataacagcaaaaccatttctgttttcatttccatattttttaccattttcatttttgtttcggtcgattaccatttccatatggctcggccggtagaaagtcgaaaacgaacgcccacccctaaccatttatgaggtatacgaatcactgaatagaacaggtcttgcgtgatcctacgaggtgtccacatccaagcaaaaaggttctaaaatagggttattaccaaaataagtgttactgaaatttaatttggcattgccaacagaatttgccgaccatttcgtttcgctaccaagatttggtaatgcttgtggtcaagccttcttggtatatatggcttacgtatatatggctgcttcttcgttaattattatctccattaatcttagaatattatgaccagatattgttcaaatttaaaatttggcatgttcttttagcaataaatttataaatgcttaactgttcggctggatgaggctgataagccatagaaaaataaataaagtaattaaaaataatttgtaggtaaatttttatatttatattattatagcgatttaaaagctggacttggaaaatagactacaataatagaatcccaaaatcaattctaagattaatttttgaaaatttaaattttgatcatgacggataaactacgtacccaccggacaatgagtgtacagtttgtttcatcatacacaaatacaaccaagaaacttccgtctcataatctaaccatttaaaagttatttcttttcgaagttaaaacatcaaagtcaatgtggagaaatgtttggaaacaaatgaagtaacccaagtaatagtagcctacgcaaccttggcgactattgagcacttttctggtactagcagagtaagcacggttattttgccacaatatatattagataaatgtaaaaagcataatgttattaatatttgggtatggctcgtattgacaaacagaatagaataacccaatattaattagattgttacgaggcagcagtttttgtgcttctaaaattttaattattacattcatacgaaaatgcgaatatcaagcgaactttatgcgtcactaacccacgtccttctgattttacgtgagaggaccagtttctacccagtactactatctttatattttaatatatggtattattgactttttagatatcgataattcgttttgtttttaaaaatatttaattggtatttattttgttgtgactttgatatatcaccgagactccgtgcaccgctatatatatggggcttcgtcgtccgcgcgctccgtgtccgcgcgttggtacaccgcagtacgtctcgtgggcacgcagcggcgtgtaccacccctgcaggtgcgcggcggcgtccaccggcgaggagatcaaggagcgttccggcgcgctcgtcctcgatcggtaccaatatatccatgccatcattcaagctgtttgcgtatatatccgctgattaatcattcgagctcaccaacgtacgtacggccggtgcgtggctgctgcagatgcagaggcgccgtgagggcgagcgcgccggcgcgcctcccccgtctcctccccgttggacgcccgcgccgcaccggccggcgtggtacgcgccgctgcgcttccacggagacgagacgacgagctcgcacgcacgtacgcgcgcggccgggtaagttgccaagatgaagccgcctcagcgcgcgtgcgcgcgcgcgcgctctccgcacgcccgcgccgcgcgccgacccgatggatcatgcaactgctagctgccggccggtgcgcgctcgggccggcttgttgaatcatgcaagagtggtggcgcctgctcgatctgctgctgcttgatttggctcggttagtttctgctgtatggatcgggcgatcgatacagcagaaaaccatctacaaatagctaggaagaaactccttttgacgcattatcctctcacatgagttactgatatgttggccaccagtagtgggttcacatatcagtaactcaaaatcagataatagtaagttagaggatttgtttctcttacccttcctctattttattgttgctgctatttccatcaagttaattggggctattagaccactgcaaactgatatgagaatatcttcctctgtatctcgtctcctactctcggttcgcagtccgttagagctcgtagtttgatctaatcgcaagccacaattactagtacatctttttttttcaagtttagaaaaaagaacaagtttaaattgaagttcgtcaagtgaatttaaatttcaaatttaatttatgaatcctatgataagaatctgaggttttaatgcctgaatcattaaaattcttagaattaaattgattttttaatcatgaaacccaaaattgaaacataaatcccgaagttcagatttttaaaatctagctgatagtcaaggacctcatcatatttcatatatatctacctgataataataatctaattaggagaacaaataaatgcccaaacatgaataaccataatggaaaaacagacagttaaaacagagggacgacgacgacgacgacgcgagcaacgacgtgacgccaacccaaactcagctcggtaatcaaccacgatcgagtagcttgcattcgcctcgccggcggcgacgtcgccgccggctagacaccgccgcagcggtaggtgatcttgcacgtccttccgaccctcaccacgtacgtgtgctgcggcttcaccaggaatggcggcagccgcatcagcgcgtcgcacacgcagtccttggacacctcctgcagccaccggcagcagtcgcggtacgccctcagctcctcgtcgtggtgctcgtcgtggtcgtgctcgtggtcgtcgtcgtcgtcatggtggtcatcgtcgtcgccgccgccgccttcgtcgtcgtcgtcaccgcgaagacggccgcgcctgccatggccgcggcgccgtccgcggcctccgccgcggccgccacggccggtgcggttgccgcggtggcccgcggtgtcgttcccggctacggcgggtgcgatctgcgtgctgccactgccgttgcccgccacgagcgccgagaggtcgaccacggcggcgtggccacggcgcccgcggtcgcggtggtggcggtggcggtggcgcacacggtggtgatccccgccgccgtggtcgtcgtcgtcaccaccaccaccgtggtcgtcgtcatcgtcgtggtcatcatcgtcgtcgtcgtcgtcgtcgtcatcatcgtcgtcgtcgtcgtcgtcgtcgtcgtcgtcgtgctcgtcggggggactaggcgggaggatggagcacgcctggctggcgatggcgaactggctgatgcagaaggccttggccttggactgcgccgcgacggccgcgaagagggaagggaggaggaagaggacggcggcgatcgccgccgcttgaagcgccgacgccgccatggccggctagctagctaagctatagtgtatagatagccgtggcctcactctctggctaagtgccactacttatatatatataaagacttaattgttttcaagtagttgggtaacgtaacttaaccaagatagagggggggggggggggggttgagaagagaagcatggttaaaattaggtgcttcataccagtggcatgcaatgggatacaaggctttgttcagccatgcccatggccatcctgttgacatgcacagatgcactcttggtgaagggttagtgacattttggttaatggttatgtgcaaagaaaaaaattgagtgaagtgcatggacggtgtttaaacttgcacagatgtgtcatctaggtatctagacactcaaaatacatttttgagtccccgaacttgttatgagtgtcatgtaggtctaaacggactccaacccgctccgtgagatgacgtggcatgccacggtgacacgtgttaatgggatccacatgtcattcgcataaaaaaataaaatttaaaaagaaaggagagagagatgagaaaaggatgtttttaattttgaaaaaataaatgaaaaaagagaggaaaaaattgttcttaattttttctatatatgattgacatataggttctactgacacatgtgccaccatggcatgccacatcagcacacggtgtgagttggagcccatttagacctatatgacaccctaaacaagttaaggggcccaaaaatgcattttgagagttcagggatctaggtgacacatctgcacaaatttagagaccgctcgtgcactttattaaaaaaaaaggtctttgtctacatgtatattgctttctataagatgcatgtatataagtatattgatgctgttatcatggcaatgttatcatggcaaatagacagtttatactacctcctcaaaaagacagtttatactacctcctcaaaatataagaaatttttactatgcatttgtgttgataaatttgcttatattttaagacggaagtgattttgactatcatttgtattgttaagattgcttactctttccgattttataattcttgatattttggacaataacagtctccagaatatatatttgactgtattttttctattataatatatacaataaataaatatatatttacttttattatagcactccctctatcccaatttgaatatcacctaagcaaacacacagagaccaaggacaacaaaaacttcactattatgaaattaatcatcatcagtcaaggtgctatgttgtttcgtgtctcatagattgcatcacgttttatatattgaatggagtttcaccaatcctatcttctatatagttggtacccattaaagggcatttactcctataaagtaagacatgcaagaagccacatcatcaacaattttaagccatcacatcatattagtataaagataacaaccgttggatcaagaagctacttattcttccaattcaatcatttattatttatccattcacctcattttgctctacttcatagtcacacatagcactgttacatattttatgcataacaccatgttttcctaatacaattcaaattattgtttaatatgtgtgttttgttttattatgcatgacaagatagcatataattattaggtatcgttacctgaatctatttttagaaaaaaaaaacttgagtgaagtagagagatgcaaattgtctaactacaacgatacccatatattacgcatgaaattcatatattataacaatgcacaatgacgcatggaaaaataaagcatgaattatattgtaataacataaggcatatataaatccacattatcatatagtttgtatgtatatagagttgtaccttaactatttaaaactatgattttgtttgatgataaactacaaaacccgcggcaaagatgtgggatgccaactagtataaattaatattggttgattgcatgtagcacattcaataatgctcatttactatttgcacaaataaacgaaaagacactttgttagaggatggtcatttaggaagaccttaaaaatcttatatgatgatcaataggggcggaactaggcctcgggcagctcgggccatggcctgaggcctatgatgcaatcccactatgaagtttgtttttccacggaataagtcaactttgactatctacatggaataagttaactttgactatctaaaaagtgaccctaatctaatccatgaccctaaaccgcaaaaccggatatctcgacccccgaacttttgaaactggtacaatttgactcccttaacggttttgctgacgtggcgcctacgtggcggtattgaccgggtcttttttacacgtgacattgacatggcgcttaagtggcattagaattaaaaaaataattcatttatcattcacacaaaggatggcatgcggaacccactgacatgtggggctcacatgtcatcctctctcctccctctctctctcccttccctcattcagcaagtctgccacaatcctcttcctggtggtaaccacgatcttactcccagctcgaccaaatctgaggggagctaacacatcagtccacatatccctgtacgaattctcattctcatctttattccagacattctcaagaatcagcaagaaccggcgcgacgagacattctcaaaaaaatgatagccgcgacggggatggtgtcagaagcggcgctccgatcctcgccttcggtcgtgctaccgactagccaagacaccaattattgctcatgccccttgtcacgcccaaacacctcagcatcctccagaatcgagccggtgatcaccggaccatccgaggttaggagggtgctgctcgactcgccggaccctggcttggtcagccccgccgcctgcatcagccgcccggagctcgcgcggatgtccttcagtttctggacgacggccttaagcctattgaccgactcgtccttgccaacgagctgcatgcttgccgatcttgccaatggatgaagatcctagtaggctgaccttgccgtcgttgcgggagaccgcagaagggcagcggcgggcaagcggagacggcggcgagcgggggagatgcgggcatggcggggagtgaagacggcggcatccggcggtggccgccatggaaagggcgaggtcggggatctccccgacaacgtccgccgccgccgccgccctcctacagctggatcaacggccgctgccaccgccgtcgccatggcgtgcaggccggcaattcggatcctttgcattagaggtactaatgcagaggatgaacagtaccgcacattaggggtactgtagaccgtccaatcgagaatggaaggatatcctgtagctatagtaaatagccactgtttatgtccttagatcgctgttcccctcacatggacagtgcttccctgcagtactgtaggcgatccggatccgcaggtcggccgtgtgctccgcctccgccctcgcgccgctgcctcctcccattgggagagaaagagaaagaagggagagagagaggaggaaaaatgaaggacacagggaggactgccatgtgggcaccacatgtcggtgggcccacatttctctttttgagtgactaatgaatcctatgcatattttttaattctaatgccacttaagcatcacgtcaacgccacgtgtaaagaagacccggtcaataccgccacgtaagtgccacatcagcaaaaccgccctccaaaaccgcctagagagttaaattgcaccggtttcaatagttcggggtcgagttatccggttttgcggtttagggttatggattagattcgggtcacttttaaagggtcaaagtgaacttattccgttttccaccatgtaattgatattggaaaaagtccatttagactcccttaattgttcaccgaatttaattcgtgacccttaactggaaaaccagataggatgactcctcgaattattggaaccagtgcaatttgactccttcagtggttttgaagggcggttttgcggacgtggcgctgacgtggcgataccaacccggtcttcattctacgtggcgctgacgtggcgatactaacccggtcttcattccgcgtggcgcctacatggcactagaattaaaatatatccgtggaacccatctatcattcacacataaaatatatcatgggacccaccgacatatggggccacatatcatcctttctccttcccttcttcctcctcgctccctccttctctctcttttctctccccttttctcttccccctcttcccccttgggacgcatcggcggcagcggcggccgggtggagtggcgatggatctgggcagcatggccgcggcccctcttctgggcgtcgatttcctcgccttgagtgataattaatactcccactagctgctactactacatcgctagcttagctaatgacgtcaccgagcaaccaagaacactaaattaccactaaattaaccaactaaacacaagctaattaagctagtgtcgtcgtcatgttgcctagctagctagctagctagctaattactacttcggtgagtggatggcgccatgccgccatggcggcgtggcagcagcacgtgtccatgtcagcgtcgtcgtcgctggtgacgagcgtgagcaactcgcgcaaggggagtcccgaccgtggtggtggccttccagagggtgtcggcgacggcgatgtcggcggcggagtgcaccggggcgatggcggcgccgtcgttgctggaagggagattcgggctgggcgggagctcgcggcggcggtcgagcctgaacgcgtttgacatcatctccttttctccggcaactccaacgccggcggcggaggtggagctttaccgccgcggcagccgcacccgacacccgaacttcccaccgccgccgtctcctcgctacaggatacgcgacagcagcgaccgcggcgactggcagctctcgatgccgccgcagcgctgctccgccctaccttcatgccggccttctccacccaccgccgcccacggcttcgcacactcccttgccactctccgctccgccatccgttgcctcggcaagctctccgcgctgctcgccgacgggaagagaaagagagagataagggagagagagggggaggaagaaaggttgggaagagaatgacatgtggactccacatattagtggatcctattataatttttgtgaataataaatgggtcccacatatatatttttaattataatcttacatcagcgtcacgtgggacgaagaccaagttaacactgccacatcagcgccacgtcagcaaaaccgcccttcaaaaccattgagggagtgaatttgtaccggttttagtaattgggggagtcgttctaaccggttttctggttgaggggtacgaattagattcgttgtacatttaagggagtcaaagtggactttttccattgatattcatagctcaagctataatgggctggcccaggtcgtggcccaattttgggtccgcccttgatgaatgatgatcaaggccggctccaattatggatccgccccctatgaaaactagaatagagaactttgtaaaataaatctatatttgttattctaatggctttaaactaaatatttttaaagttattgatagttgaagttataaaagtttgacaacaataatatccaaaacaccaagaattatgaaaccagggcggaggtagtaatcagcaacagcatcataatcacctaaataccgagctcatgtgcaactacttaacacggtggcacgatagtatcaagggagtatattttgccacaatataattgataaagtgtggcatgccacatattgtatggttatgaatgtgttagccacaattgtggtaaaaaaaatcattcaatgacaagaggactagtcttagttgatcaaacttttttgccacaagtttggctaaggttgacactaaaccaaacaggccaattcagtcattcagtgcacatctatgttggaaacactgtaaattcatcagccaagcttttgcattcataatgtccaaaactggttataaaccgtaactgttttattagcaattagaaaataatttatctaaaacttctatatgtgttcttaacaacttagaaatcaatgtaaaatgctatgttaaaaatatcttaaaaatcaacttcaaaattaggttttaaattttaaaatttggctttgctttagctttttagtgtaaccaatggggctggcgactcatttcaaactaaattcgcaacaaataatccatggctgatgtgagacaatatgtgaatagcctaacctttttgacaaagtacattacagcacaatttctagtgcaaatatggtaaaatttatctcgcaaaccattagcttctaaatatttacacaaacgcaggcgctgaaaaaagctaatgatgtgctccaggaacacaagcatgccttgttctgcagctatgccaggtgatatttacacaacaaaagaactgcggcaaaatgatttgtatttatttgtttatgtacgatgagaccaaacagtttcagtaaatcatttggggtagttgttgtcagaggggtaggagggtttcatgaatggacatgaacaatgagattctccgaagagaaatacaacattgttaggctaacaatacaacctatggctaaagattgatgcattgacagcctctattcctacaatacattgatctgccttccgcttctgcaatcctactatgctaagatacatatttacaaggaggaaggcaggtacttatctccctcctttttggtgggtcttcatgtgaaggaaccaaaccgatgaatcagaaagcatcaacgaaagcatctcgaagtgcccagctgacaaaagcatcgaccctgaaaagcagcatgtcagatgaatcagagaagaagataattgtggcatatggtggtaacaagaggaacggaacaaatggcgtaccattcacggatagcaaaaatgttatcttggtctccagctaccatgtgctgcgataaaagatgatgaattagtatcctgtaatctgatgcgacctgaagttactttctttggaacagcttgtgttattcttacacgtattatgccaagcatttcgtacagtacaaccaaaatatgtcatgaacttggacgaaatattgattaggactagtgtaggtaatattagaaaggaaacaaaatggtcccaagactttggtcacaacattaacaatgttattcctctctttcaagcttcccctcatgactttacagtttacactctagttctacagttaaggttgaaaagtttctaccatataaatgctccttacaggacaaatgcttatgaaactggattctttggacaaaccaatatctagtggtaagaggcaaatcaatgcaagttacattatgaagcaggacgaaagagcatgtaacatacctcctacatgtggaactggaggctccatagaatgtctggagggagaataattcgatgaccgaggaggcatagaccacccagagcaaggacctggtggaggatctgatggtcgtccgtagtgcactggtgctgctgacgatgcttcaaaatggtctggaccaggaggccctggacaataatcaagaacaaagaacatttagtctgctgtttttgagggtcctacagcatgggatagattaacttaattgggtaatcatatatctataaagttcatccccactaagtgtaattaatgctaattctctcttctctcatgaagccacatcacctcaattgtttttagcttttggatgattcatcaagggtttaaattgcatctcttccccccaaaaggcacactatacaacccaatcatttataacctatggataattgataaaggtaaaaaatacataaacatataaaaaaaatcgtatagtaggtactccctctgtccaaaaaaagacaaacctagggtttccgtgtccaacgtttgactgtccgtcttatatgaattttttttataattagtcttttcgttgttgttagatgataaaacatgattaatactttatgcgtgacttgtctttttaatttttttcatatttttttcaaataagacagacggtcaaacgttggatacagaaacccagggtttgtctttttttgggacggagggagtaagaatgaaaattttagaactcatatctactatattatcacacaattctcccgcagcaacgcgtggagtacccatctagttgtacaataacaattcatggctggtgtttctagggtgaccttacaggatgaaaactgtgccaggaaaaaagcgacaatgattcacgaaaaaagtacctggaggaaaaggaaatctgcccctgtcagcaacttcgtggtgcattggtcccctaatagctctctcatcaaaggaacgtcctctgtcatcaaaatggtgtcctctatcatcaaaataatgtcctctatcatcatagtgatatcctctatcatcatagtggtatcctctatcatcaaagtgatgtcgtctatcatgcccatgatgtcttctatcatgcctgtgatgatctcgatcatgtccatcataccgatatctctcaggataggatgaactattattactccaaggccgtggtctttgctgaggttctggtggtcgataggggcattggtttataggaggtggagggggtggtggttgcatatgatatccttcgttaggtaccgatgccattgggggttgatgatagttattcccatgatatggtgcaggaggtgcaggaaaattgccatggggtccaggcggattaagtggtgcaattgggggcggcggtggcatctgatttggatgccccccatatcctgaattacagaatggtggaggctgcaattgcgctacagaaggattcatactgcctgggcgttccacaacagaatttggctgttgcgtctgaatattctgcaaagaaaatgaatcattagtttctaaaataaaaatgcataaattccttcttgcacagaaagcaaatatgagcatacattggtagctcttgtaggatgcggaccaactggatcagatgccattggtaatgttcgctgcaactgtccagtctgagtaattggagcaggtggtggtggcggaacaggtggaggagatgatggcaatggcgggggcgatggaggcctatcatcagggaggggaggacctaaagtatgtcgatcagatgttctgcatttggtatcaatttgttctggccgacatctggtgctagcttcaacttcagatggtggagctacatcctccatctcaagctcgccatcaacttcttcaaggatgcgatgatgcttttctgcgggcatttgtgattcttccttctcatcagtgcaaggagcatcatgttcaggtgtaacagcttcaaaacttctatcttcagaggagcttccgtcctcatcttcaagtacttttgtggaaattaagtttggtagttgaaaaccagcattgctgcggaaaacaatggaacatacaaacatagggaaagaactggatgagatacatctatataattgaatatgtagaacatggagctatgaagtaatgaggacatattcatgcactgcatgcattaatgcatatcttgttttatttaaaatagctttgtctcacagataatatgaaaaaggacgcccactaaaattcacccccaatatttcaggaatgactcctttttctagttatttattcatggtgagttttatccaatattagctaattggatgttagcatcattcatatatcatagaacactgcttaactgaccaacaagactacctgaagaatacccatgctctaagaaaattactcaaaattgcagtgttccatcaaatctaccgtggctttgcctgcttctctacacttcgacacgtgatcccattttgtctgcacaattcatctagctatcgtttatgaacattacaatattatatgcatgccacactacttttcatacatcagtttgacaagcatacctgccatactcatcaacaagcattccttcgttgtcacgcaacgggtcatttaaagctctttctgtccttgaaggacggcgagaacttccaaaagatgcctcattgataacctcaagttctctaatatggtggcgaatgatgtactctgggagtgttttcctctcaaaccaaagcttcaaaacctgaagataaaatcacaaagtttttaagaggagaaaaggagaattgcacatgacaccagttctatcaaactgctgaaggtgcctgcctttagacattgccttcgattctcccatgccgaatttccaggaggtgcagcagcataaagtaatcgaggtagaactgcctggataagagacgggtaaacatctccagctccacctgcaaatttcttacagaatttaaaaaaatagagtgcaagcgaaatagacagaaaaagatcatgaaagctatatgttacctttctggttacgagagtattgagttattgaatccacaagaaagaaaaggtccactctcttatataaattcgactccttctccaagcgttcaacgataatatcaatcgcctaaataagaaaaaaaaatcaggaaaattgatatttggcaattggttgcatagaaaggtatgtaccctctttttattggtaatctaaaagcaccatgcatgtgtctgtagatgagatttcataatctaaaagaacatagaagtggtaaacaaagcaacatctaccagaattatcacaggttatttcgaagtccataagttgctgagatatgttgtcatatcacatcaaaagcatgtagcaactacgtattataagagatggtacacttcaatggtaaataagattgatccttgagaagcaacaataagttccagatgcctgatgatccatcacaaaaaagatggtagttggcacttggcacagagaacatagcactgtaattactaattagcctaggcaaatcaagaatctaacttccccgtccaccaacaaaacaaagaaagcaacaatgtttgctacatctataagcaagtaaatgatgatactacttaagaaagacacagtaaatgcatgataaatgaggatcacgtgccaaatagaaaactaggagtgacatgcatggacgcatggtctaacctctccagcaacgccatgtttggcacactcaattgcaagacgtgttgcacgcgctatattttcttttgttcttgtcagtgtaccaagaaaagatccaaaagcctttcgtgctgcattagcctcatcatgtcctgttaatttgctcaagttcttctgttgctgactatcaaaaggactcctagaatgaatattatcatttgtagatgtggatctgattatccggttcaaaggtgacaattgcttctgtgatccttccttgaaagcaggtgtatcaactacagtttcaggaatatacttggcattcagaaagttatctggaaaagaagttgatcgagagaaccttctagcttgtgcaacagcaataagttctttcataggcattgaatctggagaagtgctcttatcctttaggtttctatggttcagttcttttaatgccaaagctgagaaggtgtgcctgcaatacaacaataagtattgtcatgccttttcagaagaccatcttaaatcaactaatcaagtatcaaatttataaagtactaatccagagttgttataggagtaattcaaaggtacaatataaaccaaaaaagttgctattccaggcattctacatgaataggtcataagttcatcagactgtacgttgcaaaataagcattcctgctaagaaggttcaaaaggtgtagagctcaatgtatagatttcagacatgaaccataagaatgatgtttccattgggacctaaatattgctctccagtctccactggctagtaatgtcaggctccaaaaataggctctatagttaaagccaaaatagagcagacaaataaattagggacgtatggaggtagaaaacagtcccgattaattctccttaataaaggattgtgaaggaactgaaatatcccacaaaacatatattaggatccacaagcccataacatggaaagatttagaatctatatgatataactaaagacgttataatcagaatatttgaaaacccaagtatccagctcataaagcaacaaatctacacaagacaggagcattagaataataagatccttgttgatgagtaaaacaagataaccattcatgccatttatccagattccagagtgaatcaatttgcccaccttttttgttcagtcaactagattatgaagtgttacctatgtttaagacatacattgacccattattgagtctccaaagaaatgcattttgatggatgaaaacatcaggttgacattacaaggaaaagaatttcgtaggaaaagaaaaatcaaattgcatggatgcttcttcttcacaactttctgaagtttcaatcagaaaatgccagcataaatttggaaaagaagcatgcatgtcctaaatttgtcacaaaaaggttatgaacaagaagatatggagcatataatgataaacaaatatctcatgcagacataatggaagatacaatttggcatgaaagcttacacttcaaatgtccgggtgtctgcatcagattgtatactggaagatttagtggccagcgaagaggtgcttgctgtatcagccacattgactactgtttcagctacaacagtttcattatgcagtacagaatcactgatcgcattattgttagaagaaagcaactttggtcggtaaattggctcatcacatctttgaacacttctgtcagtatcatatgcaggacggtcaactggttttgggccttcattgaagttgattggtttggcaacctcgctaacactagctgtccccaaagatgaagataaacgatcaggtacagctacagtctgtgtaccaccaagagcagactcattcagcttcattgaaagagccaagcctttcccgcagtcgtcattgccaacttcactagagaccaacaagcaatcagtagttttgctatcaacgtgagtttcttcacaaatattgccttctgtaacatgactgtcatcttttgcttctgaaggaactgaagcagaagcaggaacactgttattttgcagaattgattctgaggagtgtgttttgcactttgggctatgcatggattctgtgcacaaagatggcctagggctttctgctattgcagatccgttagtggctgtgactactgcatctgcagatttattagagtggctgttttctgaagccacaaaaccatttggaatcaattgctttgaccctgtcacttcaggcagattattagtttcagcaacattagcggacatagcttctaaggcacgatgaagacgttttgatggaggcaaagcagcttcaacatccaatgttaaaacctttggttgatattctttgttcttccaagcagactgaccttcacctgaggggccaggcatgtataacttggatgattgatttgaaacagtatttgcaactcttcctgtcaaggaaacactatttaccactgctgactgatcgactgaacaatcatcaccaggtagtgcaactgtgttatgcatattacataggtctgcaagcatagcaagctctggtctgttattagtaacatcaatcccatcaactggtgagtcttccaactgaggccttcccattcgaacccttgcccttttgaccaatggcaagtgctcatctccatctgacttatttacttcagtctttggatttggagaatctgccgttttttcacttaactcagcctgaaattcatcatccttatccgtagaatgagaaaaaatatttctacttggctttctctttctcttgaaaataactgattttttcatgggaatgcttgatgcatcatgcgatttaaattgtgtctctaaagccccattttgagatgtttcactgtcgcaggtactatctaccttagtggtataattcagctttttattgttgttactggtgccaggtgtgccaggttgattgtcgatgcccgcacttgaatgcaaccaaacatcatcctgtgttgaaggggaacctgagttaccttttacatcctcaacatacacatgatgactggaaccttccttagtaccatcagcagccaaatcaactgaagccaaacaggttccacctgaaagcttgccagaatcctgagcttttcttgtgtcagtgttcagtgaacttcttgacctccgcagtgatgaaaccctactccgtgtgtagcaattttgaggctgtgcatcccttagcttctttgaaattgaactcgtagacaaagggatgtttctcatttcatcaaggatagacacattttcagtagggtcatcaggagcagaatttacaacacatcgctcacttccaactgcggtaacagaaggctcatcagaatcggccgtattatgaccacttgcaactatggaatggtcttcttgctttttatcactacccatattagagctactcactagaccctccgtatccaagctgctgttattattagcaagtttttctacacctggtttcacttcattggcaaccaaaccgagcttattattaccttccttcaaagaatcataaacatcgattatctcatcaactgccctcaaaaaatcagatccttttccctgtcgcttagcaagtagagacctccgtttctcttcagtgaatgcttcaagatctgcatagttgcagaaagcactacaataaaaagaacaggaagtcagatgtaagtgcgtagggttataggtaagaaaatcagtataacacattgaaattcatgcacagctaatggtggaccagggaaaaaacacagatgcttccatgtcttctctagaagttcctaattgtagcttttaactattagaccataaacaaattaaaaataaaaactgaaatttcacactttttattggaacaacacacaggccaccaatagtgattagtgagttttagttagtccatagcccatacattgagaaatacatcgcgcaaacccaaaaggaacacaaccacaatgggtcatcgaggatcaaagcgagatagtgatacattcacagatcaagtgtcaaaaagcaaatctttacatgtctaagatgttttcatttcctagtcctaaacagcaccacgatatcatggttcattccttcaaaactcattataaacaaagtagcagatttcatagattatttcatagttcatcgaccctgaggagcatttatgcccttggcatatacataatacattgacaacagtgtactactagtccaaatgacagctttaaccaaacctatcgatggttcaactttcttaactatcagagaaatatttaaagccaactaatcaaaattttctcaacgcttgatagtacaactaatttggggggaaatggttatatgtccccacaaatgatatgtgcaatctttgcgggatgtcagaatttcaatggttactctcattgagaagaggatggcacaaaggatggggcaattttccggttttcttcattcacaaactcaaagccatacctatccgagggaggttggatacatatatatagccatagctggctgcaagcctattgctgcaccctcctagtctaaaattcgaaatttgaatgggatgatgtcctagagggcatccaaactgaataaagcataaaggaggcataaagaagatgctaactgctgctgtcctgctaaccgcagctgtcctagcaactgaaaatatgctaaaggagcagatgctgtcctgaaaaggtgaaactacctaaaagaaaaggaagaaccacgaccaaggaccacaaagacttatccatcattctcccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgcgttgatgctcccttcctccaagtagcctcggatgaagtggtacctcacccggatgtgcttgctccgttcgtgaaaaacagggttctttgccatggccagggcggacttgctatccaacctgagctccaccgctccagtgtctctgccgaggagatcactaagcagtcgagcaagccagagcgcctgggtcaaagcggcggaggccgccatgtactcggcctcgcggctggatagggccaccacctgctgcttgaccgactgccagctaacgaggcactcgccgtggaagaagagaatcccgcttgtgctcttgctggtgtcgatgtcgccagcgtggtcgctgtacccaacgaagtgtgccttgctaggacacctcgggtagtagagaccgtggtcgagagtccccgcaacatagcgaatgatcctcttcacagcctgctggtgctccgtcgtcggtcgctgcatgaaccgattgacgtagccgacggagaaggccaagtccagccgtgtgtgggtgaggtagcaggctccccacaagacgccagtattgtgtagcatccacttcctccgtcgtgctatcgcggctcagcttcagtctctcctccatcggagtgagagctgggttgcaatcggtgagcccagccagctcaacgacgcgcttggcgtaggcggtctgtcgaagcgtgatcccggagtcgtcctggtgcaccacaatccccaggtagaaagagaggccatagatcactcatctggaaggtggccttcatctcctccttgaacgccgcgacctccgcatccttggtgccggtgatcacaaagtcgtcgacgtagacacctaccagcaaggcattttctccattgccccgccggtagatggccgcctcgtgcgggctttgctcgaagcccatccacttgagcgtggaatccaacttggcattccacgccctcggtgatggataagtctttgtggtccttggtcgtggttctccacgagcgggattatcttcttcctcggcgagtgcctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggagcggtggagcttagggtagatagcaagtccgccctggccatggcaaagaacatcgtttttcacgaacggagcaaccacatccggg

SEQ ID NO: 68985 - DNA, 79889 bp, Oryza sativa
acgctccccatctcgccgttctcctgcatcacctgcggctggtgacgccgcggatttgtcgaccctctcaagcgcctccccctgcttaggactttggcgcggaggaggtggaggagtacgagctcgacggcgtggattcggctccccgtcgtcgccgctcacactcggcgagatgtcgtgcgtttttccttgctcggccattaggctgaacaagaaaaacttggggcacacggaagagtctgagagctcagaaagcacacgctgagacccctacctggcgcgccagatgacggagctcgtggctcctcaccgggagaccgcgcaggcccccctttgccggttcggccgggggcttagggtgcgatctcaagctctctctgtatgtggaaagatgctcgccggcaagacacacgagacacggccgatgtatacaggttcgggccgctgccaagcgtaataccctactcctgtgtttttgtggatttgtgtatgaatgagctacaaagtgagagcccacttctcccccgctctaggctctaaatctggcaagaatcaaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgaccggatggggcgaggcgtgcgttaaaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttattccatatatgtggcgcagacttctttaaggggtcgggggtgccccggccctcggggccggagcaagcgcaacccgacccccccctcaggggaaatcacgaggagggcggacacctcaccctcgggcccaacgtccccgaaggtgccaggccacgtgggcgattgcgtctgcctcaagcctctggtcatgatactcccggtcccatatcaccgacacatatgttgcatattggactagctagtagcaagttttttcactttagaccatgttttattacctaatattgcgttttggactattttagtgagcatgtcagtcaccaaaagcatcttcttccacctttcatccctaaagacaattccagagcatatgctgctaaatttggtgaggagaagtgaatgtttttttttttgaggtgaacgacggcaggagctctgccggaatttcattagaggagagaaaaatagttcagagaatacaggggaagacatcgaaggagaagaagggagaaacctgaaaatacaaagggaatccgaaaaagaaaagacaattaggggggttggaaagcagtgtgtctgagatcaagttcttcctttactattctcgcaacgcgatcctctgtgtaagagatgttttgaaaaattcttctgtttctttccaaccaaatgttccaccaagtggcgagaagagatcctttaaccctgaatttgaaaggtttggggtgtagttgattgagatcagcccaccaagctgtgttgtcatctgcaggctatgcccccgggatgttttgctattggcacaccataagccaaacttttctgaagaaggggcagacattaaagagatggttagtgtcttcaaacgcctctccacacaggctacaaatccaattgcaaggccagtgccggtgcaaaagattttgggccgtgagagttttttagtgaaggattagccatccaaagaagcgcatctttggttcagctgggcacctccaaatggaatgaaaatcaatcggagagaaggacccttggaactgaaataaataagcactgtttgcaaagtaggatcccgattcattcaggttccaagtgatgtcgtcattggtttgcggtagaagctgaacattttgcagcattcccccaagctggacaagatcgctaatttcttcaattgtagttatttgccgaaaggaaaggagccaagaattgtttgtcaattccgttttaaccgatctctgtttgcgcttagctaggttgaaacacaagggtgcaatgtcttttggacatgtattttgcagccatttatcatgccaaaatttgttttttctccattacccacagttatcgtagtggcagcctaaaagagtcttttgtcgcagtcatcacaaggtaaatccattccaacccaaggcttgttgtcctctttccatttgaaccagagccaccgtagtcttagagcgcgagaaaatttctcaaggtctggaattccaaggcctcctaaaaatttaggtctacagactgtaccccaattaaccaagctacttcccggatttgttttgtctgggtcttctcccttccataagaaggatctgcggtaacgatctattctgctgattacccatttgggagcttgaagggcagttagatgaaaggtcggcaatgcacttaacactgattgcacaagaattcttctcccttctgacgtaaagtagcgtcctttccagctagggagacgcgatccaatcttttcaattagaggcaagaaatccactttcctaagctttcgaaaatgtaaaggtaagcctaggtagcggcaggggaaggatttcaaagttccagggaaagaagtaatgacatgtgtcaagtcggtggtgtcgcaacagataggagaagtgaatgtgaaggtagctcaactggcacaggaccaaaggcaacaatgacaagcatgagcagtgtggtgcttgagctcagggcagcgaagaagttggagccttcagaaagcataagcgtggagaccatctgctcattttcctagtcattaaggagccaacgaacagaactatgtgggcactgggcaggggcggcttgatctcgttgtgccctgctcatggctacttgctcagatctgcgtggctcttgaagaatgttgtggcaggggtcaccaccattcctccatattcggcccaaaacactactaaggaggagattgagtctttattctaagtatccgggtggcaaagagtcattcgaacaggaaaacggtaaaataccattcgagttggaaaacactattcgagcaagttcttgctactaagccaaatcatatgttttgagtgttttctaagttaatgacaggtcaattgccaggtaagccgaaaagggtggtcgagatggaaaagacaacttgccgtagaaaagacccatggagaagacccttggtggtggaaaaggctctcggtcatgaagaaggcaatttgagcaataaagatgccaagagaatattctcggggaccacttgaacactctatctagcttgcgccaaaagactataatgacccctgaaatataccaaaataatcttgggattgctgatgtggcggggggcaattgtaatctcacatgggcccaatgaggggcacaattgtaatctcacatgtacagctatgaactatataaagtagataaaaagcctgtagcagacaggacatattggaatactaaaaatctcatcggtcaaagcgtgtgtacattttgtattcgggctcattcctcatgataggcgggaaaatggtgttttctcgtctatcccccaatcttgtccgtaaccttgggtcacaacaaagaagaagaagaaagagaggagagagatggggcagctggaggagaagacaggtacaatgtaaaacattttgcaaagaaacctggtctaaagtgaaaagtgtattgtaaccttagtccaaagtataacatgggtaaaaatacatggtccaatgtgcaattctctcttaaaaaacgtagtaatatttctaacacaaacaaatatattgtcaaaatatatcatgtgttagctttagtacgtgaaactaatttgttattgtatagataccactacatttttctataaattttaaatttaaaaagtttgacttaaaagttcaaaaaaaattataatgcaaaacagagggaagcaacaagaacaaaataaaataaaataaacagtcccacttgtcaggaataagagggtatgggtgagctacactgccctgacgcatcaatgggttgaataggacacatgcacaatgctccctcctcccattttaagtatagccatgatttttcatgcccaattttgatcgtccgtcttatttaaaaaaattttaaaaaaattttaaaaacataaatcacaagtaaagtactatacatgttttatcatctcataacaataaaaatactaattataaaaaaatttcaaataagacggacgatcaaagttgagcgcgaaaacttatggttgtacttaaaatgagacacagagggagtaagaaaaagaaggaagtgaatcagtagcgtgcgaggagaagggaagagaagggagatgggacgacttttggctcaaagcaagaagatggatttttaaagcctttcaattaaaacaactaggtgaaactccgcgcattgctgcgggaatttagtatgataacaaaaaaaaaataacgtgtaagatagctatataacatcagattaagtaaattaatgtggtttatgataatttaaatttaaatagtatgtagaatggtgattcaaacgtaaaaagtgaggtggtatgactttatggaagaaaaaagtagggagatagtttggaccatagattaatcatctaaaagctaaaaacaatttatgtgatatgacttaattagaggaaaaaaaggaaaaagataatttggaccatagattaatcatttaagcactaactaagtgaggatgaactaaataagtatataggatatcataaaacataataaagatattcattgaaacattatgtgaattatgttggatgataatttaacatgtttgtatttgaaaagctcttaaattataaaaagaataaagatatagcatgtttgcatgatgtttaatgtgatgattgttagtggatgatgatgtggcatcttgttaattagtggatgatgatgtggtatctttgcatgttaagtttaaggagttagtgggggataactttatagtaagataggaatacagaaatgctctccccttcattaaggccttgtttagttggaaaaaattttgggtttgattgtcacatcggatattcggacacatatttgaagtattaaacgtagtctaataacaaaacaaattacagattccgttaggaaactgcgagacgaatttattaagcctaattaatctattattagcaaatgtttgctgtagcaccacattgtcaaatcatgacgcaattaggcttaaaagattcgtctcacaatttacactcgaactctgtaattaggtttttttccacgtttaatactccatgtatgtgtccaaacattcgatgtgatgggtgaaaagtttttgttttcggaactaaactaggcctaaaaatgcatcctatgaaagaaaaattgcttgaaaatctaaaaaaaaaatatgagctacaccacaaatattataccgccaggcagtagtactccaatgagtatctccacggtatctaggcaggtgagatccatacacacatagtaaccacctaccctcacacggtcatgaccatgtatgttttaatgtcttcccatataatactttcagtgtcggacaatgaacaaagaaaatatttgatgagatagataactcagtagtctgctaatgaagcatatgttgcttatcatgcatactttgttggtgagctgaagatataccacggagttcaacattccatggtttaaataatttatttacctttaaatctatatatgttgtgagggtaattagaaaaagatcataatagttgacttcgtgaatctcaagatacacctaacaatgagaactccaatttatatatgttgtgagggtaattaaaatttattcttttagcgataaacgacttacatgtcactattgatgcgcttgtggtgacttgtgaatatcatgccgatttagttttagagtacttataagatagggtgtgcaagtgtgctcacttatataggcgcatgtgtctgtaccctgtttcaaaaaaaatcacaaccgttgagaagaaaaggtaacaagttcaaaatagaacaaaagaatgtgctttttttaaataaaacaaaatcaccctcacataaatattaatattttttaaggtaataaaatttcatgcaccattaaaattaagaggatgcttgtgataagaggcgaagccaagatttatagataggcggtgtcgagattttcagagactcggtaagacggccaaaactttcgggtttttggattggccatcaaaggagcacaacacgtcgacatgtcatgactatagatggccaaaaggcccgaggcccgacggcctggcccacggcatgacattttggcccagcccaagcacggcacggcccgaccaccgggccgtgcctaggccccccactggcacgttgggctggcccaaaatgaccgggacggcacggcacgatgggccgacaggccaggcccgacacacaaagaatagggactaaaaatagacttattttagctatatatatatatatatatatatatatatatatataggacactcatatggggcaccatggtgcccgggcaccatggtatctaatgcacaaaatcactcaaaattttcaaaatttttaaattgtgagtatatacctagttataataattcgattcatacctatacttatcaacaaaacaactcaaatttaactttatttcacaatcagtgattacgtacctaagtaattatatgtatggatgctatatacctagaatcaaaatctaacaaaaacaagttcaaattcagtacaaacatgctttgaactagttagtaaagtagttaatgttaatacctaagtaattgaaaaagtttcatactcatttgaattgggtatatatatatatatatatatatatatatatatatatatatatatatatatatatatatatatataatatgtcagcccaaagaggagggaggaaaaatggacttattttagctatatatatacatatgtcacagcccaacgaggagggagagaaaatagacttatttaaaaaaaggcacgatagaccacccgtgtcttcggaccgacacgacacggggccgtggcagggctggaggtgtagcccatgggccagcacggcccggcacgaagtgccgaccgggccatgctggtccgatagctggtgggccgtgtctagccgtgcctaggccgggcgggccttatggccatctatagtcatgacccactcaccaaccgatgaagcctcaagtatgtcatgaagaagctgagcagccgaacagttgagactcggatgcaagttttattggctcatgcattttgcatctctcttttttagtattgctaatagttcttatactgagaaactatatttaacaacaaaccacctcattactatagaatacctaatgggtgccatttgagaatcccacatagatactagacttcgtaaccgacactgatgtggagaatcatagatgttggtgcacctttgaggttctagaaatgaaaaaataatgtggctcgacgcatcggcttcggctcgaattgagcacatgttttgagccaaggacttaatcccaatccaattacaaatccaacgcaaaaatttaatcctaatccatcacaaattagaataatcaccgaatgatatatagaatatcaacattcaacacaaaaggttaactacaaaaaccgaatcatagtccaccgaggctatcgcggccattagttgctcaccgaaggccaagcctatcaccatcgccactcttcgccagtcctcctcctcgccgtcgtggtggtgccgagctcgggggctgccggatctagcccccgcgcatccttctccacctcacgggacatgagagtagaggagaggagagggaggcacgagtggagaaccttttgtgttggtggaatcggatggccgctgcataggggagaggaagacgacggaggaagacgcagtcgctgttgcaccggggagagcgaaaaaaaccatcaccgtgcctatggtggttgtgcctagcagaggcgtccggccgccactcaccaaccaagctcgggtggggagacgagagagagggagcaaggacaaaatgatgagagcgaacgagagagaagaattggatattgatgacgatagcgttgggaggatagggatgagacttaaaaagatgtttttttttctcttctcccatgctcacgctcagctcggcttggctccaatgaagcgttagtttttttctttttactaaaccaacacttttattccacatataagtgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggcgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacgtcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagcgtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccagtgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagttcctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaataagtgcaggtatattaaaacctgacacttttgttattattgccgaatttttaataaatcagcacatataaagtgttataggtgccctttttaatttcaatcccgcttaaggtgtcagtaggatgtaaaaagcctcacatatatatgtgtgtgtgtgtgtgtggattttaaattaacttggcacgtataaggggcatgcctgattcagctatcgattggatgcatgcatcactagaacacctggcatattcatttatttcgtcaccgccgcttgcattcttctatttctgcagcttaattaattatgcattacggcacacaacaatcacacacacacagaggttagctacatatggattctatagatcgattattgcccttttcttgcgctgatgctggaaaattaagagacaaataattctactagctacgtacgtagaaatctgcggcgacgagtgaccacctaattatcgagccatcaccctggcggcggcgacaccagcaaagtaaacggagcaacctctccaaaaggaagcctcgtagagtagccaacgaagcctcctcgccgcgtcctcctgcgacgtcgacgatggccgcggccctgcacctgctgcttcctctatcgtcactaccacgtccggatgtcgccgcgccgccgccgccgccggcgtcacgttcttaccaccagctgcagcgacgccggcgtggtggtaaccgcgagccgtagccgccgtctgattcctggcacgctgggtgaccgcgtgtgccgcttgacgcgccaaccgctgcatcatcatcacggatccactcatctctcgaccgatcaatctctctcgctcgctgtattgtagtgccgatcgatcaatcgattctatgtgtacgggataaactaacccaaaatatatatacaggcgatcgatcgattaaactactggttgtccaatccgaatcagattctgagaccgtctcgatgatctcggttgcttagctgctgcccagcagcccagcttgtcgcagcgaatcagacggcggcgccggcggttagttgcacggttgcagtcggcattggatctcgccactcgccatcgatcaaccctgccgtccgctacctttgcttcctctcttggaactaaagatcatcgagttccagacacgagattccacgtgcaacaacgaactacaataccttaattatatacttcctttgttttatattatacaatgtttgaattttttttcaatcaaattgttttaaattcaaacaaatttataaaaataaaggcatgtagtaacatttctatagatgtcggatttagtaaaattaatttggcgttatattagatgttgctacgctttcctataaaatcaattaaattttaaaagtttaaaaaaatcaaaacatcttataatataaaatgcaagaaaaccatcattaccatgaaatatacaaatatatataactatgaacatacattaattagtattggtttaatttgttttgtttacaaatttgaacatggaggctgtgaagtgatatattttgtattaattatattatcattttttctatatatatataggtggtataaaaaaacgagggaatgcatgtcctctccaattatgaaaatccatctccctatatttatatactagaactatttgtaaaatagcactccactgtgaataaataaggaaaaccttcttcctaatcatctctttaatttccccgcaaaaaaaatcatctctttaattaaactgatgacatatgggtcccacttatagtgactggatgatgttacttccatcacaaaacgtactttcgacgacatataattgtcactctaatcaaacgcgatctgcttgcactatatatattaattatagtagtagcactaacgctagccaacgccaagccactccattctaattagtattgcagctgcaccagctgcgccctcaggcgacacgccgccgtcatcggtgccaacgccgccggcgaaccggcggcggcattgtcatcgtcatccacggcggcggacgcctcgaggaagcggccgaccatctcctcgcacggcttccacaccaccgcctcccacgtctccctgtgcggcgccccctccgccatgcgcgccaccaccaccgtcgcgtccacgcgccgcacgtcccacccgtccagcgcgctcagccgccggatcttcgccacctgcgtcgcggcgaggcggtaggtgttggccttgatctcgcgcacggcgccgtcgagcatggcggcgagctcgccgtcgtcggccgcctcgccgcccgagcgctcggccaggaggtacccgtgcatctccgggatcccgatggcgcggcgcacgccgcgggtgtagtagtccgcggcgccggcgccgtcgacgaacccggcgcgcgcctcgcccaccagcccgcgccgcaccatgtggtccacgcgcgccgcggtgtaccaccgcagcaggcccggcgcgacgtcggtccacaggaagaggcagtcgtgcgccgcgcggaacgcgccgccgccgccctccaccagcgcctcgacgtaggtgttcgacccgccggccacgacggggaggcggcccgccgcgaggacgcgggcgacggcggcggccgcctcgcgccggaagtcctcggcggtgaagtcggcgtccgggtggaggacgccgaggaggtggtgggggacgccggcgcgctcctcctcggtgaccttgttcgtgatgatggggaacccgtcgtgcacctggatcttgtcggagttgatcacctcgccgccgaaccgctcggcgatggagatggcgagcttggacttgccggtggcggtggcgccgagcacgaagacgaccttgggcttgggtgactgtccgatgacaccgccgacgtggtactccattgatgaaggtgagctgctcaccggagaagaggtatataagccatcgttaattactttttgcaaagatagtaaatttacgacctaaaatgtacgtgcactcgatcattcttactcccccgtcccaaaatataatatacgagattttagatggatgtgatataagtttgttcagattaataatattaggatagctaagagcttgtgctttgtaacggacaacaaattgagtttctaatttattaaatcaattaacaaacacttatttagtccaagtactgagagccaacggtgaaacgggggaggactcgttaaaagataatgtaatggtatagattgtggggctcacacggtagtagtagagatggtgtgggaatggacaccaccagaactactaacattttaaggactatagattacatctacccaaaatcatttacattttgagatggaaggggaacatatactatatttaaatggttataatacattttctaaataaggattaccagaagacactataccattccagaatggaatactttatttctggcatcaccataacgccagcatggcacaaatttggtacttatatgatactagcattagacatgataaacataggaaccatatctaatatcggggtatcatacatgatactcataggtaacagtatttggtacctagatcccatgctgatgtcatgatgatgttagtaaaataaaccaccgttgtaacgatatagcatttttttttattttttttgttttcaaaaacagtaatgctgattgtaaatgatcagtttgatgctaaattacctatatatcatgataattaattgtctctagttaatttgttgtgaacgagaatttaacataaaactagcaatgcaagttcatggaacaatgtgggtgcacttccaaattatcatgcatgaaaaatacatctctgcacaatttgttaatcttacagtcgaaaacattaaatatcatgaaaagcattgacaagtaattaatcccccatatagattattcgcattgaacttccttattttactttttttaagagaagttcacggttcatgaatgaataataaactcatctgtggtcaattttccatcaacttcataaaaccaatctataccaaaggagaaaaggatgacagtacgtataaataaaaaggatgataacatctgctgttgtatgcatattctagctagcaaaattaacaaaatcaatcattaatattactacttcttgagggtaaacttcaataatttctttatgttcatcgtcgctagttattattcagtgaaactttaactttgttttatgttcaccaccttctaactttgacatatagcgcaaaacattatctcatatgtatccgcaaactattcattcctattgaacctatgtctggtgttcacatcatacaaggggtaaagacaaagcctagggcaattaggactccctaatcccttttaggtcctattgaaaagtaatgaaaagtcaaaggtaaaaacaagatgcattagttcggtcttaagtttatatatgacatggaaaaattataataacattgagatctatgtgaatgaaaaatattagcccttaaaaaaagcctcaacttagatatctaatatatcttacataaaaataaaatatctatcgctcaacataaggattacaaagaaaaaaaaatctttttagatcaaacaaaaaccacccatatatatggatctatcacggagacggggtttgagcgcccgctactaatatatggattattagagacccttgagcctccaaaattttccgacatagatacagaaaggccaaaaataagttggagctttgtctagttttttttagcccctgcttttttcccccctagatccacccctacacccacatattttttttgataaaagaaaaagaaaaatggatattaacaagaaaaaagaaaaagaaactagcattgcgacacaaaaccttgcaagcaaaaagcatctatactcatcttatcagttcaagctggattacgaaaaatggacggtgattaaccaagagggtaacacctaccgcgaggagatcgaccacagagctagctgctagccggccgccggaacggaatcgatagctgccggagtttatcaagtaccaacttggtcgccggaatcggtggccggagttgtacaggggtgaggtttattccgacgaggtaactgtatatagcctctcttgtgtatttatacagtccctgcaggacctatctggctgatgcagatatgcacagtagtataccgtgtcttaatgccttccataatcagataatcagaagaaaacatgtatctgcatatgtcgacctgtatgacagaattaattggtatcgaattttgagccagccaagaaaagcatggataacaatgcaataaatagaatcttggtcgaacagtcacacgaaaatagtacgggcattgtacagtgctatctcttggctgcagtgtatatccgtcagtaagagtgttgtaattatgtactgtattaattagtactagctatttgtgagaatatgtgagattatggtaaccgacgattgactttcctgttattcttgtatatatccagatatacacatccaccaattttctagccgttaatgttattcctatcctagctatcacccgtttcgagaaatctgaaatggtatttttctttaataaccttaattatcactccccggttgcatatatacacactttgaagtttttctctcccttttttttttagttttggaaacaattgataaatcgagaaggggttaaaaaagtactacattcatccatatatctttttagttatgaacttgaataggtcggctgagagaactcatatctagtttcatatctaaatatatatatatatatatatatatatatatatatatatatatatataaggatggatagtgaagtttattgctctcaccttagaatctagtagcaaacattgcaaatagttactagataaatacaacgaaaacatgcacaacacgttcatacatcatactcattcacacaccacttgacctccacagcacattttttagttttggaaacaattgacaaatcaagaaagggttaaaaaggtactacattcatccatatatctttttagttatgaacttggataggttggctgggagaattcatgtctagattcatatctaaaaatatactttttttaaggatagatgtagtaaacaattttacagtgaagtttattgctctcacattagaagctagtatcaaacattgcaaatagttgctagctagataaatacaacgaaaacatgcacaacatgttcacacatcacactcactcacacaccgcttgacctccgcagcacgggaaatgtgctaccctgtgtaccctagctagccatctgtcctatttaccaatttcatcccacaaaatctagattgtttgagctacggttaataagaaataaaacaaataaataaaataatcaaaatagattgaatatacttttatacttctatttatattactagcacgtagtccaaaaaacaaggttgaaaaatagagaacaatttaaagccctaaaatcaactctaaaattaaattgtaaaaattcaaattttgattgtggcttgtaaaccagcgagaaaatttatcatgaggcggtagtaagtccaatggtaatatgttactagcctagttgttagcacaatccaataatcgtgcactatgaattgatatatgctcaactggttagattttttatgatgaaacctatctactcaggtttaaatctctgatgtagtatatgtgcccacattttacgatatttttgttgtttctaggtaactgatttacaaatcaacagcgaggcatctacggtaatttcgtcaatgtcacaatgtggtatctttcgagtatgtgatgtttatagggccaggtaggagtgtgtttgggtgttcatatcgatgagtataataatatcaatgtaggtaacgtgttttgaaaagaaattcaatcgtacaactctggatatctttttaagatacttagtactccacttaattgaataccaagtagaagtgaaagctcaattagttatgcaggctcccttatcctaaaacttgcatacttagatggaactcgtttacttgacatgcatggatatggatacttgtattttcgtagagtacttgggtgtaaagacgttgacggccaatctcttcatagacgtacgtatgctggtgccaggacgcatctgcatggatgtatatacgcgtgaatacggtgtgcgcatcagtggcggatccagggccccgacacgatttttttattttttatttttaattttaaaaataaacccatccaaattttattttcaagatatgaatcttttgtccacgcgagaacaatactgttacgccgctccgctggcgtgacagcgttatttggccacatcaacgttgcccgcgtgacagcattatttggccacggcgctctcgctggcgtggcaagataaaactgtcacgcccgctgcaagtgacatgctattattgttttgtcacgtcagacgggctggcgaggctaagaggttcagattttataaataaattttgaaatgatttagttttaaaattaaaaattaaaaagttcaaaaaaattaaaaaaaaaatcccccgacaccagcattggattagatgcttaaataacagtgcttagtcattagcccggctacacatgtactattagattagcactaattgtcatgtttagtcattagccagcagcttaactttgcttccgtatatgataaaatgctctatgtagttttaagaatttgtgtctacttgttaatttgttattatcgtcgttcggtttgtccagttcaagaaaacgtctaattaatccggtcaactgctgtgcatgggttgtgtccgacttagtaaaagaagactatatttatagtatcatattattttataaaaaatagtctatttttttactctacaattacaacaaattttaaaaattacaccgtaatcacagctgtactgtaatttttttctggtacagataacactatatataagaaattaggataaaaacaattgattgttttacttcaaagtttggaagggacagataggagacatataagcattagaaaaggtgactgcaatcaagtaaaatatatatacatcaacaacagtaaaactgtaaaataaaaaataagaaaaccacgatactccctccgtctcgaaatataagggattttggatagatacgacacattctatgtccagatttatggtattaggatgcatcacatccattcaaaatccataatattttgagatggatggagtagatttcaatacatcaactaacaaacatcggccagcctgacacattattcgtaccagaaattaagcctctagctagacctgatcttggtacaccacgggaagcccacagatgcagcgcttgcttgctttcaaccgatgcgcttagccggcgtagccgtagaccacgcaaggccggccggctggcctatcgatccattccagttgcagagacgttaattgcaatgcaatctctgccgtttttagtactgccgcctttcccccctatccactatccattatccaatccatctgatgaacttccttggtgaggtgaggcgcccaatcttcttcctcaatctgtaattttttaatcttcttcctcaatctgtaattttttttttgaaagattaacggcaggagctctggcggatatattagggtaaaaagagtcagacaaaacgaaaaacattaaggttcaaagaaaagaggggacatccagaaaggaaaataaactcataaagcctattacagaggagaagagaaacgactcagctgagacctagcctttaggcttatctcgaaagctcaattaaatcaatattttctttgatcgtgcaagctacttgtgattcgctttagcatttatgatggaagattcgacgattgcgctcgagccagacctgccaccatgttgtgagtagagcgccaatcttcttctttgctgaatctccttttgcaagaaaaatctaggaatcccaccaattcgaaatgggtgtgtcttgccaagattgtgggggagagattgtaaccaagccagctgcatactaaattccacacatttcttatgaagctgcattctttggccaagtgatttgcatcttcgaaagtgtttgtacacagacttcatatccagttacattgccagtgacgtctcagcaaattttccgccgttagggttctctaatgcaaaatgagccagccgaaaaaacgatgttttggttccgcctgggccttccataggggagagaagtttatgttagtgatcatacattagaattgtgcttcataagcgctctttgctgagtattctccattgggagtcgatttccaacgaatgtcatcgggggtgtttttaaggagcatgacttcttacaatcggctacccagccggaccagttcatcaatttcacttatcgtggtaatggggtttaggatcgccagccagtggttgttttgaaggctgaggtgcacattgtttcattttctcctggacaggttgaagatccctagagctaaatctttaggtaagcaaccctgaagccagttatcagaacaaaaggagcatttctttccatttcccagggtaatgactgttccagctcaaaaaagcactctgtccaattcatcacatggcacttcaatgttatgccaaggtctattatcttccttccagccaaaccagagccagtgcagccttaaagctcgcgagaatttttccaaattgagaataccgaggccccccaaattcctaggtttgcaaatgttctgccaattaatgagactactacccaaactgacattatctggatcatctcccttccatagaaaagcacgccgaaatcaatcaatccttttatatagccacttattcttattcctcaatctgtaatctttccactcttttgttctttctttcttcctgtttcgtgttgttcatggatcatctctacgactctacactcatagtattacgtttggggatgatggctctggttgattggtagtaattggtagtattctctagtttcaagctgtagaatttccgtgtgagattattggtcggtgaacattttgcacaaccctgcagtttccactttctagttacagatctgtgtgggggttgatatgtaattggagtgttatgggcgcttcatgggtatggattgttttagttcattttgggcactcctctgtacgtagagagaaggggtcgatcaaaaacggaagttaattgagaaatgaagcgactctagcctctaggactgtttttccgttcagtcgatattgtggtttcgattgatcattgcgcaacaacacaggttatagctaggagcaatgccaccaggaagcttctatatattctacctagtctgaaatataaatttcagttttgaagtttgaaaagttaaatcttttgtcataatatttaatatttatagccatcaccagccactattatatttccttttgagataatagtgtggaactaagagaaatgtaccatatgttataaacttacaatttctatactctctgtgtgcatttttttccttcaaagctactcaatacatcaaagaagtgaattgggtatctgcattgacacgggaaggaggaaactacggcgaaggccttagccctcggaccaacaacggcgacgcctacgggcgccgcattcttgttggggtgttgttgcgtttctcctatccaatggtttctttaggtgaaaaccacgtcctggttctctaggacggatgacggcagcgctcttagcgtcattcagaagaaccattcctctggggtgttgtgtgcttggtttatttttagtagcaagatcagacgtaaatgcgtgttgtgactatctttttcttttttttcctgactatagtcttccaggactatagacttgtatttttcctactatatcaatagaaatatcatactatcttgtgcgggttgtttaaataaaatgggtatctgcatttgtacaattgatataaaatatgaaattacaagatctatcaatacatatcacttgccatgctaagcttacaaactaattatcatcccttttttctcttctgctccaggtgtctaccaatacatatcacttgcctatccattccacttctatgactcggctacttgcttttctacgacacgtcaagccgagtcatgacgtgaaaatccgtggattaccctttatttaacatataagtaagttcgcgggtctgtccgtttgcatccataagcggtgaacctggcgagctggcaccctctgggagggcagcgacactggccgacgaacgccagcttcgttgtccggttcggctccgtcctcccggccaaggaggcggccttgctggctgctaccgtgccaggtcgctgagtatgtcctgctcataaagttccatgttgtgacggctatggcgggggagacgccgccattggcgctcactctgaccgagctgagcatgcggatcgaggagatgggcggtggtcggttcgacgggcggcgcagcctggtggtgctgaaggaggcactgggatgctgtcatcggagcggaaacctggaggaggtgatggagtcgtgtcatgccactcatacctgagggcgcaaagcaagctgagggaggagaagatctgcagcgagtgccggttcgacgctctgtacgtcgtcggtggcattgcagtgtttgttgccctgtgtaccatgtggtacagaaaaaacgctcgagagcttgtgaagctggagcagatgtatgatgaattgatgtattggccatattcttttctccaataaaaactggataaacttttgaataaaagtggcacgcttttcaaactgctaaacggtgtgtttcgtgcgaaaagtttttatatgaaagttgttttaaaatatgagattaatctatttttcaagtttgtaataattaaaactcaattaatcacacgttattaccacctcattttacataaaacacttaaactttatcttcatcttcaggagattcaaacaccaccattaaggcgtaatggatgatagggatttcagaaatgtttgttaaggaccacaggagtaactgtggactgggtagtttaaaatctagacggtaggtagcttctgagagcggtttcccaacttgtagcttttagttcattttctgaattatacaagttatcaaaataattctcaaaatctaaaaaagctatactattaggaaaagtttctatttggatagaaactttcagccccatgtttggttgtttggtagaataagccaaacggtatatttataaataaaaaataatttttgaataaaaatgttatatacatgatctaaacgatttaaaagcaaaggctgaaaaataaactacgatgaaaaagctctacaatcaactctaaatttaaggttgaaattcaaattttatcaataagcataagcgaaaagaagagaccgtttccaaacaaaccatatgtttaatcccaggcgatgtttgtgacatcgtaaccctgcatgttctgttattttggtaatgtggttagaataatacgaggtataatgaaactagaataatcagatttatccatgcaaaaaaagggaaaaagaaaagagggacaatcagaattgcaataagaatagaaccatgcataatcaccactcaacaataagaagatttatacagtatgacagtaccaggaatctcaatacaagagaaacaaaaaagtggaagtctgaacatcaatgtgcataatacattccaaaacctcgctagaaataaccgcttgtgccaaattgagggtaaaaataatatacacatggatggacaagaaccagaacaaagctcggaacaatgtagtgacgcccttggtgctgcatagagcagaccatgtacaaataaagaataccctgtaaaacttgggataacggcagagtaagccaccggccaatcgtcttcgaaacatgaccaagattgctggcaaacatggcctctcacgtaccatgtcaccaatcaagcaaaactagtaaacatgcagcctttgtagtgggaaagagattcatgcttcagaaaagatcatgcttccttttctgtagttcttgtttccaccctggctgctggtagaactcttccttcgttataccaaatacagtctggaattcgctgtccgacaaatatgtctgcagaagccgcacaaaagttagccattgaaactcatgcaggccaccattcacattatcaaggtgttcatatgaagcattagcagacagtaaaggctgtgattacagatggttgctagtaatggaccaattgtgagtttgccactgttttgttttaaactaagaatatctgttgcaattcctttttgaaggactagagcaaaaccacaaaaacaatactatcgatgtatcaatccttccgttgaagtttgaaaaaacaggaaaaaattgaagggtctggcagatagatgattggcaataatcccaaaaagggtctggctgaagccaaacatgtacatgcaaacagcaacaatgggggataccaaagaagaacatggtatcatttaattgaggggaaaaaaaggcaaccaaacctcccaccaattgagctaggctcaattcctataatctaaatttctttgagggcactatctagttggcttgctctacctttgagtggcttgcttgcatgttgcaagtcatgcacgaaataacaccaggttatatccacttggaatactgaaaccttgttgaactcactgcaacttctgttatgtactcgagttactaaacaacatatgcattgttactgtggttttactattacaaagttcctccaaagttttattactaaaagtcatttctcctgctattttatatggctgtgctcatatcattttttatgttgcacaggtaattaactcacatatttatgggtaaggtaagtgcttatccatttcacaaggtagcagaaacaacacataacacctactttgcttccaaggttgcaaggaaaataacaaacctctctgcgtttgtaatctatcccacgaacagggttggtagattttgatatcagccgatcatagctgaaggttgtttcacctccattttcattagcagtctgttccactgatacgtcaggctcagttcgccctccctcagataatgccccatctcctggggcatctttatcagcggaaaattctgatgctccttcagacagaggggatgcagcagacggagttagttcagctgtatctgcatcacctgaaattggcaagatccaacatcaacaaaaagaaatatttgttaactctaaattttgcaagcatcgtcttcatctactgttcttgcagttagtcaatgagtacagtatcgcccatccaaaatttacaaaacaatcaatgcacaacaatgcatcaaaagtctcacattataagcttacagaggacaataagcagagacctagggtagtgtttgcatctcctgaagataaagattaagtgtttcacgcaaaacgcgccatttagcagttcgaaaagcgtgccacgaatatccaaaactttatccactctttgtagtggaaacgaacaggactattcatgaaatatgtctagcaaaaagaaacgatgcagtgcctagaatatctattattggttagtagcaccacatgaaggaaattgatattgttacccttaaaatatatgcaggggaaggaaatagtaggccacaagtcatacctgccattggggaagacctacctatgcgtgggctttgagatgaaccctcagcagtcaaaacattagacagcgcagcaacagcagctgctcgctgagaaccttgacctgcacgttgtggtgggcttttgggttttgctgatggattgaacgctgatgttaaggcagccattgctgaagcgcgctgagtgggtccaccatcagagcttttaggcctatcattaccctaaaaagaacacaacattgcttatagtttgtaagatcaacaaattttatattttttctgctgtgcattgggagtgttaacaataccttattcttttgggaagatgggttgaatgcagatgaaagagcagccaatgctgatgccctctgagttggtccaccatcacctgaactcttagatccactctgcaaacagttaatgagatgggttactaacaagtgaatccatacacattacgtctccaaatatctgcttttcacattaagtgaggataattcatagaatttcaaactttaagagcaaaaaaaaattaacgtacctctgagcgcattccgaaaagaagtgaaagcttcttctgaaatgaatttccatgaatctgtttcaagggtgaaaagtattatatcctgtgctaaaacaagtgtgagcaaagaaatggtacgaccaaataccacagtataggcaagtacaaccaaactgaaaaataagcttgcagaattgatgaataaataattgaagaaagcatgatagcttccatgtgccagcctcatagcaactgtgcacattcattcattcatatgggcaaggatgtccttgttctccagtcctttagattaatttaaattattttaaaatcaactggatcctttcttgcctccccaggtcccttttacttctattgaggactaccaacctaaattagcataacgaaaagaaattttccttgtttcttatgacacccttaagtcggattcgacaccatatgtttaacatggcaacaatctaagcatacacaccacaaaactaccccaaacataatagctgatctaatgagacatatatgtggtaggcatttattagtttagctaagaaacagggaatgaaacatatagcaaaacactgaaggagctccgtgtagctacatgcatatgtactgaagtactgatggacatttagagctgctcagaaggaaatatgaactacgaacataggatagatctcttatacgaaaaattgcttccaaggtgaaatctcttaaatacaaagttccaattgatagaactgagaaaaaaagatatagtggtaaatatccaatagcataccacagatcttgtgttatcccaggagaagtaagttctgaagaagcatggttcattcccttcaacgactttgtacagaggcacatcaggagaaagagattcgaaggccgccgcatgttctgcatatttctgagaataaagcagttattgctgagttgagcaaagatgatgatatttaagtcagcaagagtaaatcttcatatcatacctggccaatttcaaatgccttctgcttctctttagcatccacacactgacccatccaaacaaagacttccccatgtgtatcaagaaccatcatgtcttcagtcagcaaatcatcttgtgaaaagttgaaaatttcagtgacctgcaaataaaaaggtttttgagaaactaataatcccaaattgttgaagcatgacaataagagtaagacaacatacctccagtttccctggtaaatggtgatcatgtcagtgcaaacgaaaccaaaaaaaaaaaagagagagagaaacattagggctctgatagaatataagaaacacattgaaacaacaacaggacaaattcagaatcaagttttggctggaactaaccattcctcaatgagaatgtatacaagtgaggctctctaacaacatcatgtgtggcatttctgcttgtgtaattctgctttccaccaagagcaaaccaaaaggcagagctctcagttccctccttgcaatgtttgacagcaacaccaggctgcaagtttggaaacatcagataatcgtattgagtgagaaatagctaggaattcaagaaaatatcaaatgctttcggtttattcagaacaaaacattctggagcaacaaccaagttagttctatcacagcggaaacagatttccagtagttagtaacctcacagggatggtatatttgtgctagtccctttcattcatattggtcaatcacataaaatgataactgtactttagaatccaatcaacaaatgtgtgcccctctgaaaaaggtatgccttacatatatagtttcaaaaacacatttggataatatagtcagaatgttgtaacattgctaatctggactaacagtagatcaactggttgtgacaataggactggtacttattgcctacatgatcaacttcagtcttaataaccatgctgttggaagctttcttccaaatcaagacacaaccaccatattttccttcctaaaggttcattttgaatttctataaaagttcccaagaacagaagacattgttgttttcaagcccttaaactttctactttctagtggacattttggaatttggatatgatcataattagcaaaataaaaaaaagaagaagaagaaaagaaaaataacaggaacaaaatttgaaaatatatttttgacctgcaatataatattcaagtgcccgcataaagaaattctttccaataatgtccacagcatttttttcccgacaataaccacatgaagtggaatattaaatggggtttcctcatttcataccttcaagaattcagcaacttttgcagcccattgttgctgttcatacgaactggcattgccaatccatgtaaacattgaatttccagattgcaggacaaaacaatccgtgggactcaagtttgatgacacctatagaaaaatgttacttataagcagatgggcgcagtaaattaaaatttacagataatggatgcctgtgaatttcaaatgagtctagtaagaagaaaaaggtcattgcaaaggacaagaacaatgtggctaaaatgaaatttctgcatcagcagcacactcagaagaaaatcaatcgatgtatttatgccacactcttctgtgtttccataaaaagaaaaatacagacaaaaataatgcaaggtagattctctagctgcaccctaaggaaatcactaatcaacattatttgagccctcattgtttatctgtttgcagttgttatactctacaatctcactaaggccatcaattatcaattatgctattaaatggtctacttaggcctgccactaggaagggtatgggtgacccatatccatacccaattttacccatatcaatttcataattagctgggcctcacatatacaaatggctcaaaacttgcacaaagttgcttctctgcaataaatcatttctacaaaattcaaccgaatttgacaagtttttatagtgcggatgcaagttttaaaattttgggtccaagctttacacacataaaatgggtatgggtggtaatgatgggtattaccctcccctaatcaaaattgaaatgggtaattcctccctacccatacccttcccaaatagtgtgggtaagggtatgggtgtgggcattggatacccagtggcagccctaggtctactctgtcatgtctctatatatgagcacatagaattttagaatagtttgctattataaagtaccattttgaaaacatacaaaaccaccaacaatattatcatgttgaatcttcataggcacagccattgcaggagaggtaaatattaccgcatcaacttgaagcactttattgttgtgaattgatgttccagaaattcgaaaaagagcaatgccatcgccagaatatgtttcatccttcaagcccttttcttctacaaatttctggtatccagagctgattccaccctgcacaatatgccaaatacacttaactgatattgtttgaattgagattggacattacagttcagctatatagacagtgcgcacctagttccttagagaacacccactattaccaactgcttctatttaacatgaatatggtaaggatcaagtaccatacctttagaatgaccatgggctggaaaagggcaataaattgtggtggttctttcccttgataaatacgaccctacaacaccagatataatgtatcaaactcctttccagaaaatctgtccacattgtcatagtaggaatacagtaccagaataggccttcctttcagtgaattccaaattgaattagctgtttggaaagccatctcttgatcttcctgtatgaaatcaaccaaagagtaagttcacagatcacacaacagtggtatgaggcgacaaaaatgttgagtatatggtacttagagtcataataggataggattgatttgtatggactccttccttatctctaaatccttccttatctcctctacatgtagtcctatatataccgccccccaaggctcaatacaatctgtccaatatttgcagtatttctctccctatactattcaacatggtataagagataattttgtcacccataagatgatactccctccgttttataatagatgacgttgtcaacttttggacatacatttgactattcatctttttcaaaaaaaaaaggtgcaaatatgcaaaaatataagtcatgcttaaagtacttttaatgataaacaagttacaacaaaataaatgataattatgtaattttttaataagacaatggtcaaattaatgtccaaaagtcaacggcgtcttctgtaaataaataaacagagggaatatttattttcacctgagatgactagtaatatttaattgcacatgagaactggtgattatttgacataaaagtcaagctcttgatgagaacacacataacatggcattgacaggactttgtgttgatcacagacaaagtaagaagaaagcactatagtatagaagttcaagaataagattgccaactactccctccgtttcacaatgtaagtcattctagcatttcccacattcatattaatgttaatgaatctagacatatatatctatattcattaacatcaatacgaatgtgggaaatgctagaatgacttatattgtgaaacggaggatgtacattctaaagcttgggagcactggaaggtacattaccggtatgctgtccttgccaatccaataagtcaaataaaattcttctctcttgtcaccagaatgatatgtatagagaacaatatagcaatctccgctgtaaaactttccaagctcctcctttggaagagcagtcttagcactgccattgacacaataaacctgaaatatccacatgtttcttatggttacattcctattattgcattttcccagtcttcctttatagttgctgaaagcttataaaatatacctcaagttttccatcgccttctagcaaaggaggaacttcctcgtctactggagcgctgctttttgaggctcccttgatatcaactccttgttgcttcaacagagctataggaaaagcaaatattatcaagaatgatctaagggtcaattattttatctcagagaacatgaacaatatacacaacctgcaactttccctcggccttcctccgcgccagcacttcctgcactatttactggccatgattcaaacttagacttgaatgtatgattctcgtacccttgaatcactcgggttactcttgttgtctttggcctattttgagtagcaatgaattcctacaaaggcaaatttagatcctaacaaatttgaataggcaagaaaaaaaaaagaagaaaacaatggcttgagacttacctcaactgctgcacttgcagcttttctctcctccacttgtgttagtcgaccaacccatataaataaatcagacccacagtcgaccaaaaagcacttattgttctcaagaattgattttgtcagaactgtgtcttctaactttaattgaccattattgatgctgcaagcagttgatggcatggaaaaaaatcaggatacaaaaataaagttaagccactgggaaaaaaagtaagataaacatagcgatatatatatatatagtctcagacctaaggatatagtaagcgtagcaaaccaactaaaactgtgatacccatttagtctatgctacaatacaacactaccaaaaacctgagaaaacctatataaaacatgggaaaactattaaacttatgagaagcctttgaaaaggtatgaaacccttcatcaaccagaaaaggacaaatcaatttattggtaaaaatgtatctacctaaacaggaagctatttacagtaacattaagctgcaaatacatacagctaaaatggttgtatctgcatactgaacattcgttgaaattatgtcagaagttgcttaatgtactgtcagaaatccaaaagtaataaagttgaagtaagaagtcctaaaaatggatgtatgtaattagcatcgatacttttcaaatagcatcatcttaatacataaatatacacatgccttgcacacaactgatggataaatttttggagttttatatgaagtttagcagcctgtgtatgatcagggaggaagttagtccatgccatatcatgtgttagaacaatgcttttcggcacagaaattcttcaatgagcgcaccctaaaataacttcactgtgaagtgcgtaccatacatagggaaggcaagaatatgaagttgtttggagcatctgattactaaaagacaagggtcctatctggattcacaattctgtaagcgcaatttaaaaaaaaaatcatacctgtaaagcttgggggctgtggtttcaagaacaacatcatcgtcacatatagctttcttccctattggtgcaaaacctccaaaaagaacccagaattcaccagaatctgattctgcttgcaattttccatcatctatcacaaaaattttgtatgaaaatgtgtagatttgtgccagaaagttacatgaattgagatttggttgtcgagcataccaacaatcgcaacatcacacactccattgtggtatgtctcctttaaatgttgaatcgcttccaaagctttcgctctctcttgaatattggagtttgcaccattgaattgatatattttcttttccgtatccaagataaatacatcatcatgattcaatgacgagcgagcaaatggaacctgaatataggacatttagtgtatataacatgaggagataaagtagtctaagaaacagggaggtgaaatagtagtcacctctttaactctgatagctctcttccctttgcaaatatatagccttgtttcaaacttatcctcttcaggtgttttaaacccagaggcgaaacctccctccaagggtataatgcatggtttaaagtacgataggaacttatcagattcatagccttgaagttctctgtgctgcactgcacgacctccgagcatggtgtcaagttcaactgtcttaattgctgcagtcccagcttcatcctgaatgagaacacatcaaatcaagaagtgggctggaaatgccatttatcagtacatgaaacttgagatgttagagaaaatgtacttgactagaatctttcccaatccaaaagtggatgtcaaaaagataggcgccaccacctttgctgcaagtcgtctacaaaacaaaatgaacagatcattgaaactttccatagtggagataacagaaagattcttctaaaatgtaaatataaaaaaaatcacctggagaactatatatgaatctccattgtaaaatttaccgtaatctgcttttggcaaaggaactggcttaaaatcttgaatcctccatatttctgtgccactatattttaattaaggggctaacagcataaaaggatagaaactcttgtacgtagatttctaaaagaagacaactaaaacaaaccataaaggcatttaaagaaggatacggtttttggccaactccttgaaatgcaggatcaagcactggttttgcacttgacattgagcagcaactttacaaaggtttaattgaaaacagggtagtggaagatggctccaccacagaataataggaacttgcacactgaaaaggggaagaaaaaattatatgtcaacaagattagaaagaaaaaatagccaagctaatttggacttctatacatggatcgaaagaccagatgttaaaagagcaatgatattcaaacaaacaatcaactcgaatcaagacaacaaatagagtagttagctgttgggaaatatgaatgaatggaacacacaagtgaatgatcaaaacgaacatatcctgaatgaaaccatcgtaaaaggggtatatcatgaaggaaagcatcatcaattgcatgcagcccagtaatgactcaccagaatcgcacaatttcactcttataaacgaatcagtaagtcagatcaaaacaggtaaaccggaataaaccatacacgacgtgctgattacatctacctgagcccccatctacatttgaaagacactgtaacgtagagtacccattatatttgctaatggagatgtacccatcagaggactgagacccaaatgcgcccatctattctgattgatctcatcacgaagccagtggctgcacagcgccaccggactcatgcccacaaagcaatcgcccccgtattctcgtcaaccacatgggctgcattacgagatcaatcaaaccaaacacatcatatgcagatctcatcacccagctccctcacaccaatttggaagatgtgtgctcgtgttaatcatcttctatccatcagattggctgcacgagcacgtgccgacggcagccaccaaccagagattgggaaagctgattcggcgccacccaaccccactggggtcactgatcagctgccagtcaccaccgcccccaaagcggaagggagcggattgagagctaatccacggatcaacccccgcacatttcgcctccgatctcaccgatcggttaggcaacccacccacctagacaccccccggatcgccggagacgaacaccattcctgacccaccccgcgcccctctctcccccacacaatggccggcaccaccaaccggaacaaacaacgccgcgcaagagcggatcgtcgagcgagaaaccaaacccaatccgcttcattcccgaagaaccaacgagcaattgcgcgcgcggggagacgcacgacggcgagtcttcgatcgaggagtcgagagggggtacgtacctggagaaggggaggaggacgacgacgacgggatccgatcggaggctgacgggaggggaaggggaagagggggcggcgatcgaggtggccggcggaaaagcggagagaggggtgacgcggcctaataaaggaagcggggcgctatgattgctcccttccgctctgcctctctgtctctctctctctctctggcctgtccgtgcccttgggctgggatgggaggggggaggagatgcgaatgaatggaacggggtagatctggcaaagcgcgctccctgtttttagagcgagcgtggcgagagcggcgtcgagcctgggccggtggccgccctggggtccctggacggtgggggaaagaagtggcactaggctgtagcggagaaaatggggaggcgttttcctcgatggaaatttgaacggctctccctcttggctaacaaatgatgtcatacgtcggtgtcaaagtaagcgtattattaatacggtcaatttgatcctttcattttatatactacctccgtttcttttttttttcattttatatactacctctgtttctcaatatatgcgtattattaatacggccaatttgatcctttcattttatatactacctctgtttcttttttttttcattttatatactacctctgtttctcaatatatgatttttttttatcgacatctgatcattcgtcttattaaaaacttttgtgcagatataaaaaagtttaagtcatatttaaagaatatttgataataaattaagtcacaataaaaataaatggtaattacatgtttttttgaacaaaacaaatagttaaaacatatttttaaaaaatcaacgtcgtcatatattaaaaaaaacagagtgagcattttattttcggttaacctaagttttatttggagggagagacgttttactcctagtttgttgttcgatagtagagatgataatcatgagtcaagtgagaattgaattgtacgcaatgatatacggctttagatttatctagtcgtacctagaagagaattatgtcccaattatatacccctgctcaggcattaaaaaggtgggagttcgctcttaaacttttaacgcccaccaaccgtcctcatttttaaactcatattctctactaacaatttccccccaacttaataagccattagtctctagcgtttcattttgttcgaatcggtccttgagcttttgagctttgctcttttgttccatacgatccataacgcccacctaatgaatcgggtgatcaaggcaactcaatgaagatcaatcttgttgatgaatgtgacgccctgcacttttaacattgaagataaaagtgccagactatagattattatttaacaaactattattcccgcacttttaacattgaagataaaagtaccaggctgtagattattatttaacaaactattattcccgcacttttaacattgaagataaaagtgccaaacggtagattattgccaaataataatatagcacttttatcttcaatgttagaagtgcgaactgccaaataataatctacaatctggcacttttatcttcaatgttagaagtgcagggcgtcacaatgaaccatatagctaaaagactaattcaccattatattttaaattccaacataaaataacaatgataaaataagctatagaatccttcttaagtagtcatgggaccaaccgatgtttattcttagacttgtttcattgttcggactataggatagatataggatagtgaagcaatggaaataggaaaggaatcccaacgtaaactagggggttaaaaaagagtttgagatatgtcatcagtatctcaatgacatgtaggacccacatgagtcaatgacatataggatccacatgggtcaggatggcatatctcaaattttataaaattataatggcatggttacaattttcccttaaaaatatatgtcagttctatcttcctccatccttctttttctttcttgcccatgtgcagttgaggctaacggagatttttatgtgcagttgaggctaacggagattcttatggaaaacgcgacggagtggcaggttccaattccctaaattcccatgacacatatacaatctaaaataacatatttgtattggcatggatcgaattaacccatcgtttttaatgtgttttttcccgtggaatcgatggtgtaggaaaatttcttgtgatttttttgtgtttggcttttgcgatccgaatggtatgaaaaggaataaaaacctatgaatagtattcctccaaaaatcccatggctatcctgtaatccgaacgaggcctcaaatatatacacaaggatgtaacaatcatttcgctgttgatatcaacacaatagatacacaaggctaaacttttcttgagttatgttcgtattgtagcatattaggttcatccaattaccacgttgacccaaaatgcaagctttaagcactgaactgtacaaaataaagcgttacttactccatttcatattataagactttctatcattgtccatattcatataaatgttaatgaatctagatatatatgtgcctagattcattaacatttatataaatatggataatgctagaaagtcttataaccaactgtcaaaatagcccttaagtgaaacttagagggacaaaattgactattctctcttgtcactaccacaactcattctgttcaaagtgaattctcgttagtttgccaatcatcgatcataccatggatcaggctacaatgcccagaggtgttacacagtagtatgttggtgacgacaaaagctgacaatacctactaagacaatgcataaatgtcaaggatgagcaccgaagcaaggacaactaagaaaatgtcgcaacagaaattgtactattggggtgtttagattcaggggtataaagttttctcgtgtcacatcggatattatatagggtgccgtatggggtgttcggacacaaataaaaaaactaattacataatccattagtaaacagcgagacgaatttattaagcctaattaatccatcattagcaaatgtttactgtagcatcacattgtcaaatgatggaccaattaggcttaaaagattcgtcttacaaattagtcgcaatatgtgcaattaattattttttagcctatatttaatacttcatgcaggtgttcaaacattcgatatgatagggtaaaaaattttgggtgtgatctaaacagggcctgtcatgtgacatattttttcatagacatatttttttagtattttctcttttccaatgtacaataactacatagtatatgcatgagagtttttcaccgattcctttttttccggtgcaacttaggccttatttagttggggaaaatttttgggtttggttgtcacatcagatatacggacacacatctgaagtattaaatgtaagtattaaacgtagtttaataataaaacaaattacatattccgtcaggaaactgcgtgacgaatttattaagcctaattaatctgtcattagcaaatgtttactgtagcaccacattgtcaagtcatgacataattaggcttaaaagattcgtctcgcaatttacacacaatatgtgtaatttttttacctacatttaatactccatacatgtgtccaaacattaaatgtgacaacatggaaataattggaaataatgtgccagatctaagatggtctacccaacgtcattcgccacaaaattccaatttccaaacctgttgtagtataaaggtggtactgtcctaagcaccgagagggttagtacgaacaaagctactctcgttagcgtcgttgccagatgtatagataaggtgtcacatcttgggtggaagaggtggatgccaaatagctggtttatggagaaaatttgtctgatgaatgtgggggtgcaagctaggttccgtcgctaacatcacgatcaaaaggatacagtgtagaagcggcagcgacttgagatggcaatggcgccgtttcctgtttcccgtttcctacagggaattctcttattagggagcagtgatggttagaattggttcttcgtggggatcaaatgggaggattgatattcccgccgggtttcacgggagcggggatggtcctccattccatgttcccgaccgccacggagagcggcatagggatacaagtttaatgctttttttaagttatcttatgtgactaaattacttgtaatctttaataaacgttaatcttattttttttatcatgtgacttagtagatatatgttaatatattaatataaaatatgaatatatgtgttacattgcatatataatttgatatgtatatattgttttaagcggggacatagaccccgcgagggttaattccccatgccaggtggggaaaattttgttattaggagggggatggggatgcattaccccgtggggaattcccaatttccatttctagcggtgatcggccagcaagtggaagagctcaacatctcgcaacacggttagcggaggatggtagctaggcataggcattcgatagttcacaggtggaggagacccggggcagaacttgacaatgaccagagaacgggctacggatgggcaagcggaggatttgggcggtgaacgataggtaagcggacgagtaacgctatccgattggaagtgaacaggtggatgaaaggtgaccggcagacatgcgaacaagcggcgataccgggaagtagataactcagggggtaactcgacgacgaccggtggacaggcggacgagtggtgacgattggcgagcgggcaagcgaagtaacagcacggctcacactgtgcgcccgtctaagtgggtcaagatggtccgctcatttttaccgaacggtttggacccggaactaaggagaatattcctctaaggtgataacccatcccacccatctccaaaccaaacacaatagtaaaaaatagagtcaacccatcccatccttccaaccaaatagtacaaccttaggttcttcatcttcttggatccagcgctagcaggaggtggccgtagtagccatagacgctagcaacaacaaaatgtgggtcgaggtgcttaactatggcgctttgggcagcacatgaccatgacaccgggatatgtgtgacacgtatgggctcctcgcgccaaaccgttgtcgatttacctcgtccaagctatacctttttctcaagctcacccaacgtcgatctctaccttccatatgagctcgcccaccgaagcttcaagccctctcggttacctcctcctcatcatctctttctctccttccaaactagtacgggaagacatgttgatgactagctagctaggtcaggtgatgatagagcttctggagaaggtgttaaagggtgtagtggcccgccatgccttgtcaaattccgtgccatgatgttgcctgcaccgtcgcttgccgtagtttctcgctgccactccttccttgcgccctcgtctacatcacggcaagctgccgcttctcccttctattgctgtcaccgctcgctgcaactcctccgtggctttgctaccttgcaatatactccatccgcctcattttaagtgcagccataagttttcgcacccaacttcgatcgtccgttttatttaaaattttttgagtaaatttcactttggaccatatttgttgaccaaaatttcacattgggctagggctaggcttatgttttcacttaacaccatgtataattaccattgtttgtactttggacctgattttacagttaccatcacacgagttgttgtctaggtgcttagcattttacaagaaacaatgatatggaaatttttgccatgcaaatatgattagcgcaagaacaatgattgtaacatgttataggatatcctatcagattaatgggacttcattactactacatatgaacattcacaacccttatactagagacaaaattggagaaatattgagtttaagaactatttttctagaaaagtacacgttttacaatacccaactgtagtgttagttcaaattattgaattctaagttttctaaaaaaaaaagaaataagatcagatctacaatcattatactatgtgtaatttgtgaaacccggtccaaagtataaattatgataactatatatggtgttaagtgaaaatataagtctaactctagtccaatgtgaaaatttggtaaataaaggttgaccaaagtgaaatttacttaaatttttttataactagtatttttattattatgagatgataaaacatgaatagtactttatgtttttaaattttttcaaaaaaattctaaataagatggacagtcaaagttttgcacagaaaatcatggttgcacttaaaatgagacgatgggagtatgttggaaacaactagtctgtcagaaatacaatatctatcaggagaacaacaaaattatcggtacccatatactggtaaataagaaatatgtcagtgcatacttttctcgactgcttgacccctgacagaccctagtggcaatctaagtgacagcaaaagtctttaccacattgtgccatcaatagctgtttttttttcccgaccgatcgagcgtttgagaaacaacacgctgaacagctcaagaaatcgagcttatctctgtatatatatatcggtgattcagtgtacacgagcgcgggcaagcttaatcatctctgtttctttagaagacaaacgcagctgcttttttagaaacatctcaggcaaggcaggcagagagacgatcgatcagacttgtgatcgcaggtgggccgggcccacgcccagccttaaccacgccagcgcgtgtggcccctccggcccggcacggcagaccacagcagcttcaatttcttagaggcacacgtgggccccacatgccagccagcgtgccaagacaatgcatttggcatcctcctcccgaagatgacgcacacgccccctgtgtgatccgtccctcccctccaactccaccgtctttttcctcctctttttgtagagtggacacgagttaagccacgacatcgatagcaagatggtgccgatacgtacgtactgtactagtgtgctgtagttgactcgatcagagtaatggtcaggctttcgtgatcggaaagtggtttgggctgagttgtttttttcactttgctaacttatttctcccatttgccatgcacatatttttttaaaattactaaatggtatgtaatttttgcaaaaataaattatacgttaatgggtaacactattttctatacgaggctaccgaacacagtcgttgagtggacacctccgcgcggcgttggatcagagataggtgatctctctctgtagcacaagcgcgcgtcgtgtcgttggattcgtggaggcgaagcatttgtgcaaggcgagtacgacgcgtacttcagttgatcaatggatgaacaaaagaaggaacgcatgaagcaacggcgtgcacttccgttgatcgatcgttggatcggtggaggtgaagcgtctgtgcaaggcgagcacatcgtgtttggaaggccgcctgcggcaatggcaacagcagcaacaaccgcatgttactcttatgcttgtggcactgttgtcgttggctgcaccacaactacaaccacggctgtcgaatagacccttagcagaacagacgaaagcaatagaaaagaataaccaaatggctggacagggattcagattatttcagctccactacagtctccatttctaagttagatttaagagttagagaggtactaaacatgttcttaaatttggaccacatacgcatacgtaatgtacaggtatgtgcatatatatttcggatcaataatggcataataacgtgcagtagcataccatgtgtataaaatctaagttcagttcttgtattttacaggcatctaagaatgattattcggtggaccacggttatccaatattgttacagtaaggcacttaccacaataacatatgttaactgctaaaaaccacgtgaatttcatctcaaaatgttgaattcaaaatttcaaaaattgtagtaaggtttacgataacaacacaataagatgctataaccgtgttctttgacttgaaagagatcatatggaaaaaggatactacaacatcacatttgactaatgtcgaatatactagatatatattactactaatcatgtattatttgtagggattttttttaaagaaaaactgaattcgaacaaatttaaccaaactctatcatcaataacccttgccatacttttagcatactttcaggataaacacgttacccgcaaaattaccggcaatgtgaaaaacctaggaggaacccatcttagattcttatatctataatcgcatacggatctaaaataagattaaaggggaacccatctctttcttcctcgtcgcaccccctctcttcctcctctcccttccctctttctatcaatagtgatgcagtgagatagggggacttgatcaagtcttcctcctctcccttccctctatcaatagtgatgcagtgagatagggggacttgatcaagtctccctaaccccacgctagatccatcccattcgataatgaattcatctacaaaacacatgtaaacgtgaaccacattactctgcaaaagaacctacgacgtcgatgacccgcaccacggtgagcttccacactgatatgttcatgccaaatactcccttcgtattttaatgtatgacgccgttgactttttaaccaatgtttgaccattcgttttatttaaaattttcgtacaaatataaaagtatttatattatgcttaaagaacatttaatgatgaatcgagtcacaataaaataaatgataattgtataatttttttaaataaggtgaatgatcaaatgtttggataaaaagtcaacggctacgtatgaaatactgtagcagctgagctagctacccacacaaacagtagcactgcacgctggcgagccccctacctagctcccagggggatcgtggcgaagacgatgcgttcgcacatgcttagcttttaacgcgaggatccttttgcggggcgggcacctcccatctccccagctcgcatatattgcacgcaccgctgtcgaggggtgggcccctgccaaggtccatgtgtgctcgggtaagctgcattgattaatcatgcatgtactctcgctagctacacacatgtcgatcgatccgtcagtttacacattgtggctgatcagcgagtgtgtgtgtggctgtgtgctgctgctcgctagtcgctttacagcaaacatgctggcaagctgcgcagtgtattatatgccagatgcataatcatgcatgcatgcaggaagggttgattaattaactaattaatatcactagattggtataaagggaactggccagttgattaaaccatagtcgatcggcgcattcgtactatcatgtggacaaatctatatattcaagcatgctagcgcagtagcgcgtgagtgaagatacataatatactcactcactcagggagcttcagttgtttgatatactcagggagcactaaccttgaatggttaaaaattgaacatcacataagctagcttagcgcaaggctaatagtataactcgctactagctccaattcatttatagtcaatctaatagccaattcatataataattgcttactatactattaatatatggtcccacatgtcatacacacattacatattggagtccgcgctgcagctggctacagatctgtagcccgctgttcttctctctcatagcaagtttaatagtatagcccactactagcttcaatttatctatacccaatctaatagccaattcatacaatagttacttactatagtattaatatatggtcccacctgtcatacacacatcttgtattggagtccgcgctgcagctagctacagatatgtagcccgctgctcttctctctcatcctttatctcattaaaatatgtttacaactagttaatagcttgctattgtacttgctctcatcttttatctcattaaaatatgtttacagctagttaatagtctgctatagtacctgctcttactggcacatcggccttggccttgaaatacgtgtcttacgtacgtgttcttgcagtattgtcctgcaatgcttctagaatggctgcgccaaatctgggtaactacgctagattgcttaagctgatcatatggatgatctgttgatctcttcgatccggcggacggcggtatatgagtgtatctgtcatcaataaaccgagttccattttcatcgcatgcaataatttccaacaaggtagccaacggtcaagcgcatgcagcttcattatggccttgtttggataacatatacaatccgccccagtgaatttagttcaaaatcccggtcaatttcatgggctcacggccttccaaacaaggcctcaagggcatgagcaatatgttggaggaataagttcatctgacatccctcaattgtacgcagagtctgtttaaggtcccctaacctcaataccagaaatgtatacccctaaactatgcaaaactgtctaaaaaaggtcccaaggtagtatagatgcctggtttcgctgacgtgatatcctagtcagcaaaaaataaaaaataaaaatatatggggcccacatgtaagtgaaaggaaaaatatggggtccacgtgtcagcattatcttcttcctttctcttttcttctcttctcttctgacgttgacggtagatggggagagacggccgccgatgaccccgcgccgctcgaccttgtcgatggcggcggcgaccaaccccggctcccctgagcccaatgcactgcttggcctcagtgctccgaaccacccaacccaggcatggatgagagggagatggcggcgaggagagcgccaagcctagctcgttgtgccatgggtggtgtgcggcgttgcgggggatgggatttgaggacgacgacgacgtggatgatgcggtcggcaaagtcgtggacgatggcgatggactcgcaaggccgccgctcggaccccatgttaagcgccatcttcaccctcgagaaccccaaaatggcgtaccagaaccgccccgtggaacacgtcgacaaacctgccgctggcagtggagccaacatcgacctctgcacgagtgccgtcgtcactgccgtccccatgtcctcgggagcagtggaggtggagacgaagaaggcgggcgagagcggagccacctctttttgccctatcccgtcggcctcatctcccccttctttggccgacttcctctctcccctcactgtctggcctcatctcccttctctccggccatcaccagctgctgtcgccgccatcgccgccgcctctcaccctctactaccagcgggtgaagaagagaagaaaagacaaaaaaaaaagaaaagaaaagaaagaggagaaaaaaaaagagatgttgactaggatgtgggccccacataatattttttaaattttttctgactaggatacagcatcagtaaaactgggcaactatactgccttgggaccttttttttttacggttttaaataatttaggggtacacatttctggtattgtggttaggtgaccttaaacaaactcagtgtacaattaagggacgccaggtaaacttattcctatgctggaggagggaaggcctagtttgatttagattactcaacggatttttgccgcggatatactcaactataatgacttaggctgtgttcggcagcccctcttcccaacccatcttcctcattttccgcatgcacgcttttcaaactgctaaacggtgttttttttgttgcaaaaagtttctatacgaaagttgcttaaaaaaatcaaattaatctatttttgaaaaaaaattagcaaatacttaattaatcacctgctaatcgctgctccgttttccgtgcgggcacttagtgttaggaaccggtggttccgaacacacccttaatggatgcagtgacttaataatgaataaaaatttgttttcattccatgccttttttctactcccccgtttcatattataagttgttgattttttcttagtaaaacttttttaaatttgactaagtttacagacaaatataatattattttcaatacaaaacaaacctattataaaaaatatattcaatttaaatttaataaaatagtattatagatgctgctattttttttataaatttgatcatatcttaaaaaaaaaactttgatagaaaaagttaaacaatttataatagtacttgattattgtgttaggtggcggcataccccgtgctctgtgtgcctcgtacgtgtacgtcttttgtgatttttttcttgggttactgacagtggaaaaatagtccaacggcattcggcaaacagtccaaatcgtccaactcgaccgcattatccaaaatctccacacaatcgtccaccatctgaagcaatcatcgttgcctatcatctcatcatttggagaattcgagggagagagagagatagaatagtagactagagagccactcgggcagttgcattagacgtgaccacctgcggcggcggaagcggcagtctcgccgccggccggagtcgagccgggtcgcggcgatgaggccgccgacgcctctccccttcctgctgctcctcctcctcctcctggtgctcctcctcccgtcgccgtctgcggcggccgcgggcggcgccgacgggtgggaggcgatcggcgcggcggcggcggggggaggcccccgcagggtcgcgtcgccgggagagcaggaggcggccgccgccgggttgctccgcaggctcctcccctcccacgcccgcagcttccgcttccagatcgtctccaaggtcggtgcgcgcgacgatttctgactcgggggaggcgaaacggtcgcggcgaaaattacggtcgctgctcgattggatcaggatggcgtcgtcgctgacgggtttgactttgattctctcatccagggtggcgtctgcggcgggtcaagctgcttcaggattagtaatgcggatggctcgcgcagaaatggagcagaaattctgtacgcttctaccgctctcctctgtgtgtgtgtgtgtgtgtttacttcccagttttttttatttggaacagaattctatcctgcttccacggtttaaatttagaatagttaaaattatggagttatggtctcaaaattggctttgtttaaataggagtggttttgtaggaccttcaactaagtctgatgctatagcacagtagcacttatctatctgatgctaataaaactgtaaaatatactaatgggttgacataatgaaaaaacgccagtgcgaagtatctattttggcaactgttccttctcatgccggctgtctcttttagtaacttttgcattttgtttttcaaaactcaaaacattgccttcagctgagcatagataggggaatgaatggagaacaatttgttgatatacggctaccaaaactgaaaatttgctatggttacattgcaaaagtgaatgcaattacttatcattgtgttcaggatccagggtaccacagcggtcgagctcgcctctggtctccactggtatctcaagtactggtgtggtgcacacatttcttgggacaagactggtggcgcacagctggcctcggttcctttgcccgggtctctaccgcaagtaaaagggacaggagtgaagattgagcgacctgttccgtggaattactatcagaatgttgtcacctctagctgtgagtttcacaattttccttttttcataatgtttgttctgctccatagaccatatctgctcagtcttcaacctccagctccaaatcctttattatacccaaaccacttttgtcaaattggtgataatattatattgcactctgaaaaaatgatctcttttcctttttatcgagttatggaattggtcatctaggtctgttgcaaaacaaatgcttgttggatttctaaaacgccatcatgattatatgtttgtactgatgcaatataaatctattattgccactgtgcgtgtcaaattgaagttcttttatttggtctaagcatttcagtcctgcaattctgccaaaagttttttttttaatttctgtattctacctgtttcaaagatctaccttttgttcttttcaagatcaaaccacacatttttagtttgtaagaaatatctcccaatctggctacttttactcttctttacttggtttccaactgtttatctctgacaaagttcatgtagcatctctatagactcatttgtctggtgggattggaaaagatgggagaaagaaattgactggatggcacttcaaggaattaatttgcctttagcatttaccgggcaggaagctatctggcaaaaggtttttaaggtagtatgacagacacaatttaaactctgaagcacattttcaaattctttttggagtctaaattgttaacatacagcaaccagtgatgttgcttatgatgggccatgcatataaattagcagaagctgcgtctgtttccttacccaataggttacttgggctggctcagtccaataggatgcgtgatcttctctctctctctctctcgcttatctaagggaactttacattctagaaagctcgaatcaaatactctaatttatctccgtgtctgtcactatttggaatattatctttgctgagtgccagtcttttgtgctgccttctataattttatcgaccattttcccaaacgatagtcgataaaaaatttgcattaactgcatactaatctgtaccattgctgttttgtgatcaatctggcatctttaaacattacagatccagaagttatcttcagtttgacatttatattgccactgtttttgttttccatatatgccactgtggaatcataatgcaatttttgctgtgttcaatcccttgctgatgactgagttctatttcagagttttaatgttacagacagagacctagatgatttttttggtggaccagctttccttgcttgggctagaatgggtaacctgcatgggtaagcttagcataaatttattataaagtatttgatctgaaaataattatgagataaatagtacaataattaaaaaagaaataagggtatgttgtctatgcccttttggttttagttcacagaggatagtggattgctttatgtctaacaaaagtgaaccttaacaaaattatcacccttctaaaatacatatcctgttgaggtgttcgcagtttgaaattttttgcctgaggaaaatctttactgaagctaaattaggttagacatactacagaggttttcctctcagctcaaatcatttctttcagatgacagacaatactttgtacttcttaaaaggttaaccatggcttgcattatcagggacccacatagccagtacatagcactgcccaaaacattgaattgatatttttgtagttacacatagtatgctaattatgactatttggtcataggatccttcagttagcagcatatatttgttagtatgatgtgaaaaaaacagtgcagtttgatatatatgtttattttaaaacaaatcttagatggggtggaccactatcacaaaattggctggatcaacaattgacactgcagaagaaaatattgtcccgtatgattgagcttggaatggtcccaggtaataatttgttttacattgtagaatttcagctctttacttctttagcaattgtttgtctatttatgtgagacaaactttggacatatgctattgtctattgtttgtctattgcatctttcctcgtttcatgctatgtttaaagctttgtcacatttgctcttatcctatctttggagtcaggaaatatggagagtcagttaacatatcaatgttaccttcgatgtactattagtatagtgcactaaatatttgattctggttatatacttcactgacattaattgcaatttttcagttctaccatcgttctcaggaaatgtaccgtctgtgtttaaaaaattatttccatctgccaacataaccaaacttggtgactggtaatgcactcttctgtgtcatttccattagttggctgacatttcatgctagttcaggtgtgaccaaaatttcaaaatcttgtctgtgttttatagtcgcagttcacatcaagatacctattttataactactgttagtttgggggctggacctcaaatttggtgttgatgtattcatgctttctctttgctaaataatttccagagtttataagtaaccgtggaataaacagataaataagtttcaggctatcagtcttctgttcttccttggcattatgtgggttgtaggtacagggtaaccatgcacacaggatagtttgaagtcattgtttatatgatcgaacatactttgaaggtctagtattctgtttcagcccatgaatactgtatttacagattcctttgcttcaggaacactgttgatggtgatcctaggtggtgctgtacttatcttcttgatccttctgatgcattgtttattgatgtggggcaggcgtttatcaggcaacaaatgaaaggtcagagtctttccatgaaaagataccagatttcatttattccaaacttccaataccttttgactgttctttcgccaatagcttcacgaaattgctgcatggattactaacagtgcaattttaatgtatgtttttataacctgcatagggcgtgtttaccattctaattgtttttgtattttgcagaatatggcgatatcaccaacatctataattggtaagctctgactgatctgcttctctgttttttttttcagtagaatttgcatgaataatttgtttcttgcaaagtacctggactgtacaatacactatagtttagcatttttagcgcaaatgattggctctccttgtaattcatggagatgaaccactgattgttaattttttttttaaaaaaaactataatgaaccttgatgcaagaaatgttgagtgcaaaaatatttgaacatataaggtacttaataccaaaacagttttgtggcaaggtttaaaaaaaaatctggtttttgaaaatgacaagagtcctttcctttctcctcacttgattcttgctatcaggttagaagattttgttcctgataccattcagaattctacatgatatccagataattccattgatatactggttgttgataaaaaaatgtaatattattggtgtattggtttgctttgttcattgatttagtacttatttatgttccttgtccacaatgtctttcatacattatgatcaatatttattgtttgttttcagtgacaccttcaacgagaatacaccacccacaaatgaaccggcatatatttcatcacttggttctgctatttatgaagcaatgtcaagaggtaacaaggatgctgtgtggctgatgcaggtgtgcttgctctcctttttgacctttgaagtgtaaaatattatgtattcaatagcatcgccacattttccaatggaaaaaaaaacatatggagtacccattcatacttgctttgtcccagtttgtagagaaaaaaaatgatgtcttaccatgctgtagttttgccagtaaaaaatcatttgccctaagccacagtggcatatagtgtttaattagcatagttttcatgagcacatgttacactcatggcaatttttgaacattagtataatcttggaaccttcttttcttgattcagggttggctgttctactcagatgcagctttctggaaggagcctcaaatgaaagtaagtttcttcgttttattctgatttctgaacactcatagaaactatagttgagcctggactgatggatatctgtttcatcattctgaaattcgataatagcgaaagaatgtgatgatccaatgttcccttgtatcttgtttcttgcactcaacttgaatagagaaaatagcatctagagctatagatctttaagtgtgctcaatctaagttgccatctatttagaacctatgtagtgtagtggaaataactttagtacttatgcactcaacagtctaagagaaaccttgaatcattactggtgagatttatggaaaaaattaatgtagtgcttctcagtgtttatgctactgtgtttgtgggtccatctggatagggacaatgggacatggacttaattgagattgctaaagaaagctcaactgagaaatggctctggacaatctatttctttccaaatccaatcattccctcctttgtgcctttgtatttctagcttctcaaaccatgcctgttgagaactgtcttaccttttctatattctagcactactggtttgtcctagtcttctagaagcatgtaaggaaaaggctggctcatgggatgcagggcaagagagggccttctgcactaatgtcttttagtttatgcatacaataagccgtaactattatgaatgccgattcatggatatggtaaagatccaaagactggggaatacgacactcgcactaaattaacgccagtaaggctactccctgtcaaaaccaagggagtctgaggcttattggactaactttagagattcaattgtcgattgatagcggggtacacatggtgttcttttttagggagggatccctgctacatttccatgggtagaatctctacttttctaaaaaaaacatatctctaatttcctagtagtaattaactaacaactttcattaactgacagacaggataccaattgactaacccctatcctactaggaaactagttcattattaaggaaatagaattctaatcctgatgccacagtattatggtactgttcacacatggccacacagtggtgctaccatagcagtaacagaagcaaaatattatgtgtattcatatgaacgcatattactatattagcaaataggtagcaaaagcatctacctgtcttttccccatatgtaagtttctgctcattcttatagatggagataaccattgcctgttttgtctttcaggcattacttcattctgttccaactggtaagatgatagtccttgatttatttgctgatgtgaagcccatatggcaaatgtcctctcaattttatggtgtgccatatatatggtatgttttgactccaccctaaagcttcaaatcttcttatttcttaaatatcacttttatactctattagttgtaaaagtatgcatggtggttctcattgaaactaggtgcatgttacacaactttggtggcaatattgaaatgtatggcatacttgactcaattgcatctggccccattgatgcacgtacaagccacaactcaacaatggtacattttactctcttctattaatatagtgtagagcttatatgagctgagattgtccatcatttgttgcaccaaacttgaggtgaatctatcaatgagttccttaccactcctctaaaaaaaaagagttctttaccactgatctggcactgcagattatatatcatggcatgattcctattaatatgatacttacatttgtgccttacctcctttaggttggcgttggcatgtgcatggagggaatagagcataatccagttgtttatgagcttatgtctgaaatggcattccgtagtcaaaaagttgaagttgaggtatgtacaacaaacatgcatatgcctcgcttgttatgaaccactgtgactgtctcatctccttttcttttgtgaccagctcacctgtcttttctccataatactgcctgacatttttcatttgctgaagttgttgcatgtttccaatttgtcaattgccatctaatctgtattatctcccaggattggttaaaaatatactcctacaggcgatatggtcaatcaaatgttgaggtggagaaagcttgggggattttgtatcatacaatatacaattgcacagatggaattgcggtttgacatcatacatatgctcctctacaaattatgctcctgcattacaactgtgctatgattattgacaaatccactgatcatatcttctttcatatgtatattgcaggatcataataacgattacatagttgaatttccagacatcagtccaaattcatttagctctgatgtttcgaaacgaaaggctatttcagaggtgaagaaacataggaggtttgtcttaagcgaggtgtctgcaagcctaccacatccacatctatggtattccacaaaggaggctatcaaagcccttgaattatttcttaatgctggaaacgatctttcaaaaagtttgacatataggtatgttttataatcgccattggtccttcaaacatcctgatgccatgcattcttctttaactaggtatcagttaatgctgaactgtttgtttctagaggacttgtttcgaaaaatgaaatgctgtggcagtttcaacatctttatgctgatacatgaaattcatttctccaattcccagaaaaagaaaacaaaattatctgctttatctcatgcctgtttgatctgctatgcctttctagagcatagatgcatctacttagtttgtttaccaatcatgtcagaataatggcattcacagaatcaacccacattttccaggcttggagtagggaaaagtctgaaatgtggggacactaatggtgaaatgctcatgtgcgattgtaattatgtatgtgagagtactcacaattattaaaatagtccaaaaatgtacagcagagccaattgaagctttgacaagaatacaacaaaaatgaaacaaagccatgagcccatgaatatactcttgaacacaaatcttagccatatgttagaactttcactgccagctgctaattaatcaaacaagctgttctgcatacatgatatttttttttaaaaaagaaaactgtgaattaacgataattgttgtcacaggtatgaccttgttgacctgacaaggcaatcactgtcgaaattagcaaatgaagtgtaccttgatgccatgaatgcttaccgaaagaaagattcaaatggtctaaacttttacacgaagaaattccttgagctcattgtggatattgatacactactagcttctgatgataattttctgctggggccttggcttgaagatgcaaaaagccttgctaggactgaaaatgaacgaaagcaggtaaatttctcacccttcatccagtattagtcacagatattattttttttcttattattgactgactcaatttcttttttttttcttattgttgactggctcaatttcttttctatcagtatgagtggaatgctagaacacaggtaacaatgtggtatgacaatacaaagaccgagcagagtaaactacacgactatggtaatatatatagttgtttcctccataattttgaagtacatgccagatatatgtatgctagttatacttctaggttattaaccttcctgcctttcttgacaccatattaccagccaataaattttggagtggactgctgaagagctactatctaccaagggcatcgaaatacttcagtcgattaacaaaaggcctacaagagaaccagagttttcagctggaggaatggacgaaagattggattgcctactcgaatgaatggcagtccgggaaggagctctatgctgtgaaggctacgggtgatgctttggcaatttccagctcactattcaaaaagtacttcagttagctgcaattgtccacttcgaattattagatgattgaaaatatcacatttccagcccctgcactaggtgcacacgccctaactgttggaataaagccaactgtctactttgttgatgtggtaaataattcatacatcagaaacacactgtttagaagcttgagaatcgtgcaaatgaaggtcgaaaatataaaatgagaaaaagagcaggacctcagctctctaaagtcagtaaaatcacttagcttgaaaaacaactctaaaattctggatccaaataaaaccacaacaaggtaatacccatgctaaaataagttcattttgcacacataccgatacaaagttaaaaggactagggtgtctttactttagcaaatctcaatacaaccatttctcaattcatttacttctaatacattattctctatttctacaaactcagatataatgattactctaaaaataaatttattttgagacaaatgaaagaagctgaaagtaaacttattacgggacaatggaagtattttggtttgatgctttgatcctctttcagacttcgagcatgagtattgtacgtgtcttctctgtattctctccaccataaaaaaaattaatttagtattgaatttaacacatgctatacatatttatagtactagcatgttttaatccgatactaggttaagcttttatgaaacggagcgaggacatgtcttttggacacgcatacttcctccgtctcaaaaaaaaatcaacctatgagggatgtgatctgtgctaggacaatgtgtttgaacgtagggatgtctctatgtctagatacattgttcatatcctctcctcctagttgtttttttttttggatggggggagtaccagctagtcgtaggctgcgacagtgcgaggcgtagaggagacaaccaagtggatcccacatggccacttcacagcatcgatgatcggtcgcttgtgtgttacgagtagttctagatagggctgtcaacgagccgagctcgagcgagtttggctatataggcttgagtttgacatgaactcgagctgagcctgcataccgatcgagcttgggactaagctcgagttcgagctcgagcgagcttcgagcctactcgagcttgacagcttgacttggtgaaactccaaagaacttactcttgtataagagatattaatacaaattatcggtagtcaaaattaatgggtgctacttgtcttgaatgaagcctctgcagcttttctcatgaattcatggctttgaaacattacaattaacaaaagctagctactacatctaataggaatagtagtactaattctaaaaaagaaaaggaatagtagtactattactagcagccagttaattactttattgagaagcattgatgagatcttgagacttgagcaggtcaagcacgatgataagtatacattgacccatcaagaatatcttcctacgtgcaatgcatcttatgctaattaagccctaccgagctattcgagctcgaacttgctaggattgcgagcctcagcctaggcttaagcttggcttgtctagtatttgagccgagctcaaatcaagcctgtaacgaatcaagctcgagcagcttgcaagctccgagcttttttgacagtcatagttctagatcagctgcaatagtaagatagactgcaacttaagttattgtagctgctaagttggatctaactctaacggcaaggattagtttggtcactgtagtaaaatatattgtatcataaaacagtgctcagggtactgtagggtgaacactgttgcaattaatttggaccattatcatataaatgaaatgactaaaaaatatatgcagtcctatggtgcggccgcagttaagactacacccaatttcaatccttaattagtggctagacggtcctatcttttcgcttatgtatataattttccaagctactcattactaacttaaaaaaaattataagtaatttttttgcatacgtgtttttaattatttaaaagcaaaaagtatgataagaaataaaattaatttaaaaattatctcgtaagcataagaaaaagaaggtgttgtcaatctcttcagtattgaccaccaccaacgcacgcacagtcgcacagtcccccatcggcccatcccatgcgtacgtggtttgcctgccttgctctggttggagagccggaggcactttggtgtaccacgcggctctctctctctctctctcacagagaaattcagatcccagtttaacctgtttcaaaaaaaaaaaaacctagtgtatgtaagacagtaagagcaaggtcaatagtatagccagctgatggctccactcgtatccatgtcattctatagttgattttaaagctaacttgtacaacagagtggctattgtgttggctgtatctcatccatcaaaaaatgtattttacacgcatatattgatatacatgatcgaaagtgaactcaatccctgtggtcgttgttgtgcaatactcaggagtgctctatacataaaagaaaaataaaagtcacagacagcaaatagatgagaagaacaaaagaattaggaagagattagatgacaataactcaaattagaaagctattttctgctccatcaacgatgagatccgtttgttctgtttgtagatgcatcggccccttcttgacgcgatggccagcagcagcgccagcccgcggttgtcgtcggcgcccgttgctgccaccacgttcgcgatctgctgcgccgcgagcgctgcgttcgtcgatgccagcggccgagtcgccgagaggaacgcccttgtcatcgccgccaccacgggcgccgacgacatcaacagacccttcttggtcaggcttttgagcgagattgggctaggcgtcggggtggaagacaattgcaaacggcggtcggcgaagacacgccaggaagactgggcggggaatcgacgcggaagacaactgcgaggcggtggccggcagagatcgatctgcgacactcccgtgaggagagaaacaagatgggctgcggagggggagggaatacgctgcatgtcacacgggatcggatggctcgtcgtgagacccacaaagcacacacgaacccgtgctattgcccggctatagattagtcgctcgctttcttctctctcctgttcctctctcttccacataggaatttaatgagctggatatttttagagcctgctcagtcaacttattgtacctgcttacgtacaatcacagcgtggtccagactccagacgtaatcacataccctgtacacctagcacacattagtgatcagtcaatggaaatggttaagtggattttagtttgacgagacgcagtccctcacgaacgagctagagacaatttttgaaaagaaacggtgcgtgcagcgctgcttacgtacgtgctccgatccacccggcccctgatccggccggctaacttttgcttttacttttgtggcgctgatggggatgcacagtctccggaatgcaagaacacgggtgcgccagctgctgcgtgcgttgcatgcaaatgcgtccaagcaaagcggtcgtcccagcagcttgactgaaacttgaagacttgaggtgctgatttgaaattttcattaggctcaattggccagaaaaagaaacctaaaacgattgatcaaaacaaaaagaaaggtggtttagccttgatctaatcagctaaggtcgatgaattaatccctagttagctgctcatctcttcagttcaaactagtagtatagctatagcccagcttgtgttgatattcagatactgtgtgcaaatgcgtgcaacgcgggcaggcgaccagatgatcctgaagctgggctgtacagtgcctggtgcagaggagatgatagccaagtggacccggccctctacatggcgcagggcaggggtacgtggagtgcccagatttgttgtcactcgatcgatcgtgtgatctgcgacgccatcacgtgagacagacatgcatatgcactcgccgtgttcctgtgtgttggccctggactagtactacagtaaatgtaccgcaggaagtggattttatgggtacatccccttgttttatgtatggtgtttaaaaaattataaaaaaatttgaaaaaaattatcaagatagattcatacatgatatatcttttcgcaaacatgtaagttaaaattcgatttatacaattcgaaacaaaaataacaacattaaccgtgaattacgcgttctattcatagtcaaatttgttatttttggttctacatgtataagttgaatttgaatatgcatgtttatgaagtgacatatcacatattgatctatcgtactaaattttttaaaattttttgatgattttttaagtgacataaaaaatgagagaatatccccttaagggatgaatacagttttccatataccgcgttgcatgttttatttaccacacacggacatacacctggtactccagttcaaacctgagttagttttgcaaactacggttaataatactcgtacttaccacgcatgcacggttaataataagctcttgcaaaccctgtgctagctagctagctaggagtaacatacatcaaccttttttttcaaaaaaagaaaaaaaaaagctttcttgatactttctctcgcggagggcaagctgggccaggcggaaacggccgccacggctacgcgaccgagcagcgtcgttgcggtagagtcgtagagaccgagccattgaagagctcttcccccccttgaccaccaccaccaacgcacccatgcgtacacgtggtttgtcaccgatcgagcgctcacagagagagagagggggagatactccctccgtccaaaaaaaaaaaaaaagacaaaccctaggttttcgtgtccaattttaactgtcagtcttatatgaaatttgtttataattcgtattttcattgttgttagatgataaaacatgactaatattttatgcgtgacttatctttttaatttttttaataattttttcaaataagacgaacggttaaatattggacacggaaaccagagtttgtttttttttggacggagggagtatgtgtgtgtgtgtgaggtgggcgcgccatgtcccgatgcgcgggcgtgtcgggggttgggcccgatggggatttctgttgttggttggaggcagaggcacgcagatcgcgcgtgggtgggttggggacgtactggggtaaccggtggtaacctgaccaacccacgcagctcaattcccgtgctggcggaagacaagggcatgcatgtaaggcggctgtgttgggatggaggagatgggaatcaatctcctgtgcacggaaaacggagtgatctattagtatgtgaataattaagtattagctaattttttttataaatggataaatatgatttttttaaacaactttcgtatagaaactttttacaaaacacacaccatttagtagtttgaaaaacgtgcgcgcggaacacaggggagaggagttgggaacctcttatgccgaacacaccaagcctgtaaaaggtgttgatcactttatcagaaattcagatcccatgttaaccaaactcaagagagcctactccttccgttatataatgatcattatatatatttatacacaaagaaaaagaataatttaaactgtattaatcaagacacactatacacatacttctacaatacatgtatcgattaaaacaccatatcatttatactatagcatgcacatattctcccatcttgcattaattgtatttcgatagaatccgtatccatgtgattatatgatgatcaatttgagaaatatttgatttcattatatgatgattagtttctgaaggagaaagtaataacataatacccacacctaccacatactatgtcatttatcactcaaaagaaaattaccttttgcttttactttcgggggcgctgatcgatcggatgcatgcgtgatcaagctggccgccggacactccctgtacgtttcacctcgcgatctgcagagttcaaacttcaaagtgcaagaataagtcctacgttacccggtcgagcggggacgcataccatggccaacgctaagatgtgacacgtacctctagcctctcccacgcggacgcgatgccaaaaagcagcaaaaagcacgtgcctgcgaggaggcgcgaacctcatgcacccctgcgcgaggcgtcgggtctaaggccagggttcgagccgtggctcgcgctgagcagcttgaggcctcttgggcgtgtagctttacgcaactttacgataaataaggtctcacttgtgggtattacctctattaattggagaaataagctctcctgtgtagccttgcccacctaacaaacggggctacggtttgcgtcggtcatggcctaagcaggcagtgtagtgtatagtagtagcctcgattgttggtgcatacgtacccaggcagcaccgtgcatattcttatcggattaggatcctctgcagtcgactgcaccgcgtcttttatcattgacatgtgagtctgaagatcatcagacccatatgtaataaatgcatctggcagtgaccgcagaggatctcaatccattctcgtcgggttctctttccctcctgcaaagcccggccggccgctgccattcaccgagcggcagctagccagcagcctacagcctgcctctcgctggctctgagtagccaagagtccaagacgtaccatctcttttctgaggccagagaacgtaggtactagtgcaaaccaagataaaaagttaccggagataccaccaaatatctaattattgaataatctgtattccctggcgtttttacattataagatgtttcagtatttttcaatttaaacttctttaattttaactaaattaatataaaaacaaagttaacaaatatattcaacgttaaattttataaaataactttatcctagatggccttttgccgattgccattgaactttgaacaatactacagtgctacgcctgaatatgagtccacgttcacagctcggctctacaagatcttaaacgaaaattaaattgacaaaacaacctcagattaattatccccaatttgaacctaatcacagcaattacttgcattctccaaaaccagactaaatattgattcttgagtagcaagtttgattagcctaaccacaccccccgtacacacgcgcgcatacagtcaccgcgaggtaaggtcacctcccccccttttcccttgcagtgggtctctcgccggtcgatctcccccacgcctccgaagaatataaaagcccccttcaccctctgttgccttgtagcctcaacacctcaccagtgcaccaccccaccaaccacctctcgttttgcatttctctgcgctcgctgtcgctgccatggattacggaggcggaggcggaggagatggtggtgtgcgcggcggccccggccgcggggaggcggcggtgggggagcacagccgtaccggcccaccggcgtcgtgtggccgccgccgccgccgggtagcacccctgtcaccgtccggaggcctccaccgtcgacctcgccggctccgcaggcggcggcttcgtcgtcgtcgacgtcgacaccggacaagctggtgaggcagaaggcgatggagatcgcgctggcgccacccgccgcggcctctccagatggtgaggcgctggcctcggacaatctcgcgcaggtatggaagaaggaactcgtccactcttctcgaggctatggtgtattggtgtacgtcactcgcaaccacgttcccatcaacaaactgagctcatcttaccctctccccttcccacccctctagatctctgcacaaccgtttactactcttctgctgttgtttctatatcgatatagtagcggtagcggcctagatccggttctaggcatgggtttcgagtgctaattctgaatgttttgattctaggcatgggtttcgagtgctaattctgaatgtttttgttgctgatcacgatgaacgttttcgtgtgtgcactgtgttcgtttacgaatctcatgctgcctaatctgttttgagacggcgagattgttgatatatgattccaagtatcgaggcttccgatctcatcctttgttcgtttacgaattttagtgctgcttaatttgttcttgagacggcgagatgttatgtgatatgatccaaagtatcgaggcttccgatctcatccttgtgatgtttggcagaaaacgaaaaccaaagcatatttgaacgtttcttagatgtctttttatttcttattttgtattacatctttattgcatccctgtagagtacattacagtttaatgtatcctcctgacatcttttctgggtgagaaaagatgtattgcattttgaatgcataagtgtcaatactgtacaatttgaatgtattttgagatagcatcttcttgtgttacatttttattgtatctcgctaaagtactgtgctgttgaaatttattccgagagcaattttggtgacaccatgtattacattttacaagaatacatttaagaacacatcttgtaaaatgtgtggtaagatttaagagcacactttgattgcatctgtagataatgccgtgcagctaaatttattccgcgagcatttttctcttgtcaacaaatgagtactgattctaaactctaatgtttcaaaatcttcagataaaaacagcattaggtggggtttgcattgaaacaaatcatcaggatgataaaatcagaaggtacaaggggattacccctattcctttgagccagctgttgtacttatctttcatctgctgtttctgtaactttaactccctttctgtttatgttctctaagttaagggaaatcaatgtagattgttgaccttctgaaatacttgttgaggtgttcacagtttgaatttttagtccgaggaaattcacttcattattctacattagactagacatactacagaggttttcctttcagctaaaatcttctcttttcagaataagtattcccaaatgacagagatactttgtcctccttacaaggttaatcatggtttgcattgtcagcccaaaacattgaattactgtttttctagtaacacattgtatgttaaattttattatttggatcctaggatcctttgttagcatgctgttaaaaacaacaggtctattaacacattatatgttaagatcatgtattgattgctgtaatgataaattgtttggcttcaacccgtgaatgccgttagttacatagtcccctgcttgaggaatgttaaggaatatagagtcctttacattgtggaaagcttttaaatctgatttttaaaaatgtcaaatagtcctttattttcaatgtagattgttgatggaatatttgaatggtctttgttaaggattttgggcatattagcatatcaattatatctggatgtgggatgaaatattttttccctttaaaatggttatgacttagatatctttcaatcttataaacgatccgtgaatattcaactgaaatgatgtgtaaatgaagtattacacgatttccctgacctgggggagtatagcatgtgctatcatctttttgttagacctgcatttttatttatgtacattggtgtttttttttccaaactgatgcccagtatttaatgttatcagattttctgttgacaagaatgggacaagatgctgcctagactctagcagtgagtctggaccatggtactccaagaagcttaataacaagaagggagtgactggaatccttagtcaatggcacaagcagacggaacagaaagctcatgaggtataatgcgacttatatgcagatccaaaccttttatgccttttgaattttagctccattttgaatatgaccttttatagattttcttagaatgatttgtgtgtagaacatgagactttttgaatatgaccttttgtagattttcttatgatgatttgtctgtagaacataagattgtatttctcttgacgatgtaatttagtcatgaatcatgtatttgtcttgatttccatctcattttttgtcaggttgttatctacaaacgttgtactgcttctggatctgcagttactctttttcttattatgatgagcttggtttgtacggtgagaggaagcaaccatggaactgattgcgacatcggcgagtactcaacgagcattgctcaagtttgtcagtatggtgctcctcccgcagtgtgttgcgaccttttacaatccgctgtccacacttgtggcaatgctagtgttttgtgtgaaattggcagatctgtgccaattacttctagaggtttcaatgttcatgatgttatggattggcaccgagagtgcacgggtcaaccagaatcatccagtgtagatgcatcgtccatttgttatgtatcaggtatatttccctttgcttgtgtgatctgttagcctgctttatctgtttactgaacaacattgtcttatctgatctgttagcctagctagtttaactgtttactgaacacattctctatattaggtgaaaggcacaaagagggcacaaaagaagagggccatcaagtaaatattttgattgagaccggtaacaaggagtgcaacgcaaggaagtcaacttctactaatccgatgtttatcggtttaggaattgggtttggatcggccatgctctttgctttcgcgctggtggtgatttggctgttcgtgagaaggcgatcacaaggtatgagtttttctttaaactagtataattctgtttgcttgtaaatacggccaattgaactcattttcattttgcatatggtcaattgaactaaataagaattcttattcctgcaggaggtcctctggtgccgcagattagcttgctcgcaatcgcgcctcacttctcccaagggcttcctgcgctgcccttccaagagcatcctgcgctgacgcttccctgcgggcctgtccctgtcccgacacctcaagaagttacaacagtgcagccagccaccagtgcatatggtcagccagcgccagtgcagccagccaccactgcatatggtcagccagtgcaaccagccaccaatccaatggcgtacttggcatcagtcgtttcctatgcgattgtagacagacttactagccgccgtcgtcgctagtacttgtgtttgtctctcctcatacttttttacaactttcttctcatacttgagacaactattgagtttgatgatttagaatacttgagatgaccactgaacaattccggttactgtaaaatttgagacagctagtgagtgctgatgatttctgttaatttggttctttaaaatacctggacgactattgattgagggctgatgtttttttcttttgttaatttggttgtttggggtatccagaattcataatttcagtggactccggacttcggaacggttcgaaaacacaaaccacttgtttttaagtttttttaaaaaaataccaagtatatcttaagacaaaaggcacgagggcatagcttttaatagaaagcagataaaattcaaattgaacttaaagtttttggaccaaatttattcggactttattgattttagtcggtttatcaacggattacatgaagagatgtgcttccaatgatatcattcagtagattttgatctaatattaggattgtgagatcctgtttagatgggactaaaacttttaagtccctatcacatcggatgtttgtatattaattataaatattaaacgtagactattaataaaacccattcataatcttggactaattcgcgagacgaatctattgagcctaactaatccatgattagtctatgtgatgttacagtaaacattctctaattatggattaattaggcttaaaaaatttgtctcgtgaattagctttcatttatgtaattagttttgtaagtagtctatatttaatactctaaattagtgtctaaagacagggactaaagttaagtccctggatctaaacaccacctgaatctgctggtgtgtttgattagagataagaaaatatctgtttatttacgttttaagggcctggtgtagataagggcctgaatgaggaacttctcctccatatatttatgatgtttccctagggtccaaatgaaatacgttttctacggctccatatattgtgcggcaatggcggaagctaagtcgaggtttttttttaatggtggaatcaaatgtactacacctatactaatataaaaaggatcaattcaaactttttgctatggccacccaactgaaatgtacaccgaaaggtctcatccattccgtagccgtttgatcgtctcatccaacgcctcaaaacgcatctaccacatgatgtgtgtgtcaatttcagggagtaggaaattggggataaacttgttgcattgacttagctctatgggcaatatattgtgtacaagagggatgggaaataaccaaaatatccaatacacactattacacttaacacccccactcaaatgcaatgtgtatgcaataacgttgcatttgaaaactacaactaaacactaaactaaatcaaaagtccatgcttgatgatgacgtcgaagtgtgcagttcttgaaatgatgaagaagaaatgattcatctcatcttcaatgaagcggaccttggagccttcacggatcgttcttcagcctttaataccttaagccttcacaaattgtttttcagctcttcattgattcagagatggtgacaatgatattgaaggaccttcacaaactgttcttcggtccttcatgattgatgatgatgtcagctccaacggggagcatgatggaccaactccggcagggagttggtgatgatgacaggacaataatgaagaccaactccgatggagagttggggaagttggagatgacctgctccgatgtggagctggtgatgaactgatgatgacggctagctccgatgtggaactagtgatgatggagatagattggcaagacttcgacaaattgaagaataggcaatgacttcaatggactcaatgggaactagtaaatgacatgacgatgctagtatatactccctccgtattttaatgtatgatgccgttgactttttaaccaacgtttgaccactcgtcttattcaaaaattttatgcaaatataaaaatacttatgtcatgcttgaagaacatttgatgataaatcaagtcacaataaaataaattataattacataaattttttgaataagacgaaaggacaaacgtctgttaaaaaagtaagcggttcatacattaaaatacggagggagtatgcagcaggacttgaatagatagactagataggaaacaaagaaaatttgatttgtagaggacaataattgatggatataacaaaagtcaatattgatagatgtgcagcaagcagtaatgtacatctatctattatctattatatactaaaagtccattaaatttcctacaaacgctctcaagccgccacgtggcgctcctacaagcgctcctagatcgccatgtggcattctacaatcccaccatcgattttcatttaaattggtggacctgttattttacaccgttttaggtacgttactttggatggaaaaaaaaccaaaaatataaagccaaaaaaaaaacctgttcaccagggaaaaaaggaaggatgcgtaccatataagcacgattaaagcctaaaggaaaatacatgtacaatgttataaccatcaaaggccttttgaaaatatgatcttctatactataaaaataaagtttattactctacaaatatgattttttgtgcttctacaagcgctcttagaccagtacgtgacactacataatttcaccatcgattttcatttaaattaatggacccgttattttatatcattacattagcccgctttctcttaatctcctatgtatacgagataaactatttaccggatattcgattaaaaaaacccaaagaaacatacatacataccattaaaaaaagctataaagcccaaaaaataaatatgtatgttggtacaacatcgaaaaaatatagacaatccttaaaataggattttctatactatgaaacaaaatttattactccagaaatatgcaagttaaactagatcattataagtatcaaatcaaaggtatttaaacacccacttttaaattataatccgttgtattcaaatgctgatgacttatcatagttatattatgatataaatacattacaacacatggatctgacatataataattaatattataataattttcaaatgatttaggcgacatataataattaatttcatcataatctttgaaataacttcacatcatattttgtggtgtcaaatataacttgacaaatatataacactaactgaaatcgacatgcttgaaaacgaaacaacattatgctttgtcagttatatatgatttaattttaatttatggagactaagattctcaaatgttttttttcatatttttcaaaactatttcattggtattcctaggcaataatcttgctataatacggccccttaatccatacgtttttcccgccagattagtttgttaacaaatgtgcattaaattactcatgatatattttgtttatagtcgaggaattctaatttgtcgggtataaatgatagttgatagttgatgaatgtatgctataagtgcactccaataaattagttatttttaataatttttgaaagtaaataaaatttaaaattagtaaatgtgtctcatgcaattatgaaccaattatgaacaacaggtgacgaaaacaaaccatacgctaaaatattgatctttgtcaaaatataaacaatgatataatggtatgatactctgaagatggttatggtcatatatctgtttagcgatacatttcttaatgatcaacctcactcatttcaaagcagaatattgtatttatacataaaaaattaggtagtactgctcaatactagaaaaaattatgtctacacaaaacgtaaaaacaattattttttatgggaagaattattttcattacatcaatcttttcttgctttctctaaaggctattgaacatcttttacaagtatagttgaggtggccccagtggaaaccaccgttgacaatagtgctcaactttttacttactcatgcaatcatctttaagaatgctgatagtgaattaggacttaaaattgtactgcacactgtccttgagaggcatgagtatgtcgatatggaacccatgtttaaaggcaaccgagaaataaagacttggtatctccacctgttagaggggatattcatgtctaattttcaacactaatatcacatttaccaatagatgcagtattttaagtatatttatttatagatttagaactatgtgttgacataaacacttaggtatatagtggagataaatgttttatgtatttatgatgtattaggcttattttggtgctacagatgcagttccgtttattaaaaaggcatctagcgacaatggtaagaagtaatggtgacaataggcaagtttacataatcaggacaaaagtgatttttttaatataagaaacattcctatcgtttatattaaaacctacaatatatttcacgacatagatttttgttattatgaggtaaaatatataatttcttatacgcatatgatgtgatatgacttaattctcataacgttatttttataatcataatgaataagttccccgcgtatctgcgcgggctttctttctagttactagcaaaagacccaaagaatgctagtgaacgtgttgacagtagcaagcaatgagctaatgatctaactaccactccaagccatcatgataatttggagatgtaaaatgggattatgataagcagctaacaataataaaatacggtgataattgatgagtgattatcggatggcagcgaccagcaagcacaaaaattaactgcatatgtgtgatggagtacaagctcaaagacatgaaaaacaaatcgacgattttgacagattttgcaactgaaattaggagcaaccaacaattttgacagatgatgatgaacaatgaagcattgatgcatatcctttgttctccccaaaataaaactgaagcagcacaagctacatcagtacatgcaaagtaatggagagagaatgtgcagaggagagctggagcttgcgttgacttagccataggcgtcttagcagtgacggctaaagatgaaattgtggaagaggaagagaagatgtggaatatttgcttgctggttggagatgaaatagactacgacggggctcgctgctgctgcatcaggcaggacccctgctgctgctgcttgactccgcgagaccgttcagtctcgctctcccattccgcggtaccacgcggtctcgcactttcgccgcgcgataccatccacgacgtcattcccacgtcgttctcgtgcaacatttgtgcgagaccgacgatatatttacgcaaaaaaatttacatcccgaatatttataagaaaaaattgaattaacagtatattttcaaatttaatttctaccttagctgccaggaactagagaaagctccaggcatcagtcgtttagtaattttgatgttcatattctcgtgagttgccttgccgcattatcatgtacagttttgtgaatcaaaatgaaaaccgaaggattataggttctggaagttccatgctcaaaacaaacaattgttgccatgttagaatctgaagcatgatcaatttagcagtttcttttcgtagctgtgtcttactactttcagttatatgcattagctgcttcaactatgacctgaaacccaaattctactcaattttaagttggaacgaaactagataaaacatgctgggtaggcccacatggtgcttgtgtctatcgagcaatagctagacttatacttggtgggtacaagtccaaatttcccaacaacatcacaattgtttatatgatctgccatatccctgtttttcgtttggatatgttgctaagccgagtaaatattcttaaaaaaagcagagttagaactcaagctgtggcagagttgctctgaaatctgaaaataccaagttcagaacaagcagcacatggtacaatttagctgtattcaaacacatctagtattactgtttttaggatgtacgattttatctatttttagtccaaaagaaaggaaagcaccatatacttcatcctagcaacaataggtgcaagttatataccgtacccttcatttgatttccttgtctttgattcaccaagaactagttctacctgaataccaacattggtactgtatgatagatatgtatgttttatggttctagattttttgagaacccatgttcaagtcttttgtgccaatgataaatttggccgcaactcatggccaatatgaacataactgaaattcccggtttgaacttcattggaaactatttcagttttaattgggactagcacatataggccttgtacttcagaaatatttcaattttactgatgtaaatcggttgtactgcactggtttgcaacctgaaactccatttaaaaatttaaacctagatcataagatattcagagataatggcaagaagtagccgggccactgaagctcatggtggcattagtgctatattataatttctcttgcacttgagtgggtccttaaacaagtattataccatttcagttctgcttcagcactagtgttcatctttttcctggagttgcacatctggcgtttgcagcatttctgtaaattggcatagtataatagtgttgtcactatctcttttaaggacattctgtaaagcacgcatggatggctttctggtctggacatgcaggagaggagcacttatgttatttttttagcacttctattcagggtgaagacatcctttggagcaagcattagtgtcggatcttatgtgattgaatatttgcctgatacttttacctttcgactgagacattttactgcttatgtgattgaataagtagatgtgtagggacagttcttatcagatctgtcaaaccttgtgaattgtgatgatgctattgatgttcagatgggcaagcgattaattctgtgtatatgtgtgctagtgagtatgattaattatgcgtatgggtgctaatgtctatgattaactagatgggtaccccgcgcgttgctgtggaagaattatgtaataatatagacttaatatcggttgagcagtaagaaggagaatcggttatggaatatattcagagatttcgtaatgtccgcagccgatgttatagtttgagtctaagtgatgagcaactagcatatcttgcattccaagggctatcaacacctatcaaggataaattattttgccacgagttcgacagcttagctcatctaatgcagacagtaagtaagatcaattttggagttattaagactagactgaagataatattgaagcatgagctctcgtactccaattttttttttttggagggggggcctgtgttaacaatgaaatttggtaagccttgaagacgtcatcagcctaaaatcaatatcggcttcagagttttggaatcggccgatgagaattatcaagtcgccaatagtcggattcttgctatattcggttaagaaaactaatctattaaagg

SEQ ID NO: 68986 - DNA, 7050 bp, Oryza sativa
tttcgaaacggagggagtacgtcattaacttgacaatacaaccgaccattcccgatgacacatattgagcaataaaaatgtggaaccaccagctgttacaaagtactccatctagagcattagcatgtagattaatttaatcactaacgagaacgatcaaacaacaatacacatgcgtgcaacaattagaatcacaggctcgcagctactacatatgggcaacaaacaaaaccgcaaaattatcagcaccagtctatcactaacagcgactcacctggaccgtgccggatcggtcacgaagggtgaggaaggtgaggccggcgtgggcgcggtggagagcgacccagccgcagaggcgcacgcggcggccggcgtcaccggcgccgagctcgccgcacagcgcgtccctcgcaggccactgcagcggctgcagcctctcgcgcttcgcctcggccgcgggcgccgccgcttcctcctccggcggcggggtcgccgcgtcggtggccgctagggttcggagcggagacggcgagcacgaggccgacgaggtggaggaggcggtggagagcagtaggaggcggcggaggtgcgaggcggtggggctagggttgagcggctttaggcgggagaggagggagagcggcgaggcgcggaggagagaggaagccattggattgggctcggagacggtgggaaagcgagcagaggaggacaagggcttgggttgggttttggaggaagacgggatgggatcgccttatcctcctgcacgaatcttacagcacaagtttttcgcctgcctgcaagcacaagcagatagaaccatcgccagaattcgaaatcaaaagctcttcgacaccaaaatcaaaagtgaattcgcgccggaacatttcatgagaaacgtaggagtacttctcagcttatttaatccaaagtaaactgcacgaccaccgtgcttcaccaaattggagcagcaataggcgtcaaaattgtgcttacaaattcagatcccgccaaggcagaaccaaattttgaaaactgcacaaatcacaaaacgcgcaacaccagtagcaggggggaaataaaattggcgcgatgtagagacaattttttttttcagagcgcgcgcgttcatcaggcgaaaaattcgtgaacatcgtgaagttatcgcttccaccgttccaggcgcataacatcaggacaacgaaagttttgaaaccatgaaatcaaacagcgcccagattcactgccagacttcacaacaaattcaaattaaacatcgaaacatgcactaaatgaaaatgaaatacagccccaacgaggctctggataggaaatttaagacaaaatattcagagattttcagataagcaaagacagcgcaggagcaggagcaggagcagattatcgtacaaaccacaggattggaggcgacaggggaataatcaagaacatgtaaaaggcaagcagattaagccatcatcatcataattactactttaccagatccagataacaatattgtcctaaatccaccaggatatttcttacatgaacccaagatagtcaaaagccagaataactacagcacagtaccataccatccaaaattccaacctaccacaactaccattagcagcaagacgagaaaggggcctatgagcctaagcggaggtgaacttggtcacagccttggtgccctcggagacggcgtgcttggcaagctcgccggggaggacgaggcggacggaggtctggatctcgcgggaggtgatggtgggcttcttgttgtagcgggcgagcttggcggcctcggcggcgagcttctcgaagatgtcgttgatgaaggagttcatgatggacatggccttggaggagatgccgatgtcggggtggacctgcttgagcaccttgaagatgtagatcttgtaggtctcgacgctcttcttcgccttcttcctcccagcgcggtccttcttcccctcgccggagcccttctcgcccttgccggcggggagccgcttctccgccttgggcttcttcccggccggggccttctcggccttctccgccgcgggctcctcctccgcgggcttcttcgcggccggcttcttctccgccttgggcgccatggatgctgctctcttcttctcgggaaggggaaacggtggtggttcttttgctgtgtgtggatcgcaagatttgcggttgggaagaggaggagacggggccgattggttttatagaagaggggatgtgcgccctgattggtggaaagcatgcggcgcggatcgatgacgtggaaggattcgtgtcgttcgccgctgtttgcggtgaacgggtgggatgcgtttcggcgcggattgctgacgtggtgaaatatctgggcgcgaagagacgagcgcggggcgggattttctcgcgcgtgagcgaaattgtggaagggcccatgggtcatagggacgcgacgatttttgtgtatcgagaattacaattttttttagagtactggatttttttaagttttaatgtatacataagaaattttgaccaaatattgatttcaaaatgtttcacgataaatgcgcaattctataatagattctaccatggtttttatgtggtactattatgctattatgcaaaggcgtcatgctgaactctttattgttgtaaaattcaagtcaataaggttctgataaaattcttgggtgaaaaatcgattaattcatttagccactttatttggctttccaagatatactaggtgtgattttctgtgaggttctagaccgggctaggcaataactatatccgcttccaaatacttttttatttgtttgacaagcgttgttttaacttcgatcatggctatttttaagtgattagactatgatgaacaaatattaatgcttaggttaggcttcaacacgccctaataatatgatatattataagtatttaattttaaagaaaaaacaaatggtcaaagtttaaatatgaatattttgtgacaaatagaatcttggaacaggtggagtacaaatgaaatagaatggaaagcttgatgctaaaggcacttgagacatcatcaaatgtgaatcacttttcaaaatgaaattaaaaactcagttaaacattagcagaaagttgattttgacatagcttgtctttggcctacaatatattaaactatgtttgttgacaaatatatcaactcattggcaattccctatttttcaagtctaatttaatctactcaaccccgatatcaatatcctcctcgacccagctttgttctgccaagtgccaatgccttggcttccctcactgctgctcttgagttcgcgaccatgtagtcgttgtcgcttcagctgctcgtgttgatctcttagctcgatgctgcaaccaagataattgccttcacattcgtttatgccatgcgccactaaaattattctaataacaagagaaaatcccttgcactcccctgatatttgagtcgatctctaacgtgtccttcagttttttttctttccatggtataattatattatttttttgaggagaacgacggtaggagatctgccaaaatttaacattaggagagagaaattacaaagtagcacagaggttcagaggttacaagccaaggaatggaaagataaatacagctacaggaaaagctaaaaaaaattattggggtttaaaggccaagcagcgcatatcaatagcttgcttgataaaataagctacttcaatctctgaacaggaagagttttggaaaattcttctatttctttctaaccaaatattccagcaagtagttagaagagtttccctgaccaactgcacatccttcttagagcctgcaaatttggttccagaccaccatgttgacacatccaggacaggatttattccgaccgaagtcaagttttggaattgacaaattagggtctacacttgtctgacaaacacacaatcactgaacaaatgatttgtatcttcaaaggcacaaccacaaacgcaacatatccaattgcaaggccaatgcctgtggagcagattttgggcagtcaagttttttgatggagaactagccaaccaaagaatttatttttggttcagtcggggaatttccatagagaatcaaactcattggtggcaaatgagccttcgaactggaaaaggtaagcactctcaatcgcgtgagaagtggcagattcagatgttctccatggtataattatggattttgatttttggtctctttccatattcttttctttaattggccatttaatagttatgaaaagtccattttggcatcagcatgaaaggaaaacataatttagaattatctatatgagattatcatgtattcaatattttgttgtgtgaggtattattcatgacaaaatttgttttgcacatagacgatagagagtttaatagttattcctttaattatagcaaatctaagtagtgtgtttttggatgatatatacaatagatttcaatgcgccctatatgggtaaggtataccctctatcctactacttatgtaattttatggatacaccgcaccttcgtgtgtatggtaaagctccatatgcaataaggaaatcgataagagattatggaaataatcctcgcgggcaagtacataacaaagatctactcggaaaggattaggaatatactatatcgtgcaaggtcctaggtcttcgagttccaggggattcacggtgtaaatacatacccttaaggggtccaaggttttgagtcataagcacaagacaccaccaccataatctcggaggacttgaagcctattcaccgatagatctcgtcgagctaatctcaacaaggatttcatcggtaatctcataatcatttgttctctattgtactatgtgtttttccatatcaatctcatataaactgtaataggactattatcttgcgaggggcatgaaccagtataatccttgttttttgtttgcttgatgttgaatcgtgtagatcctcataccaacgtatcccaataccctcatcatccggtctacgggtatcccccgtcgacaaagggtaaattcaactggaataggactagattctatttaaaaaatatgtgtttgcataaccgtgggtactaagatatcaatattggagacattcacaagtacaccagaatagcttcaattcttcactaactatatattcttatagtttcctcgcactagattatctcatatgttaattcaatctatcttttctaacacgtatctacgttatcttattaaaaaaactaatataaatacataaaagtataagttaaggttatagtttctttgatggtaaaacaagtaacaacaaaataaataatatatatagttttttaataagatagatggttaaacactatgtgaaaaaatcaacggtgtcatacattttgaaatggagggagtatatccactaatgtatttggggataccatgtcattgatcattgttctcgaatgacaactgcttcacgtcgaaagacgtggtaaactcggtgagtggttggaatagtaaagcaatgtattaattgataaaaatttttgggatctccccattacatggctctaggagactatttataatcctagtacaggcttgtaccctttaggatttggttagtacatgtgaatttgcatagttacccttaccgtagggacattacaatgtgtatacagtgtcttttgcatttatgggccttgaggcaacccccttgggccggcccattagttgtcgaagggcctctataggccgctgggcctcctatgtccttagccgaaggtatctactacttcggggcgatggccttgtgcttcgccctacaaccttcgcccgtggtgactctccagttgaccgatgagcttggaggtgaacccttcggtctccattccatggcttcgcgccagtcttgatggcaaaacctacttggttctttgtcattctacttcgcccaaggactttggcccttggcttcactagtggcacatgtctgggacttagccaatcctcgatgttttgggtggtttcggtaggtcggccgaaggccctcatgacatacctccaacacttacagatatagaatattggaatagagtataccaaagtaccaacctatgttgtgccttaagttatctcatatatttgaatttcattttattttgttacaaacttaaaagcaacaccaatggttcccaaaatggtagagggatggtagtgcggagagagtgacgtgtaagcgaggaatcaagtgggagggatgggggagtgatttatgtttctatttccattggtagtatcgagagtcaatttgtactgttccatttttttcttacctaaaccgcttattaccaactaaataataaattatgggttaaacttttatatacttatccttaacgagtcaaaaataaatgttgtaaaataatcttcgatgaagaaaccataaaatcaactataaaattaagttttaaattttaaaatatggcttataaatataagcataaacgaaatgatggaaaatagatgtcttttagagagaagaatctattcacgcctcaaactttaattaggaattccaaaaacataattttggatggtttttttgttatccgttggacatgctctgattagggatactgttagagccacagcaataaaactattttctttagcgaggaatacaactatactaaaatcatggtattgaaatcacagagtattttgggtagtgatgctcgtgagcctatctgacgttgattcatgatctaacggccgttctgcacttactgcagtcatctactgctaggcattttgctcatcttcactgtcaaatctcaatcgctcgccgtcgccccccgcccgacacaccggcggccggcctgtgcgacggcgatcctcaccaccaccgcctccgatgcctccgccggcacgccggcgtatcgccggcgatcccaactccacgtcgatcacctcacatgccggcatg

SEQ ID NO: 68987 - DNA, 1292 bp, Oryza sativa
gaattcctgcagccccaacaaatcaggattcaatctttcgttttcggtgtttgtattgggatttggtcaaatttgaacaaaatattgccaaataaaaaaaatcgaaaaactttaaaaaattcagcccaaataatatcgagtccaatacaacaaaaaaaattccaaaatttcggtccggaattttgaaccatggcacaaattaaacagatagagggagagagattgtttacggcaactcttgcaaaatatttcatgaagaacgtacgaaagaacaaagagaaatctaactagaaagaaagaaaaaacagattaggacataatgctagctaattaactgagacaaagatcgaataatatatactttacgacatgcattattgctgcttgcatgggggaacttatcgtcgtcatgcatcgatcttcgaattcgtcgtatgaagagacgatcgactagatttcagttgtgagacggaggatgcgtcttgggcggcgcgtagtcgacgccggcgtcgtccgctgcgccatcgctgccgccgccgtcgccggaatcaccatcatctttcccgccgacgtccgcggccgccgggaacggcgccatcgcggctccggctccggcggcctcttcctccgtcgtcctcgccgccgccgccgcaccctcgacgccgccgggctgcagccccagggcgccgtccggcagcggcgccggcgccggcgatccccgctgctcctccgccgccgcccgcatgtacctccggggagacctccacacgtgctgcatgcacacgcacacgaagataatcaaaatcaagaatccaactaattaatttattaaccaagaacacttctccactcatgcttaccatggcggcggtaatgtcgtcgtcgccgtacagcgccgccgtcgacggcgaagcggccggagcggcggcgaagaggcggcggtggttgcggctggtggcgtggcagacggagaggtggaggaggaagaagaggaggagacagaccatgcaagagcagcgcatgatctctcggcttcttcttctctactctctttttgagtcatcgactcttttttctacagggatttttgagggtttttttttttctggtcttattttgatccgaggcgtggttggggttggaatgtgacgcggtttggagatttcgcataggtatttgtagtcgttcagggactcgtattgtcatacataaccaatcaatttatgccacgtgtctaattaactaggctttgtgtattcaaagacaaccaagattatatattcatatatact

SEQ ID NO: 68988 - DNA, 700 bp, Oryza sativa
attcctgcagccccttcctagttctgaacttcttattgatgcagctttcatggttaatgttatataccatgtactattgactagcatgtgtttttccctgttcccatagttctgaatgatacacctacatgcttaatggtatatatagcatgtacagttatctggcatgtgtgtttcatagtttagaatgatgccaagtaaatctgtcatggcatcacgccaatttcctccttgtgggttcttgagcatatcatggtatatcctgtgatgtgttcactagtttgattgctataataaccgtaccaaatgctttcaggtttgttcagtggatcagctgggttttcagttctgaatgcttcccaattaggttccccttgtatcacaagttgaatatttcagtcatgaagtaccgcgtgaccaaaggagctttgctacagaattgtgctacatgagagcttaagaagctccaagttcacaagaaaagaatggcgctctgcaaatatacaaaggatggaaccagagagacatgagactggaaagctaccggcagcataattatgcagcttcttatggctaaacaccaccactcacattgaacagcattcatgacgcaacacaagtaaaagcgaaagggaacacattgagacaggaaagaagattgacagcaagaatttcggaactatgaaattggaattataac

SEQ ID NO: 68989 - DNA, 13323 bp, Oryza sativa
ataattaattttttttatctatatttaatgcttcatacatgtgtttaaatattcgatgtgatgtttttataaaaagttttgggaactaaacatgtcctaggtggctaggtagatgggccctcgattgtaattaaggtggcgtgcagagttgaggccgcaaacacaaagttaaataattgtctcctgctgtggaaaccggataacgcgtaaacgggttgctgacgccgcttaattccaacataattttaagtctcacactccacgtagtcatgaagacatgatgataggctgccttaattagctggagaagaaggaactaggcttccacgcaatcactcctatacctgtacatatatgcatgtcaacaatttgcaaatttaataacttaattcattttgtgcaaatataaaaagtttaccacctgtttcaaattgattattatcatttcaaccttgctctaagttaaaacatttttatatttgatcactaatatttagaaattcgtgtatcctaacaacatgtgaattatatatatattatgaaaatgttcttatagtgaatccaaaaacataaaaaataaattttaatatgctaaacgatataatatttttagaaattaatgatcaaatctataaatgtttgacgaattagaacaaagctagaatcataagtaatttagaatggaggtagtgtggagtgcaactatggagtatctaactaagctagtcagggtcaattagacggacatcagcggtgatcgatgcacggttgaaagtgaaagtgtgaccatatatatgatagatatcgtgtggcccatccagaagctacgcccacgcaagtatatataatacctccgatctttaatagacgacaccgttaaattttttgccacatgtttaaccatttatcatatttagaaaaatacgtaattataatttatttttgtcgttgcgagttgttttatcacttcaagtattttaagcatgaattacatattatatatttatataaaattttgaaataagataaatgattaaatatgtgttcaaaaggcgatgacgtacataatttattaagaaaacgtataatcctcatcatcatgtcgtgtataattactttccaagcaggcctaactagctacatgtagacttagtagctgattaaaatgaagcaagctggagctaaaatagtcgtgtgacgttgttgtcaccagcgatattatatcccatcgtaactttcacattggagttttctaaccatataatcgtgtactgtggtttgttaagaaggtataggtgactaatggtctgtttggtaggttaaaattctgagaagtagttggttggtagacattttctaagaatctagaaaagttaggtttctcagcttctgacttctagtgtattttttgaaatctacaattgcagtttcttaaactctgaaccaaaaactggattatttggaaaagcttctgattctgagagaatctgcagcagttagaatctcctctaaacaggccatactaattgcccactggactggacacacaatcatgacagtaatttgattaagggtgataagacacgcactcatgcattactggccagagatgatcgagtactcgaaaatgaggtgtgatgcaaactgcaaactggaaaattaaaaagaaagaaaagctgaatgaacgaactgggttggattggaaaaaaataaaatgaataaaatcggtagtgcgtgtaacaagctaggccactaaataaaccattcgtacgtgcatggtactctattaattaaagaaggaacattttatagagcgaaaagaaaggagtggtgaatcattcaggcatagtgctcgatcgctgcttgatagtgagaagcttacgggcggctgtgttcggtggtgggtatttacacggaaaacagagtaatccattagcgcatgattaattaatattagttaattttgttttaaaaatagatcaatatgattttttaagcaactttcgtatagaaatattttgtaaaaaatacaccgtttagcagtttggaaaacgtgagtactgaacacagccgtattaatgtatcaaaatatagaaaaatatcgctgtaacctcaaaacttagttgtctgtttagattcgtacttcatgatatgtccaattcaatcctaacttatttatatcttgaaacaaatgagcatatttttttttctaaaatctccagctgtaactgtctaaattgttaaaatttgtaaatataaaattaaaaaataaagtaaacattagacgctgagaaacttagatttcctatattcttgctagctatagctggtaaatttagtggcctagcttctcaaactgggccactaaattaccagagattcgtggtcgatcgatcgatatcgtgacttccatgacagcaaaaagcaagcagaatcacaaaaaggagctaaaattcgagtttgttggcctgcagctgccggatcgtcgcatccaagttatctaggaatcaaatcaaaagcaggcaggcagcagagagattccagctgccaggagaccatgaacccatgacattgatcacatatcgccgccggcgaccattgccgtcgcggtctgttgagctgtgatctaaattcatttgcatttaataaaggctagcttctgtcgtagtggagtggaggcccgtcgccggaggctttggccggagcgtagcggggatgcaggggcggagcctccgcgaaacggatcgtcatcccttttagggttccaccatatatatatctcttgtaagccgccgtgcggcgatgtaacctcaccccagatatagtgaagatattttgctggctggcgctcgtggttttttctctcccgttttaggagggttttccacattaaaatcttgtgtcttctatgattgatctattgttttttatcgtttgttcgcctgtcatttcctaacaccgtcgacgacgacgatcggccggcggtcactgttggatcgatcggtgcaaattaaattaaagcagaggctgagcatgtacgcagcctactcaccacaagccatgcaaagcaacctcactcgcgatcatgcttgcacacacctgtaatccaagctactactactgtcgacacaaatgcttggccaattcttcttctgtttctctttttccccatcgttttctgcttcgcttttttgcagcatctagttcatctttctttctttccttttctttcggagcatggatacagagaagcagaacacctaccataatgtattcgattgttatgccgtgatgggggaagagccatgagaattgtggaaaggagatagctaagtaggcaaccactccctttgtttctgtttttttttctaaagtagatgacgatgttgattactggacacatgacgttaaaccagtcgtcttgttgaaagtttttatatcaatacataagatataaattatgattaaagtatttttttaataataaaacgacttacaataaaataaataataattacataattttttaattacatgaatgatcaaatacgtatttaaaagttaacgacatcatgtattaaaaaataaaggtaatacataatactctcttttttttcaaaatataaaagattctaggccacataaaatatcttatattttgtaacggagaaaacaacaagctatagctcgccgccgatgaacgaaccatctgcaacggccggccggtaacggatcgccagcatatgcaagtatggcacacaacgaaattaccaaactgatcaaccgaaagaaaaaaagctaggaaaagcagatatgattatgaatatatgatatgatgatgccaatatcgatctaagctgcaaattgtttcgtttctgatatatgcatgcgtccctgcttacgttgtggcccatattcagagtatccaacgtcgacttcttgttgggtttcatgacgaaattaacccatcaaatatataaaatcttcttctcatcttccaatgtatgtatctctacctcactacctgcaattgttgtctgtacatgccgcccagatacatgccacaaacagcaaccatatctgactttttctaacgatctccggcttttttttttcctttttttgttgaaaatgacatgtccaaaatctctgtacagattgccgaacttattatatattagctgtgaaattcagaaaggaattaaccgccgtatataagttgggagctcgggagcttgggcttctccggagcctcacctgctacaattttacgagccgctcctcaaaatttcaaactctcctacatattatatatatattttttaattttagagaagagtgtttttcactttttcttaacatgtctctatatccaacccgacatatatgcaactttttaaattgagaacttagcccccaaacaactcaatccgaaaatcgttcatttggagatttgaattcagaatcttgaggtgctacttaagtcactgcaaccatgtcctttcacaaactctcctacatatagttcattccccttttgtttgtgcatttatttttctcttctgttttctatatgctttgcaagcctagccagataggtcctctgcatattactgcgttgtttgggtttgtgtcatggatccaacataatgggccacatgctagcttctgataatggactgggtccactaaacggggacaactgttaattgaaggccctttgaaaggaataagttcactttagactctcgaatatagatccaatataatacgtatccctcaactaaaactaggcaattccccgcgctttgctgccgaaattattgagtaattttaatatatatatatatatacacgttacaatcaagctatgggtaaaaagaaaacaaataaaatatcaggacttatcactatttattatgaaacaaacaaatgaaacccgcgctataatattgaacatattgatatgtttatgttaaatattataaaaatgctagatatgtttgtaaaaatattgtagaaatgatgtgagggtgatgattgaatagattgtagatgatgttacatgcttgcatgaggttgaatatgtaattattgctagtgaataatgatatggcatggttgcatgttacgcttcagagttagtaggttgtaactttatagaaagtatagataccagatatctttaaacccataactattaaaactgatgtaaaatgacccctcattggttttaaaggtggtttttgttgacgtatagtagctcgtcgacctggtccaaccgagtaaatcaacatgtggggctcatatgtcagggactccttccttccccaaatttcctctcggcggtagcgtgtgatagcgtaaagactacaatgaccgctgccatgaggctgaggctgtgtttagttggatccaaagtttggattttggttgaaattaaagatgatgtgactgaaaagttgtgtgtgtatgacaggttgatgtgatggaaaaggactgaagtttggatctaaacacagcctgaagaagacgagcttctctgacctgcccatcgcgccgtcggtctttgcagcagctgcggtgatggtcgtggagctggatgttgggcgtcagcttcaggccaagaatgtgcctatggtctagagcttattgagggcgtgccttacgcaccactgggtacgatgatcactgggagttccgataaaatcttgttttaatctgaaaacataatagtgttgtatgcgcatggtaaacttaatgttttagcagagaaagggaatttgagttcaatacattgttcgatccctttcgctctcattctcaggccttataaagagttcggcctactacacggcccattcaccgcctacgtatcgtggattgggccgtatgcctctcgtgggccgatttggaggaaccggcccactatcctttgaagttgcaaggcggcgtcgcgccttagtgtgacaaaaactgaatgaattaattaacttaaattggttggaaagaggataaaatgaaatagaatgagtgtttgatattaagtgcgtgtagcaagcttggccactaaataaataaataaaccattcgtatgtataatactactagtaaaagaaggaacactaatttttcagggcgaaaaaaaaaaatgagtggtgaatcacgcaatcacttccctgcaatataatgcatggtgctcgccgtcgctgcttgatagcgagtgcttctcgattcgatttgcatgtgtacgcactcagctgtagttctatgttagactgtgataaatatatatattcgatcataccactggtggagaaaaccatctttgatcggtcggccgaaatatataatagtcccggttccactaaaaaccaggttcaaaaggttatagctaccttttgatctttagtcccggttgataacacatcaatcggaactaaagatcatttttagtcccggtttaaaagatggtaggtggtgtcagacccctcctttatctttagtcacggttggtgactaaagatctatttttagtcccggttagtgttaccaaccgagaaaaaaagatcgacatgcacggtgcgagatcgagaggaccgaggcgcacaggaggatcagttaataagttctgaccttttatctcctcctctcctcactcaccccatctcttcctcttcctcctcccatctcttcctcttcctcctctggatccacctcctcccctctcctcctcacttctcaacctcctctagatcggcccctcccgtctcctccccacttctcaggcggcggcggccgggtggctgcggaggcggtctcgcgcggccgggaagcgcggaggcgccctcacgcggcgactgggtggcgacggaggtggcctcgcgcaccattgcgcggcggccgggcggcgaggcacagcgtgcggcgggcggtggggcagcgcgcgacgcgggcggcggggccgcacacggagcggcagcgcgccggctcttcttttttttatatataatttgtgattgagagatgtataatttctttttaaaatttgtgatttattgcatggatctgagatgtataatcgatctgtgatgcaattgatttgtgtgtaatttttttaagatttgtgatgtatttgatttgtgtgtaagtaacttaggatttgtatttgtgatgttactttgaatttggggatttgaggtttgatttaggtatatacatgacactcgatttggggatttgttgtttgatctggtatatacatcccacttgatttaggagaaaataaaaagaaaatggaccaaccgggactacccctatcctttctttagtcccggttgatccctctctttagtcaaagatcgatctttacacccgttatttcacccgggactaaagatagcgatctttagtcccggattcgtagtcccggttggaaaaccgggactacagggggttataaaccgggagtaaagatggtttctcctccagcgtactctccctccatcacacaaaaccaatcttaatacaagatatgatacatcataatactacgaatctgaatagagtttgcttagattcgtagtcctagctaaactgtgacacatcccgtactagattagttttttttttttatatctatcgaatccatcacaaaaggagtttgggtttgttggtagctgcagctggagtactgtctccgtcgcatccaagctactctagccatgaatcagaaagcagacagattcctgccaggagaccacgaaccatgacattcatatcgccgcgcgcctccggccggccatcgccgtcgtcgtcgtcgaccatcgatcggccggccggccggtcgccgtcggtctgtccggcggccgtcactgttcgatcggtcgatcagagcaaaggagaggctgagtgtcgaaacatgaattcggcaataataaaacggggtagcgcacgagacctaaaagtggatggatgtggagacaaaggatttagacaggttcatgccctctcaatgagaggtaataccctactcctgtttggggaattgaatccgccgggtgtattatagatctgacgatctagttgtctcatgccccctagagggcctcctgcccaccttatataggatggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctataactagtcggataaccatgccgtgtgggtatggggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataattcaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagaaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacatggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattaggcacttgatcacgcgcactttggcctaagcaaaaagtgcctaagtccctaaaagaacgtgacaggccacacctgaaaatatgggttgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgatcgctccaccatgatgacaaatttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcagcagacgagacgaccgacgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggtcgaggtggccggtcggtgacgacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcggacgaggcggcccgtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagtagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaagccggcggtgaagtcgtagacgcccaacagcggcggcataataggccagccgtgtaggcggaggcaccaatcggcgacgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggcgatgtagatgacgatgcccatcaacggtggtgtgaccaaccgaccgtataggcgaggacaccagtcggcggcgacggaggcaggccggtggtgaagtcgtagacgcccaacagcgacggcataataggccagccgtgcaggcggaaacaccagtcggcggcggcgaagtccagccggt

SEQ ID NO: 68990 - DNA, 20315 bp, Oryza sativa
  unsure (1)..(20315): unsure at all n locations
ttggtgacccgaagcggaagagtgtatcatttcaatccttggaatgaaaggcgaaatgctgaagttgttgacattcgctaccacgcccgagtctgcattgaaggtatcccgatgcatgcaagatcagaagacatggcggcaaagctcataggctgcaaaagctcagtgcactacatagaagaatactcccgtcgccggaacttcaaccgtacttttgatctttggatttggagcttagacttgagcaccatcccaaaggccacccagttcacaatcacaaggccagatagagaagcaagggctactgagatcccttttcctgacctggagccatcccagccggctccaactgatacaaagaaaggcctcacttatccggtcatcattcacatagacactgtccaggacctcttctctcgacagggtcgggtcttcatgtggcactatggagtgcctgatgatgtcacccggatgaggtcgatggctcacccaattcaagcctgcagaacccttccggcgccggagagaaggtctgatgatgaagacgaccacgagcagcgttcaagaaggaggcatagaagtcgctctctttggaaccgcttaggcggtcgttcgtcaagcaaaagcagagagcctggtcttgacaaccggagttcatacaatcaagagacaaggggaagacagagagaacgagctgctgacatcaatagaagtagaagccgacatctgtccaggtcggtcaaacctggagaaacaagaatcaggcgtcaatcggcgacacctccgcatctctctgaccctgctccagcagacaaggtttcctccccctgcaaacctttcagccattcaagagatagcagccctgaaaatgggcattgctctgcagttgcttctcctcctctcgaacctctctcacctgacatattgcctgtgtcacaggagcaaggggcgttgctcatgcttaaaaggcacctagatcctatgctgcatgaggctatggtgggaggttcaatttattcccctgacactactctgccacgccctgcttcccctgtttttgttctttcatctgctgcagaaccacaagagaacttagtggatgaggcccagcatgatgtggagacattcctagcagaggtgaccacgcccattcagcagccactgctgtctgcgccaggaacaaagctgcgtcgaccctgccgcaataaggtgaccactcctattcaaaggcatagtgcaagattggcactgaaagtcagacgcagtacaaagcttgaattaattgcacaagaaattcttgcaaagcaatttggtgttcttgatgataacaagcttttaagtgatcaaattaagaaactctatttgcagcattacaagaagccgctctccccagcagacatgaagacaatcacgaccctggtggaaaacggaggctgcaaaggagttcgtctgcgcgctaagaaggcggcctctatggtgccgatttgaagcagttgtcgcgtcaaaagttgccctacgtgatgatgatgttaggctgcttaagtagaagaatactgtccttgttctctgtattgcaaatgcgcacctcttcgtgtttctgccaatcttcctggctgtgtttcagaggtcgtcagctgagctccatcccaaccatcgcatacaaggccccctcagctgttgtgtcttttgtttatgtcgcagctagactgtttcattctaaactggaatgttagaggcttgaacaaccaagctagaaaaggaagtgttaagcttttggtagaacaaatgaatgcaacaatagtctgtcttcaggagacaaagatgaatgaaatcactgatgttgatgttctacacantcttggtaatcgtttcagaaatgattttgcctatctccctgctgatggcactagagggggtattctgcttgcctgcaatggcaattttttcagcctctccaatgttgttcagaagcagtttagcctcacagcaacagtaaccatgaaaaacgataatgctagatggtccttaactgtagtttatgggccacaacaagatgctcagaaaattgaattccttgctgaactccaggaagttgaacagatggtttcccttccttggcttttaattggagatttcaacctaatctacaaaacctcagataagaacaatagtaggctaaacaggggaatgatgcagcgtttcaaaggtactctggacaggttggggataaaagaacttcacctttcagggagaaaattcacttggacacaggagtgtgctaacccaacccaaacaaaaattgatcgtgctttctgttgtcctgattgggatgtcctctttgactctgcgcacatgtctgcactctcttcgtcctgctctaaccatgcccctttattcataactggctgtatggaaagagaacaaaataattccttccgctttgaatcttattggctcaagctcccagatttccggcaagtaactgcagagtcctggaataggccactacagactaccaatcctttcgtgcgactccatttaaaattaaaaaggcttgcaagagatcttagaagatggaaatcaaccagaataggagatataagattgcaattggcaattgcaaatgaagtagtctttcaactggatgttgctcaagaggatagagtattatcggaggaagaacagtgcctccggaaactcttaaaatcaagggtgcttggactggcagctttagagagaatacgactaaggcaaagagccaggatcacttggttaaagcatggagacgttaactctaaattcttccaaatcaaagcaaatggtagaaagagaaaaaatcacatacagatccttcgaactccagatggctttgctgtaactaaagatcaaaagcaggaagaattgaagcgttacttcacacaaaaattaggagcctttgctctcagaaatcagagattaaacttggctgctctcaatctccctacgcttgatctctcagatctcgatgataacttcactgaagaagaactcaaaaatgcaatctctgacttgccttcggaaaaatctcctggaccagatggatttattggagcctttttcaaacaagcatgggacataataaaaacagatctcatacaagctgtttccttctttggagatatgggatgtgcaagactgcaagaactcaattcggcacatatctgcctcatccctaaaaaggcggatgcaacaaaagcgaaggatttccggccaataagtctaatgcatagttttgcaaaaatagtagctaaattactagcaaacagacttgcaccaaaattagatgagctagtctctcaaagtcaaagtgcattcattaggaaaagagcaatacatgacaatgtcctgtttgttcagaaaaaaaagcctactcttttcctcaaagttgacatatcgaaggctttcgacacagttaattgggcatacttgctagaggtccttcaaatctttggctttggacataaatggtgcaactggatttccaacctactaggtacttcctcttctgcggttcttcttaatggtatcccaggtcaggaaatagaccgtgctagaggtcttcggcagggcgatcccctttcccccatgcttttcatccttgcaatggaacccctgcacaaattattcaagaaagcagaggatcttggccttctctctagtctgcaaagacagcggcgcttcagatgttctctctacgtagatgatgttggtctttttataaagcccattcgagaagaaatgctagtccttcgtggaattctttctgtctttgcagatgccagtggacttcacacaaacatggaaaaaacatagatcttcccgataagctgtaacggagtcaacctagataactgcctttccatcttcccaggtggaatttcaaacttcccatgtaagtacttgggcctgcctttgcacacaagaaaattggggaaattagagcttcaacctctggtggacaaagtgggatcgagaattcctggttggaaaggtcgcttcttcacttcggcaggtagagaggtgctggttaaaaacactctttcctctaccccaatttatcacctaacaattctccagcaaaataaatggctttacaaaaggatcgatcgccttaggcgagctttcctttggaaaggtgacgatcctgaaaacgttagcgggggcagttgtcttttgaattggacagtcgtctgcaagcccaaacctttgggcgggcttggaattctcaatttagagaaattcgctcgggctttaagacttcgatggctctggtacgaatggaaagaggaaaataaaccctggatcaatatggaaattccatgtgatgagatggacagaaatctcttcagagcaagtacacaaatttccctgggaaacgaaaagaaatgcaagttttggtcagacaattggctgcaaggatacgctcctaaagacatagcgccgacattattcagattagcaaagaggaaaacaaactgcgtagcctttgagctgcacaataatcactggatcacttccttaagaacaatcacttcaataaatgagatcaatgagctggtgcacctaggcagtaagctgcatgagatcagattacaccccaattctttggatagtatcacgtggaagtggactaatcatggtgaatactctgcaaaaagcgcttatgaaatgcagtttgtaggatcagttgccaacacaaattttatgccactttggagagctgaagcggaacctaagcatcggttctttggctggttaattttacatcaaagaattctcacagctgaaaacctccttttaagacattggccatgcgattggatttacagcttatgtacagatgcttttgaggacgcaaaccatttggcaaaggagtgcagtttcactaacacggtttggtcccaagtttgtagctggctggacatcatgcagaccccaaatcaactacaggatgcaaacattttagaatggtggacctcaatcatacattcaacttatggaaggagaagaagaaaactgataggggcacttcttataacctggtggcaggtgtggcttgagcgcaatcgaagaattttccatcaaaagcaactaagtgccacccaagtagctttcttagtaaaggaaaatatagatgccattcagattttgcgccatacataaaggcttgtgcttagctctagttgatagcattatgtatgtaaatctctgaaaatgaaaactgaaaatgtcacctagtggtctactctttcttgacctctctaactgcttctccttctaatatatccggcagagctcctgccgtcttttgcttaaaaaaatatatttcatcttttttagttaagttattttaggtcggagaaaatatatatctgacgtgcctatcaacaagacaacaacgtagagttgtcagcattagcttgccacaggtttgacttgcaagttgcatgtgagtgtagcttcgacgcagcaacctggtgacctggattcgtggagagcaaacgaattgggatgtgcgagccgagcagccacctagcaaggtgtcgcgtcagactactgacacatggcccaaacagccaaacgcacagtcgtctcagcccacctaacctaacgatggtcggcctacgggcctcattgctctccatgctcacggcccacggtagagggaggcatgggccgccccctatctacgccggcctttacgggatcaggtgggctctggctctgaagatcgagctcgacaggcaccgctcggaggaggagaaggcggagacgatcgaagagttcgccgcgaggttgcgcagtggccgctgctttggcaattggattggacagtggatgagtggaagaggaacaagatttactagtagtagctgatgagtatagctcagtgatttaataatatccattatcttatcaaccgcaagcgcatagagccatagaacggaacaaatttacaccggattaccgggttagaaccatactaggttttacagatttatcgtcagattcgtaatatccgcgtgcacagcaattgcctatcatatctaccgtcgaattcgctatggttatcatatcgttttccttaaaataatgcagaatacaactatacatagagataatggaaaattacaaaatcaaatatacggaaagatcgcggttgttggcaatcgtgcaccaatcggtttcacgctccatatattccgtgaaaatttgctcgacttaacaactatacaaagcgatctgatcctgcgagggttttacgtacgcggcgcttggttgaagcaggcaacaacatgggcaacgccgccgccgtgccgtcgtcgtgcgcttcggcggacgcggcgccgtcgacgacgccgaccatcaagctgctcatcgccaaggaggcccaggtcgtgctcttcgccgaggccggcaaggacgtcgtcgacttcctcgtcgggctcctcgccatgccggtcggcgccgtggtgaactgctcgcgggcgagaacgcgctcggcggcgtcgcgaacgtgtacgccagcgtgaggaggatggacgccgcgtacatgcagagcgcggaggcgcgcgacgcgctgctgaacccggcgccggcgcacccctgcctcgccgccaccgccggtggcttcccgtccctcgtccagcccccgcgcgtccaggcgccgtacgttgctcctcctcctcctccgccgccgccgccgggccacccggcctaccagtgttcgaccatccggccgacgaccccgtctctgccgtctctgaaggcggcgttcccgcccttcggcgcggggatgtcgtcggacacgggctgccgctgttcgacctgcctcgccgccgcccagactggcaaagggttcgtgcgggacgtggtgacgtacaccgtcatggacgacctcaccttcatgcccatgtcgagcatctccagcatcgcgctgctcagcaagctcggcgtcgaggacctctccgcgctcgaggaaaagacggtcaagatcggctaccaagaggtgataaattaaccagataaattcttcatcgaattctccatactaatttactacttagggtgtgtttagttcacgtcaaaattaaaagtttgattgaaattagaatgatgtgacggaaagttggaagttactccctccgtcaaaaaaaaaaaagacgaaccctggtttccgtgcccaatgtttgactgtccgttttatttaaaaaaataatgaaaaaaattaaaaagacatgttttatcatctaacaacaataaaaatacgaattataaaaaaatttcatataagacggacagttaaagttagacacgcaaacccagggtttgtctttttttttaaggacgaagggagtatgtgtgtaggaaagttttgatgtgatagaaaaattagaaatttaaagaaaaagtttgaaactaaactcggcttactttgttttgatgcgaatttgcagggtttggagattctgaaggcatcgttgcagtccaagaccgtgttgacagatgtcttcctgaacaggaagaagaaggctcgtgccggcgacaagcaccatagatccggcgacaagaacgtcgacgcccgagcaacgagcgagaagaaagacgccgccgccgcagtccagatggagaagagcgcgccgccgatgccacatgattttgacgtctagttcagttcagattaatgtcaaaaaaacagatcctacttttgaaagaactttaccaccaaacagaagcataatgcgttggttgatttctgcgacgttcttgtaggaggcctttaaaatttatgtagtctacgtcatgctcatgtggaaattatttcgaattcagtccaaattcttcattaaggagaaagaaatttcgagttcttctgagcattgctgctgcttgaactgaaccagacaggaacggcgaaagacaacagcaagaggagagttcatagattgctcgagcaaaagagatgcaagcctcgaccggtccagtccaaaaagcaaaggaaaaccggacaacaccggatcaaattgagagtttcagaggcaagcaaatcaagaacagtcaagcacattagaaacagcggtagcattagaaacagcagtacagtagtacacatggtgattcttaccagcggagagtcctgattcacacagattaagggggacttctacgcacactactatacgggtattgcttgaacatcccaaattgcttcaggcttaaccttcatcatgctgcacttcagctactagctagcaaaagatctggggcgcgcacgagtgcacgacggcacaagatactactagtagtacgcattaatttacaggcatcactaaagaccaatacagtcgtatagttaactacttatcgatcgagatggcttgcattttgacatcgccagcgaccagcgttgttgaagtagtagtagaattcaggcttgctttgcaggcctcctggcaaggaaaacgtcgctgagaacggtcttggactgcagcgaggccctcaggatcgccaggccctacaaaacacaaacacaacatatatgcagcatcacggacatggcaacgtgtacatgcaaagcactaatataaaacagagaaagagaagaggagtggtgagtgttgactgatgaatgatgattagtagataatttagtttatcacctcagtgtagccgagctgcacggtctgctccttgagcgcgcccaggtccttgacggcgaacgtgttgagcagcgtgatgctggagatggacgacatgggcgacacggtgaggtcgtccatcaccgtgtacgtcacgatgccctgcacgaaccccttccccgccccttcggctgcagcggcctgcagcttctgggcagcggttggtgcggcatacgtgcatgccgttgtcatctggttgccgcaggacggacacttgacgccgctcacgtccgtcacgtagtagaaacagtcgtaggagcggcagctgaagaagctcttgggctgcgaagaagacggggccggcaagcggaggacggaggtgttggagctggccgccggcgagagcacgacggggctgagcagcgcgttcttggaggcgccgggctggacgtaggtgccgtcgagcttctcgacgctggcgtagaggttgccgacgcagccgaccatggagtccttcccgagcagcttgacggccgtgccgaccggcagcgccaggagggagaagaggaagtcgacgacatccttgctcgcctccgcgaacagcactcgctgggcattggtgtcgacgagcagcttcatgctcagcgcggtggtggaggctgccattgcgcgagctttgccaactgcttttctccgcctacactactactggtagtacactagtactagcgcttcagcaagcgggtgggtgatctgaggctctgagcgactgagcagcacatgtctcggcggcggccgcctgctcgtgatacttatggtcgggggtcggcgatgcacgaggggcagcgcctcttcgagcttaagagcatctccagacagcctctccaaatcactctccaaccgtctatttagccaaatctccatttaattagcaattcaaatttgttatttactccaatagtctctccattcatcctttctattctgatttctattctgagccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaatattctctaattatagattaattaggcttaaaaaatttgtctcgtgaattagcttttatttatgtaattagttttgtaagtagtttatatttaatactctaaattagtgtctaaagacagggactaaagttaagtcctggatctaaacaccacctgagtgcatgacagtaggatccgcatgtcagcctcaactttttcttcttcctcgttttctcccccttttcccgtccccggtcccctccacgcctcgcccctcctcccctatgtccttgtcctcctccgtctccgcctcggccgattcgtgtgtgcgagtcaacagcggtggcggcggcgagaagggagaagccggcgacggcgaattcgttcgcgcgaggcaacggagatagcggatccactccttgccgagaaggaagaagatgccgacggatgtggccgggaactgaggcggtggcggaaacacgcttctctctccattccttgacgccggcggccgacgagcaggaggccgcgggtgcgctcgccgtcgtgctgccccaccgccgcatcctcctccttcactgctctcaaccgacgcgggtagtgctattgcgggagggaaaagcctcttcagcgtgggatccaccaatggcaaggcaggttgggctaaccaaatttggccatgaggggatgagtttggctaatcatttagcttagccatcctaatagagaggttgttggagtggattttttttggttaaaatagccaaatttagctgctctaagccaaaacatagggggtgtttagactttagatccagggaagtaaagttttagcgtgtcccatcggatacacagacacacatttgaaatattaaacgtagtataataacaaaacaaattacataatccgcctgtaaactgcttgacgaatttattaagcataattaatccgtcattagtaaatgtttattgtaacaccacgttgtaaaatcatggcgcaattaaacttaaaagatttgtctctcaatttacacgtaaactgtgtaattgatttttttcgtccatatttaatactcgatgtatctatccaaatattcgatgtgataaggtgaaaaatttcaggtgagatttaaacagggccatagtataaagtttcttcgccttctgcgtgcggtagtgggttttgagatgaggtgatgcgagagggcgtcgtacagcgtgcagattacagacgcagatagtacttgtgtcattacagatttattacagtgcgtaggtagcaatgcatacagcagcgttagtgcgtgatgagcgcacgaactgaacgcatgacgatttttattttgctgtcaagcaacctctgagcggaagcaaaagattttttacggctctaaattttttttggaaaattggtcggtaatcagatgcaaccgaggcaaacaccaaactagttaagcgcctggaactgcacacatactagttcgctacaaatacaccttcgagctgaaccatcatccatcaatacagccatacagcatacaggagcatataccgagttaccgaccatgcccgatcgaagttgggtagtagatacgaagtacttgagtagtagtatactgaagtctaaaggtataaaagcaaaataaaagacgatactccttgtagctagggatgcatcatgcatggacacacacgagcaatgcatcacaaaagctcaacttatcctaaacatatcgatctaaaattctaaatagtccaacttaccatcttcatgtcagtcgtcatccgtcaggcgtccatgacctataactactctaaggcagcgttcgttcggaggacattgagggagaaagcacttcgtttttcgcacacacgctttccaaactactaaacggtgcatttttttgtaaaaaatttttatagaaaagttgctttaaaaaatcatattaatctatttttaaaatttaaaataattaatacttaattaatcatgagctaatggctcacctcgttttacgtatcttctcaatctactcaatcccattcttctcaaacacaccctaaagctgtgtttagttcagcgtaaagtttagattttaattaaaattggagatgatgtgactaaaaaattgtgtgtgtataacaggttgatgtgatggaaaaggattgaagtttggatccaaactttggatctaaacacagcctaagcttgaattgctggtttcttgccaacgaaaacgttgaggactaggctttataaaccacgaacaacatgtacgacttttttttactcaaattatttctaattgcctcatacaaatttttctactgtttatcagcgtaactcaacagccaaatagcttgggcacttgacaagctatccgacaatagtcacgaagagattgatctgctttaaactttttattggattcatgagatggacaaccagcctatccatggtcaaaatttctcaagagcagaagcacattcgcaaaaggtgaatgtgctgtgacaggttgggtgcccggtgtagacaatggatgttcctatataactcaaaccttgttacaagcagtgcactcacttcacgtacggaagccaagatccttcaattgctgtggatctacaggagatggcgctttggtgagtgaacattgagcagttgtagtctttgggaaagcaatcacatcccggattgaattttcaccagccaaaagcatcaccaaacgatctaacccataggcaattcctcctgccatggtataaaaattaggtggaatttgagctcaacattccaaaactaaaagcagaatggaactagacatactataacacatgagtacatggcaatacgcaggtacaagcataaacgctgacgtttttttttcttgaatatgcaagaagcatatcactaacgcttgcatttattaaagcatcttagaatcaatatgctgtccaaaatctgatggtgtggttataacaagaagtaggattgatttgaaagattgctcttgtttgtggaaaaatactgtcttaatgaaacatacaagcatatagtagtaatagaaagttcagtatgcgatccaaaatctcaaatctaatccaaaaatatgtacatggagttcagtggttgaacatagcataccatgaggaggagcacccatgtcaaaacattctaaaagatagccaaatttttcctctgcctgcattgcaatttcggtattttagagctcagcaaaatgcaaaaggtacagcatgttttctatattaacaagtttgaatagaacggataaatactggtattttttacataattcctgcatccaaatgtctcctaataatgaaaataagtgacatcaggtactcaaaactcacagtaggattttttttaacgaatcacagtaggatattatggtcattaactgccagatactatatcactgcatttgatgtttctttactctctagtcttgacactcaacattgaacctttctagatgcatccagcataatttatgatcatttaccttgaatattaaggcatgcttgaattgagctatagataaaaacactggcttatgaatgacagcatgcacctttgccacacaaaacaagactacagtctcagacaatctaaatctggaggtatttcttcacaattatgccattccatgtccagtgaataaaaagcatgcacatatggcctaatgctcttatttcatctcagcataacattaattacttttaaaaaaattatcgatcaatctacaaattgaaaattgaaagcatggtactctcaatagtatgaagtgtcaaatataatacctgctcgggtgagataccgatgatctcaaaaatcctttgttgtacatcacttttgtatatcctcaaactgcctcctccaatctatatttatagcatgcagaacaaaaaagatgcatgttatgattttctacatagatctttacatgaattccagtacatataaagatacacaacttttattgatgtatcagatcagactctgcagtctgcacaccttgtttcattggctattattacagaaaaagggtctaaactcaaaagaaaccagccaaccagtcttacgaattaatcacatctatctgtcatggtcaatttgagatgagtatttagcatctgagattttaaatcacattccaatgaacaaatacagatagacttgtagaaagggctataatgttatcataatccatatttaaactagaagaatgtcttcaataaatgttgaagagcatgtgccatgtatggatacagtccacatgcattacaatacctcaaccccaagactttattaagacttgtgcttcaatgcttacacaagattttgcatcaaggagaatatgtgctaaattttctactatataaatcatgtaaaagagcatgtgcaatcttggacccttttctgaactagtatgtactgaacaaggtagcaagaaacttgatgcagtgaaagtacctccactccattgtaaatcatgtcataagccaaggctcgagctgatggtagatcattcatatcttcaggatttggtgcagtgaaaggatggtgtagtgcctatgagaacaatggagatgctcagagcacgcaaaacacaagacaatctttactttgagttacatgtcaattctctgttttaccagtgtctaaatttcttacatttaactgtttttccttctcagttgttcaggagagcaatgctcattcactgtaagcattaatgacagattacacattttgtaaattttgctattggtatccctatgaaaatttagattgaacatgtaaaactgtgtatgtttgcctcaaaccttccgtgacattgcaatcaaatttgcattctggagacttgtcaatgtccaaaagctcttttttgaccagaggaagtaccaaaaacaatctattatctgatattggcccttaaatttgtttgttaatactatataacctgttcgcatgccattaacaaatttcaggacatcattaaccaatggtctgcattctggtgatactgtacagtatgttatttcctttttgaagaatataactcagtatcctaatttagtaatgtgcattaatggtgtgctttagtaactactacaatcaacattctacaaaataattgaagtctgagcagtcagcaaaatggcagttctttaaatagtgtgatacagctatgcttaaagagtattcattctggttttggaaaagagtgaaggagtaatcagttgtaatttttgaaagaagatacatagaagaaaatctaacctcgtatctctgctcatcactgttccattcaaacattggaaaatccgtcacccaaagaattgaatgtgctgactagcataaagaaaacagaaaatgtagatgaagatatcaggagcataactaaagcagatgatcaggactgctctcagaaggtaatacagaaaggcgaagaggcacagaatctcaataaaatagcattcatattcacagacttactgtatctatcacttccagcttatgagcaataaataatcttaatctgccaagaattcgattagccgctgattgctcacccagtgcaaacaggataagatcacctgattttgcatctagatgtttcaacaactgctctttcttttcaggtttcagacttgccacgagtggaccaattccttcaagctctcctgtgagcagcagaccaattaaaccacaaaacaaattcattggccaggccaaaaagtttatcaaccaaaagagtgcaaaaattattttaccattgtccataactttgagaaaaggcaggcccttggctccagctttggaagcttcagtgtagacagttcctttctttaggtcagtatttgaaaattctttggcaccaccaggaacacataatgccttgatgacacccccgttttctaatgtatctgcaaaaatcttgaagctactgcccaaaaatgcatcactaacctgcattttaacagtaagaaaaggatgaagcgtagctgtgaatttattattttagttatcacagtaagatgggccattcagaaaggataaaggtactcacatctttcagctgccaatcaaaacgaaggtcaggcctatctgttccatagcgattcattgcctccgtataggttagccttggaaaaggatttggcagcttgatatcaccaacctcttggaaaatctgtgatatgaatatccataattcaatcaaccatgagcaatagttaaagaaataatggcatattttctgagcaataaactagtgaattaagagcctgattactactaacgatctgatgtacaatagctaaatgacggaaccagtgacagacctacagtcttgtcatgggaattgagccaggaaggaggctggggcctgaggcccagaaccagcagcaaaacctggccaggtatagggggaggaggctcagcccggagcacacgcgtgactacgtgagggctcatgcaaggaggcacttgtctacattgcagggaagaaggtttttttatatagggatatgtgttcaaacgtctcaggcatagctattactgtcggtatttactaatagacaggggtgaagaacaatgctaactcaaatacgaaattaactaaaaagataagaggaaacaagttaagtatttgaaaaccaacttacatgtctcattaattcttcgttcaacttcaacatatcttccattgatgtaaatgcaatctccatatcaagttgtgtaaactctggttgcctatctgcacgcagatcttcatctcggaaacaccttttatgaagtggttcaatgaatcaagacaatattgcagagcagcattggagataattgtttgactggttcaataatacttccctccattctgaaataagttaacctagtacgggatgtgacacatcctagtactacgaatctggacatgctcatgtccagattcgtagtactaggttaactaattttaggagtgagggagtaatatattccaggaactgagcagtgtacagtgagcaatttatattgagaatattcatgcaaacaggaaaaaaatcaagaacccagctaaacaggttacaggggaaagagattatgcaacagagaatatagagcaactcatgcagagttgtaagataactggaagaaaaattatatccaagaaacaaacatccttcaaaatgttgtacctactaaccttgcaatctgataatatttttcaaagccagagaccatcaacatttgcttgaacagctgagggctttgaggaagagcatagaacattcctggcttcaaaaaccatatttnagggcatcaggggaacatgaagctcttatttgaagaagtttcaaaaattcactgcagaatgattagacctaccgccaaaaagcactagatatatatttatgatactcaatagagttgtactttcataattgtcactgtttatagttaaaataaacccaccagagaatgcaaaagaaatgtagaatgtagtgtatccccacaagaacgtaggcacaagggaagtcttacaaaaaaaggttcttacatttatttttattgcagttttcaaaagttagttctagccataaagtttttcttttaattggaaaaaacaaggagataaaggaaattaactacatccatctactggaagataattgtgcttaacgatggtaagacaattgatatttgagaaagcaattattacaccagtgaacccaaatatgatttgggtaattaggtctttgaaagttgccacaaataaaagtgaacgaaaaagcactgcgcatttttcaacagaagaaataaacgtgttataattgtctgtttaagtgaaaaatagttacagacaacttacctgaactctcgatgggacaagatagtcccgagcaccttctggtgtagacttagataaaactggagtctcaatctaccttggaacatgcggtaactttggatcagacacaatagaaacaataacagatacagacattataggcattgcaaggtactaagatattattagtcattgtgatgtcttatattctaatgactcgctgtaaaggagatacaacagcaaagaaggcatacatgacccatctatttcaactgatccaagttattttaactagcaaattgtacaggaaatgattaaaaaaaatttcatgtacaaagcaaacaaagcatacatgcactctgtaaaaaaaaaaaaagatgattaaaattggaattagagccctaagcccaaggtgcaacatgaccttcaggcattacatcatgaaagcaagtatcttgctctctctactgcaggcactgcatcgaaaagaaagtattttgccgtcttgcaaatttccgttcatctataggaccagactacttggatatattgcattccatagtggaacaaaatgagaagcatatagccaaaggcagattatgttagaggtgcaaactcagcatgaagtaattaatgagtatataattggtatacagcatacctcaacaaaatcatgtctatcctccaagtatcgacgaatatgcttgacaacattatggcgcaacctcaagtttgactgcatttgtggtcggcgtaagtccagcacccggaatctagacatttacaaatatggaagttaaagaaaaagattggtccttaatatatggaacttaaaacccataatataactatattcaagtacaatggtcgcctgctgtgaaagaagacattgagaacagggaaaagtgctttaggcaaactattaaaaacattatacaaacagattcaagcataatggtcgcctaaaatcttgaaagaaggcaaagagaacaggtaaagggctggcaaacacagaaaatgtacatcttctggcaaggatggttaaatctggaacaaatttgtggtcaggattgcagaatgtcatgacatggtattgcaacagagtaaagggtggtttaacagcagtatgtagttaaaaacattcctatacactagcataatccaaatgatggtagaaaattccaaattaaactgaatatgacagccttcataatgaccgccaatatatcgatctagtgaaaaaatattggaaccttggaagaacaaagatccatagaatatagcaatggccatagttcagcgtaaatcagtaactggggtgaatgattaataaacaaagagattgcaaccctcacggagtgaatgatgtgccatgtttcacagtatctccaaagccactattcacagggtaaacatgtgactccccagaaaatgggttaacacctcaacaagttgtgtcccagtagttagtgtcgtaatgcaacctaagtattattttggcacctaaaatcttatgcacaactttgaatgtgcaatgtaatcccatttatgcatgtattcaacaagcctaatcaggcgttaaccaacaatcaaccaccatatttgaggtattcaatactagtatttcttttcttcaggatacttaatatatgagcataaaaagagtgcagataacaatgtattttacctcagtctaatttcttctggaaacttctcttttacagtatcagcagtggtgattggaaaaggcaatgaacgagttactgagttcagcacatatatattatctgcagcaacctgcataggtcagcatgtaatatcatagttagagagcattttgctgtatggaggaacacaataaaaaaattcaggaagtccgcaacaatgaaagaaaagaagtgttagaattacaaataatgttgcacgggctattccttatcctatatattagctcttatagcatctatgtgctccgtacatatgaacagcaaactttaaaagtgtggaatttctgtactagatagtttgaatttcaaattcttcacttgacatatcatctcaagcttctctctctaaactgcaaaataaagtaacatacaaccagtcaatacctctatagccccagtcttcatatctgtgttgatggcttctgttgggcgtgaccgaacaaccccctcgaccgcaaccactgactctactcttagtttgttcaccacagcataaacttctggatattctggcaaagttgtcacctacacagagagaacaattaccgataagaccatgctatcttgtagatgtttatcagtctaccaatcactacagaaagaaaaaacaaatcaactcccccataacattacaaattgatgcgattatatgacttcattttgccttcgtaagttattagatcactcaacatcagtttattgggaatttgtagctgcaaacgttgctaaaaccactcaatagaacaggaaaacagtaggtaatgtcagtgctacaaatactattatactccctccgtttcgaaatgtttgacaccgttgactttttagcacatgtctttgaccgttcgtcttattcaaaaacttttgtgaaat

SEQ ID NO: 68991 - DNA, 2936 bp, Oryza sativa
ccctactcctgtttggggaattgaatccgccgggtgtattatagatctgacgatctagttgtctcatgccccctagagggcctcctgcccaccttatataggatggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctataactagtcggataaccatgccgtgtgggtatggggtacccataatctccacactgagcatgttggtagtgtagccaccacaagccatgcaatacagcacactcgcgatcaaacatgcatgtccaaccgtgtagccactccactacatgtccacaaatgcatggccaattcttcttctgcttttctctctctctctctctctctctctctctctcttctccttcttcctcccatcgttttctacagcatttcttcagttgttatttttgggcagcatgcgtgatgcatgggagccatgagagcataagttgagaagctaactagctaggcatctaatatattgatgtgtaatctttttacgcgtccgcgaaaaaaactcgctaggcatcaactacctatccaaggctctgttcgaacttgagtaagatatgcacgcaacacgtacaagaaaagcagaaaagcagtagtatattaattgagttttttttataaaataggctaaaattcggcctttatatccataatggatatacacagcctatgattaattgaattttaattattacaaacattaataaaaaaattgtcatattatataatattttaatcagtgttcacctagtcgctaaacgctagtcggacggccaccgattgactagcgactaggctgattaggcggcgactagacggattaggcgaattagacattttttctatttctttcacacaaaaatactgattctatacattcggtactcggtaaatattggcatttaggcaaatagcataaatcatagttaaattcagaaatcatcaagtccatacaacgcgctaacactgcacacgaagcattgggtttagtacaaatctatagggatagcgaacacatcagtatagccactgtacatgcacatcataattcataaatcataactttataaatctgaggggctggagctaggagagaggaagaaaaatttatctagaactggaagaacagaggaggtgaggtggtggaggggagcctgatcccctgatggcctgatctagggttggcgtaagctgcttgagtggttccgtacttgactgcttcaatcggtgtgtttgccaccttccattgacggcaaggatgaaggatgagatggagagcaggagaagcagaggagggagaagaacgtggagaagcagaggaggagagggaaggacgtggagaagcggtggaagatcgatgggcgcggcgacggagccgtcgctcgtggcggtgtgaaaaaaggggtaggcagggattacgctctctctccaggctctcaaataagggaacctaaatccccttctataccgagtcggtcccgcgtggcgcttctaaattttatcacgcctaaattttgatttctatcgcctagtcgacgcctaaacgcactgtcccgttgtctaattgcgcccaggcaccatcctgtccaggccgtccaggccgcctaggaccgactaggaccgtctaggcggtaaatcgactaattcactgcctagggtgtaaactggacaaattgtcgccgactagcgattaatcaccgtctagacgggctaggcggccgtttaggcgaacattgattttaatgcaacttttacataaatttttttaatgaaacataccgtttagccatttaaaaaacatgctaacggaaaggaaaaacctatatccaccaactcactcgccgccgatgaccgaccgtagatcggaattcaccggccgaaactggtaccggctcgccgccgccgccgccgcctctgcaacggccggacggcaacgaattgccagcatatgcatggatggctagctggcacacaacgaaattacgaacaaactgaactgaaagagaaaggaaaaggtgatacatgataatgatatgatgatgcaaattgcaagcgatgcctagctttaatttgatttaatttaattctggataacgtatgtgatgtctgcttgcaaatattgttcgtttctgatgcatgagtccgtgcttacgttttggcccatatccaaagtatgtatgctatccaacgtcgacttcttgttgggttttcatgacgaaacccatcaaattcatcttcttctcatcctgtatatcaagggcgggcccagtatgtattcaagggtattcagatgtatacctaagttttttggacaaaaaataggtatatataccctacagtgtgtatatgtattaaaaaaaattaaaaaagaaaccttatactgcttatattgggccttattttaccatttcttctctattggtcctaaattttccgctttcctccccctttcctctcagcccgcaccctaattgggccgcatctcagcccatttcgacattttccccaattcccctccccatctaaccctaaccaccacgggagccgagcaagaggactgaggaggcgtgcgggtgcaggtccgccgtcccgcgtcgaggcagccggcggctgcggcgccctgctcgccgagcttatggtgcgggcgcgtttcttagtttgttcgtgccggcctctccgcgccggcgtcgagctacacgtatgcacgccgtgtggttttgggcttttggctgtctggcagacagtgtggagcttggctttggttgcagcaactgtggggagagatcgggaaga

SEQ ID NO: 68992 - DNA, 1076 bp, Oryza sativa
ctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagtactagattcgtgtttgcaaaatagccctgagcaactaaatatctttaaatgctgtttactgcaaccctaacccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagcgcctgtggtcgtcgccctagtcttccgctatttctcgtttgtctttgtgtgtgctgggccttcgctgcccctgtaataaattatctatttacgcttccgcttgttaaactctgaattgtatcaacttttggtgtaccttgcctcctgggacaagggttaatgcacgcacgcaaggaacgcccgttgggtcagttccggtcgtgacaagttggtatcagagcccccttgaccctaggacgagccttagatcccaagccttagcaatattttcaaaataaaaatcccttcttatttgtgaaaatcctctattctctctctgtcctgctgcttcatttatcgccaaaatctgacctttaaaatgttgcttttctttttgtttttgtttgtagatggccggcagcgtcagccgtcgtggtttggacatgactggcttcgtcttggagctgcggggcatgtgcgtggtcctggggcatccacatggagtggactaccaggccaggccgctttcggagcaagagggtgacgatgcggaaccccacgctgcttgggaggtcactgcagtgatcctcgctggctctcccgagcggacttcgctgacagtcacc

SEQ ID NO: 68993 - DNA, 1638 bp, Oryza sativa
aaagtcatgtgcctacaaatgcagccaataatgtgttacacaaccaaagctcaaataggaaataatacacaagaaatgatgttacttgatcagattttctaccagccactgttgtgtctcagtaaatggccttgatcctcctctattccgagaatcgtcttcagattgtagccttgaatcttgggcttttttccgcttctcaaggtattgctcagtgtcccagtggtggcagagagaaggccaatctgattcactaacccattccacacgagccagcaggtattcctcgtctgagagttcaattgtacgggctacttcgtctttaatcttttccccacgcactttaaagaagtagagcttgacagcatcaacacgaagttgatacatcatatcattgacgcgcttgtttgcatattgttgtaagacacggttagcctctgcctttaattcttctcttgtagaaaacaatcgctgcatgatgtgttacaggtatacaaatagatttaaaaaaacaaaaccaaacacttctttgaaatctaggataggaaagaattacggttacccaaaattcattcaccactcgctctgcacatgtctctccatattcttcattttctttcaaacaataatctgccccccccaaaaaaattttgggggggaaaaaaggggttttggggaccagggcggctacgaataattctaccatcattgtcaaggtccttcacagtgcctgagtattcgcgtttcagaataaccccaagctgtgaggtatacttgtactctgcagcatgccaattcacatacttgaattgcctgtatacaaggttagcacacttagtctcaattcacataattggttcaaatgaactagtagcaaatgactaaattagtatagcagttctgaatttttcttgcatcgcttaaaaaatttatgaatgtatacttacatttcacccctaggtataaggcccaccttccaacccggtcaaggtacagccaggctggtccttgacctctcctttcgtcctctttgtgtagcttgctgttcagcttgctcagtacttgcacgatgacttccttgactctgaccttcagcattagagttagcagggttcacttgagtgccatttgtagaaggcacactccttgagctagcaccattagcactacttgtattggaaagttggctagctgggcgcttctttgaagcaagagaccgatggcgaaggttgttcatgatctgcacatgcacatacagctaattaaataacttactagtataattaaatacataaactaaatgctattaagacaatattacatcagatatagcatatttcagtaacacaaagataccaacatccagcttatcttagtcaagtcttgtccacaacatataagaacacactgaccacaagttcacaacataagcaaggaaaaaaaatacaagacataaaacacaatcagaaatcttcaggatcataaatgatggcttcaggttcagcttcttcttcatcttcttcatcatcttcctcatcatccagctcttcatctccttgtgttggagagttacatttggcaagatagtccaaatctttctcattagttatctcatcagatatgtaagtggttgctatt

SEQ ID NO: 68994 - DNA, 30040 bp, Oryza sativa
ctgaactcatggtctctaggtagaaaacgcctatggcaatcaaaccaacatgctttgccaccattacggaggcgaaatgcttgggtatcacataagcatgttggacatccaaaaataccatgggtgctccatgcagcaaaattaccatatgcaggacaatcatgaacagaccacaaaaaggctgccctcatgttaaatctttccttgcgcgaagcatcccatgtttcaaccccctcccacaacttgaaaagattatcaactaatggttgcataagaatagatagcttctttcctggatgttcaggaccagatataactagtgaaaggaatatatattctggtttcaacagtactccagggggcaaatttagtggagaaacaaagactggccaacaagaataaggagcagcaccaatattgaaaggtgtgaaaccatcagttgaaatagcaagtcgcacatttcttgcatctctaccaaaggttggaaaatctatgtcaaattgttgccatgcttcaccatcacaagggtgcactagcttaccacatgtggactgtttatgtgattgcatagcctttgcggtctcctcatgtgcataaagcctttgcagcctatcagtgatgggaagataacgcaaaactttgcgtgggaccttattctgtccatcctcaaatcggggggtgttacaaaagtcacacttatctttatgctcattttctttgtagtataacatgcagttattatagcaaacatcaattttaatatatgtcatacctaggccctgcaatagtttcttagaatggtaaaaatcctctgccaacttagaatcaggtggaagaagttcatggatcagttgcaaagtatcatcataatgtgcgattgacatattgtactctgactttaaagctagcaaacgagcaatagcagataagctagtgtgcattgtgttgtcatggactgactcattagccccatccaccattctatagaaagcactagcagaagaagttggctcttcatcaattcctggtggttggacagcccctatatcaagtaacatctcatccatgcgatcaggttgatcaaacccctcctcatgggccaagggagacaatggttcattattcctaatatgttcttccccatgggctgtccatgtctcatagttttccttaaagccaaatttacacaagtgtgcctctataatatcccttgtatgtctcatgtagttgcgacacctaccacatggacatttaatacttccatcttgaactaaatcaggtatatagaaagcatggtctagaaacatattgttcttttcaatccactcatcagagggtgcagaaccataatgccaaccattatacatccaattacgttccgccattatgttattctgtctaaagcaatatcatttaactatcttagtatataaagtaggcttggttaacaattagatcacatccaaatggaacatcaaaaataacagtccaacttaaatggccacaagcatgcataagtatcttagctaggtaggtgaactagagcttaccagattttgttgaagctaccagaccagcacgtctgagagttaacacagctagcgcatcaacaggtcaacaaggatagttcaccaggcttcacagattggggcatccttgaaaagtattacatagatctggaccaatgcatatgtaaaattcagttttgctgatattaacaaaataacacactgtgttctacttttgtatagaagctacaactaaatatgcaaaataacttccaatctctcatgcatgtcagatttaacataaaaaatcaaaacatacagactgttttgcttactatgtggaggcaaacaatagcagaaacgacttcaacactgaaggaggacttctcttggacttcagtagggacgggcagcagctgcggaatggcggagtaagggccggctgtaggggtggcggtggaggtgttgaggctgacgggatggtgtaggggcggcgcgggccgatggacgggcggagcagaaacgagtaggggatgggcggtggggggatgagggggcggcgagttggggagggaggcggcggtgctaggccggtcgatgggcggagcaggggcgagtgggggaggggggaggcatggcgagtgggggagggagaggcgaaggcgggcgcacggtggggcgacggcggcggggccgcgctgctgagtagcgctacgcgcctgcgcgagagagaaaggagtcgatggcggcggtggatctggagttccggataagattggggattttactaggttacctcaattttttttgtgggccggaagcccaaaacctacagaaaaaatatttcggagggcgccaatattcccgcttactgaaattttggcgccatattttcctgttccctcgcgccacaaattatcgtgacggtaaaacgtcaaaaaaaaatacagttctctactgccaaggagggaatgcccatttttctgtgggccgtgtccaaaacctacagaaatattacatttttctgtgggtataagtaagcccttcacaataatttatatttctgtaggtttgtttcgaaacgcacaggaaaaataatgacctacagggtagctccaaagtgtggtagtgtttttgctatatgactccgtttcaataatttgaatttgaatttcaaattataacaacttcaaagaatattttcatatactaaatgatttcaactgaaaaagtcatcaacaacaagttatataaaccatcaatatctacaacttttgttttagtcattttgctatatgactctgttttataaatttgagtttgaatttcaaattatgacaatttcaaataacattttcaaatactaaatgacttttcaacatcaaagttgtataactcatcaatatctataacttttattttggtcatttcttcatccgataaagtgatagtaacattgtttacaaaatttacatatctcttatatggttttcaagtatttaaatcacgacgaaattgctataacgtcacaggttttgggccggtttatgacaaaatcgataaactgtcatggtattatgggccttgtatccatagttgcatatccgtgacgttctctgaaaacatcacgaaaatttcgtcaaatttcatcacagattaaatagattcttgtagtgcaattcaattttctttaccctagagaaaatgcctgtacgttgcaacgggtgaagtctattttaattttattattgttatatggtttagttaagatgaaatttaccgtgagagttcgcttggatatatatatttttagaaaattatgaactgcagttagaaatccgatcgtctcaagttaacatgcgcttatcgatcaatggcaagcagactacgccttatatccttttcgctccgatcttaacctagcttcatctcaccgaatcatcggaaggaatagtcaacttttgggtgcaagctaccgtattataatggtgcagataatacctttccctgtgatctgtagatttccactgaactgatttgacattttcttagcattctcaaaaaaatagcactattctaatattaaattttaatttggcgtttcgggctccacgccgctatttattgctcaccccattaaaatatactagttgcttctatcatccaaatcgatcttaaacaatcacaactatttttcatctcaataataatctatgcagaaaaggacgcaagtaatctagaaggagtatggctgaaaataggggtggacaaaaagcttgggctcgtaaactcggctcaggcttggctcgggctcgcatacctcggctcggctagaaagccaaacgagccagcccaagcctccaaacgagccagcccaagcctccttcctagctcgttttcgaaacgagcgagcccgagctggctcatgagccactcgtgagctcgcttggctaagtaacaatagggccatatgtaaaaattttacaccttttctaactatttatttgttgaaaatgataactttgattgttatattatctatttatgtgttgtgatgacgtattaaagaaaaatatcactttgttacacattctatgtggtaaaatgttgctcgatttctcttatacatgcttgagatttacttgatgccaggctcgaggctcgagcccataaacgagccgagccgagctgcagttttagctcgctgtagcgagccaagccaagccgagcttcccttacaccaagctttcacaaaccgagccaagcccggctcgtttccacccctagctggaaacttgaccaaaggacatggtagaaaaaataaatgctcggaactacccgggttccatctagatccgaaaaaatatatgttagaaataagagaattgttttatccgctaatatatactatattatcaatcatatgtaaaaatattccgaatatatctacctacaaacatggtagaaaaatggtttttaatttcaatatatccgcgtaggggagggtggccacgtgaccggatccacgccggggaggcccaccgccatcggatcgaggtggggcggcaccactgcagatgcccgaggttgctcccatcacctgagcccgccgtcgccgctcccgccgtgctcttgcgggatccgttgcaaagctccccgcaccggaacactattttatgagctcaattaatattgcagttttttttatgtatcttcttgaacactttaattgtgtccctagattcaatatctacagacaaatatatatctgttcctgaatctatttccgacgaaaaatatgggataggatatataggatgagttgtgtgttatccgtcgttatctatatacgtggttctgaatttgaagaaaaactatagaccaggatactagagtggcagaatgtaatgacatccgagcgtaccttagccgattccaccgctaggagggagtagtgaagtagatttccattatggaactatatatatataccttttggcatgtcctgatttatatctcacggttgttttaatttattttatttttttctaagtttttgcctcatagttctagtcgacttacattatctttaaatattactctttcacaatataaaaatacgatgaaatgttttagattaaggaatactctctctggttccttattaaacaggggtaatgctttagataagagttaagataccaattaatgatgataattaattagagtgactatttcctattgtatccatattaaatacatctgtgtgactagcttaattaatatgttttacatgcatgcatgtaaagggagtaaattagtccaaagtagccacaccaaaggtaaaacgtcagtttttatttgcatccaaacagttcaaatctctaacgtcaactaatatattaaaccggagggagtaatagatatgcattacctaaccagctgtactgcgtatatgtagtacttaatatggtataatgtatatatagaagtacacactcactactagaaaaagcatttttcttgacgtggggtctttctttcgcaggcggacataatctttagagacaaatgaccgcctacaaaaatataaatcgaggtgaagttcactatccgcctgcgaaaatggttttcaccggcggaccacctaagcggcgcctgcgaacatttattttcgcaggtcaccttatgtggtctgcctgcaaaaaatcgtacctacccaaaaaaaaaacattaatacttatctacacctccaacccctccccacaactcatttgcccaaacttatcttctcaactctccctctctccctccaccggcttctcagctctctctccccctcccttcccctctccccctccacgggcagcggcggaacgcgcggacccggcggcggcgacgtggttccccagcctcccctcccagatccggccggagggagggccgggggaggacggcggcggcggcggcaacatgggcggctcccctccagcggcggccctctcccggtgcggcggcggcggctccccggcctcccctcccagatccggccggagggaggccatgggagggcggcgacggctcccctctcctctcagatccggacggaggaggccagggagcgcggtggccgcgaggcgcgcgtgtggacgtcggcggctgcggcgaggcgatctttttaattggattttcgcagacgggctattgccccgactgtgaaaatggatgattttcgctgtcgttgatatacgggtggtcctcccctccgtctacaaaaattgcttttggtcgtatgcaaaaaatgctgatggtagtgacttaggctttccggccgttgaccgcgcgttacccacgggaacgaagctcagccctctataaatacgggcgccatgcattatgcatgcccaccaagacagcaagcagattaattactattagtacttaagctgctaattacgaagtactactagctagctagtaacgacctaattaagcagtaaatagcttagtcgtcgtgtacgtgtcaagaaacaaaaatatgacaatgctgatgacctcgtccagcagtaaggtgatgatgctgcttgctgctgcagcatttcttctcctcgctgccccggcttttgcttccgacgggcagacgcctgtgggttatgctgaggcgccgtttaccgccaatggaggtgagatctctatcgactaacatgcatgtactcttttgtttgatttcttcaattccaggcagatagaaagggacatgcatgcatgtttctcctatttcagattaatttataatgttataatgtattttatctactactccagtagctaaattatcatatcctaagatggacatattatatacacttgtttcctttcattcgttttctcaggtcagcaacagcaacaaattttaacaaaatattaaaaaatattatatctcgtactagattaatttattttcgaacgagataataccagcttaattggatgcttgcagcctttagctactcagaataatgtttgctatggtatcagcaataatgttttagtcattcagtcccgcaggtccgtccgtcgcgtctattgtcagaataagtgaattcaaaagtgtcatgtcttgtatggtgtgcttttgtattggttatcctatcttaaaaccttaaataacatgttgcattggatgaatgaattcttttattcaaattctacttactactcagtactctctccgtctatcccaaaatactataagagattttgatatgacgtgacacatccaacaaatctagacatacttatgttaaaatttgctataataggatatgtcgcatcctactaaaattccttatatttagggacggagggagtacttctgtttcgaagtgagttcatttttatattaaccagcgtcataaaaaaagtatgtacatatattatcgtttagtttactaaacgttactacctctgtttcaaagtgagttcacttttacaataaccaacatcgtaaaaaaaacaaagtatgtatatatattatcctttatttactaaactttccagtctacatatatatgatgactttacatataatacaaagcgcaaaacacattttatatgtgacaatgacatgagcaaaatatagactagtgtgcaacattgcacatatatctataactaatataaagaatcgtatttttccgttcgtcaccccccaaatcccagtcggtactccatcacccccactcaaaaaaaattcccaatcgaaattcaatcacacaaataaaattagaggaagcattatacacacaaatatatcaaaaaaaaaaagatcgaaggggaggtcgtcgtcgaaccgccgccgctgccgccgccagcgcagggacgccaggccgccgcagcacccctcccgctggatccggcagaggggaggggcgccgccgccgccacctcccctcccgctagatccggcggattgaaaggcatcggtgcccctgtccgccgtgtcccctcccgccggaagggagggcgccgccgctcgcctcgctcgagcactcccggggccccatggcgaggaagaggaggtcggctgctgctccacgccgctgcccgtcgccgctcaaggggagggggaggggggctcgccagtcgctgctccgtgtcgcctcagccactcggggggcgccgctcgccggtcgccactccatgccgccgcagctgctcggggggagggggaggggggtgccactcgccggtcgctgttccgcgccgccgccgccgcatccgtcgctcggggagattgggggcggggagggagggggagaatgaatcctagggttagggttagggttagggttagggttagggtttgggtttgggtgtatttatttaggttaggattaatttggaccgtccatttgatcggacggttccagttgctcccgcgtcgggccaccggcctattgggccaccaaatagaggacgcaaaatggacttcaacggagaaaggaaataggccagacacattgaatagataaaagggaggtaacataaacttttctatattcgacccaaacctagaaaggaggattttgattctttttccaattaaataattgttaaatgatgtttgtattattaaaaattggcaattaagctctgataattctaataaaatttcaaagagcgtaactaatcgtggagaatttaataaaattaaatttaaccatgtcattttatttctcacacttgctttacttgtaaattgatttaattattcacctacctacttaaaaataccaaatgttttagtaaatttctattttaattaattacataatgtaaatatttcttaactttttctcaattttctggtatgtacacttcccgttgcaacgcacgggcacttttgctagtacaaatatgaaaagaacaaagacctgcttggaaacataagcccttagttgatctgtaaagtgtaaaataccgatgtcggctttctctccatgtatgttatggagatgttgctatctccagaggagtctgttgacataaaatacatcgtgacgcacgaaggcttgagagattttgttggctctagtgcaagtcttatcaattgggtttgaggcatgccagttagtttgatcatgcaactaataaggtagaaacatataatagttaaatactggggccaatcgatcataaggtcggtacaatatcgtatgcccggccgatgccgatagtgttttagatcaacggctataaccgatgacatcggccgaaacttagatataatataattgtaaatagtctatctttattaaaaccaatcttgatagatcagatctaactgagatattataagattgagggtaggtaataaaagtagaaatcaggcaattatataatctccgatgaaacaatgaatgatatcaattgatttgagaaaattcacctagcaagttacaaccttgttaacaccaaaatttggtaagcaccgaagtcatcatcggcttagagtcactatcaacttcagcgtcttggaatcggccgatgggaattatcaagtcgacaatggtcggattcttagtagattcggttaaagaagttaatcaataaagaaaatttatacagaagaaaccgagttcaaagaggatgcggtactacaatttatcttttaattaggatgagtctgttaatttccttttatatttagaaaagtgtgtttagcgtccgataaggactagtatccacccctataggtataaatatatacatcggggtcattgtaaaatatcactcaatcaatacaactactctcggcgcatcgctaacctcttttccgaggtttttaacttatcaccgacggaacttggcacctgacacggggctgcattgacttcgacttccagtgaagggataagtcctacgttccgccggccctgacaattgtatcggctacatgtgttgttcaaggctgcatcgcttcgttctcttggattgctctgatttatttgatatacttgtctacctatttatcatatatcttagttaatctaagtcgattattcaatttacgtgtatcggtcaaatcttttctaggattttgctagtatcggctaaattgttttgtcgatctagattagctaaggtatccataaccctgaaaatcagtcaaatgcttgattgtagatattatgtttcttttcatacttagtactgcatcaattgggtttgacctactaagttgtacttggaaccataatctctagcctgcttctggattgccaataagggtttcatcggagtttcagtctatgagttatctagtcgttgtatcggcttatatggattacatacaagttggatttagtcgatcacaataaaggtttcactgattatttaatcgtttgaatttaatgtcatcagatctccaggtgatgtatgcattaaccttcggatcaacgcttattccattatactccctccatccacaaaagttacacctattacttttgtcactaagaccgaggagaaattaaattatcttagatgttacaaaataataaaggagtaaatgcaagcatgtcacgcccggaatttctatccaaaattccaaacgcttacatgtgtgttaaaccctcgtccaggaatcaaccgaggcacacaataacaaaattgataatagaatacaaataattaactatttaatattcgcaaataataaattgctacagaggtagatagttcctctcaaaaaaaataaccttctacgcagcggaaaaaaaaaactataacaaactacggaacagctatggcgactccactccacaggcatcttaaccagaacaagctcaatccttcagatcatcacctttgctgaaatactcctcttctgatgattgaatattgcaagaatgagcatatgacatactcaacaagccacacagcaaatatgcaagtgcacaggataacaaaggacggcataatagggtttcatttgcaaaaacagcatttagcaaatatttgagaatttaataaaacaattaagtaataaacaatattaatccaacgctatacaacataccctgttatataggcccaaccattcagaacaaccatcccggctgcacagttctatctccaaaccaggaatataccattccaaaccaggagctaatcaaattattaccaattaaagcatcatttactatggtgagaagggtgagactaatcacgaaaaacattgctcaactcacccataaccgcgggtacggctattcgaatagattaaactctgatcagaggcgtaccactgtacccacaagacacaaccccacatcatgtcaccctgtgcctcaataccaccacggtacctcggaaaggagttgtgacaataccccttgcacaacataatccattacagcgcacctttcctggatcataatcgcccccttataaacaaggcatggactccccagcgacccccgtggacttctcgccacttcacagtctggcgcactataatgaatcatgctatataaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaataataaagtaacatagtttataattaatccctttagttagctaatgtttctaagcatggctaagcaaacttacatatgacatttagctgaaccaatccaacatataaggttcatgctaatcaaatttataaccccataggaaaataagatcatcttcggccattaattaattgggaaaggttcaccacccgatgacattcgaaaacaatgcatagttgaaataaaataatagctttaaacgggttcaacatgctcaaatgtttgtttgggatctgtgtgacttgccttgggcttccgcaaacgcttcggaatcttcctcaacggaaacgctctcctccggaacgtcggaaactaaagcaattaaacaaaaattaacaaaacagtacaaaaacaagcataaacagtacatgtggatatttttaacatgtagatcttgattttagaaaaaaatttaacaacttgaaccacctgaaacggatctacggtactcaccaatgcgtccaacgacgaccgatggtggccggcgactagaggaggcggcgcggtggttcggttgaccggcggcgacggggctccggtgatcggcggcgtcggcggtggtgcggccgggcttcctcaccccttggcgaacccaacggcggcgacggcaagcggcggcgacggcgcaaacggcgcggcggcgcggctggactacgaccggcggcggggcggcttgacacgcgcggcggcggcgctacggagcacgggagaggatgggagagagggcaaacgaaagaggaggactagggggtcctatttatagccttggattgaagagatcggactcctcccgcaagaaatcgactcgggaaaacaaaaactcggttttagagataaactcgaaaacgagttcgattcggacaagatactcaacgattagctccgatttttgggggtaaagatagaggagaacgagaggataaaaactcctcaaacaatcggaagaaaaagggccggattaggtgcggatttggaggggaaaaggggcggctcgggctagcaaggccggccggccggaggtaggagaagggcccgacatgtgggccccacatgtcggtgtcccatgagaggaggggcgggcggctcggcttgagccgactcgggcggccttgggccggctccggcgcgcggaagagagaggactgttgggccgaattgggcccaaccgcttagggaggggtttttgaactttttaattaactagcaaaagtgcccgtgcgttgcaccgggtgattacagagtgtgtatattgaccaaaagtgttgtttggtttagcaaaagtgtccgtgcgttgcaccgggaagtttacagatcagaaaaatatgcaattaattaaaatacaaattcgctgaaatatttggtatttttaagtaggtatatgtgtataattaaataaatttacaagtaaaattctccattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatactttcttataggtttgcttcgaaataaacatattcaatagaactataattgtaatgcttctgaaaaaatgagcactaaaaatgtacttattctctttttttcggctcgagggaccaacaatagacttatttccgacctatgccggtcggcccacggccttttgcgcatgcgcgggcgcacttttcctcccccaggccgcaacctgggcttgggccggaaaagaggcctcactctcgatccctcttgggccgatttcggcccggacgacaccggccgtccgatctctagggttttgatcggacggccgagcgtcaatagtggagaaacaaaacccactccctcttagccgcggaaccctagcccatttcccttcctcctatctcacttcgccgccctctcctccacgcccccgagcggcggcggcgacgacggcgcccctcccccaccaccgatggcggcggcggcggcacccccaccacccacggcggcgtcggcggcatcctcccccaccaccggcggtggatctagcgggaggggaggcgccccgcgagcggcggcggcggtggagtcctcccccaccaccgacggtggcggcggcgctctcccccaccaccggagagtgccctctgccgccgccgccggcggatctagcgggaggggaggcggcggcggcggtgctctcccctccaccggatccacagcgacggcgacggcggcggttcggcaacgacggcgacggcgacggcggcagcggcggcgacccccttcgatctaattttttgtttttatttggatatatgtgtgctggcggcgacccccttcgatctaattttttgtttttttgcaaagtgctataaggctgcatgtgattctttgttatgtgctatgattttttatactatgtatgtatatatatgcacttgttctcctggtgatgctaaccgaataggacttggtataattcaaaccaagtcctattcgcccaaacagaaacaaaatcctaatcagctcaaacgaaaacagatgggagtttgtttcctatttttgtggaatcggacatattcttttaccgcgttgatgaatcggattcgttccggttttttttcacccggttttttttgacggacgatggaagcacctcttattttttaagtagtagtagaaataatttgtgaaatgttgtttcaattattaaaaatacttcccttgctcaaataattcccagaaaattctagaaaatagaggaacaagcaaagtacttaataaaattttatctagctcatttttatgttgaaaattttcctagattattagggtttagcttgtaggcttttaattttaattctaataaatgatttaaacaatgcatttttaatttaggcgatttttagggcgtgacaaacctaccccccttaaacggaatctcgtcctcgagattcggaagaactggcgaagagatgaagatgagctgacttcaattcatcttctcgctcccaagtggcttcttcttctgaatgattactccactgaaccttgcagaatcgtataacgcgattcctggtattcctctcgcttacttccaagattctgactggcttctccacataagttaaatcttcctgaagctctatacgatcaggatctgcttcctccgtaggtacacgtaaacatttcttcaactgcgacacatggaacacgtcatgtattcccgccattgacggaggcaactctagctgataagctacttcacctcttcgactcacaatcttaaaaggtcccacgaaacgcggcgccaatttccctttggtctggaaacgatgaacacctcgtaatggcgtaacccgaaggtatacataatctccttcttcgaaagccaaatctctgcgacgattgtcggcatagctcttctgacgtgactgagcaacgcgcaacctttcttggataatcttcactttttcttctgcctcgcgcaatatgtctgtcccaaaaacttgacgttcaccggtttgatcccaaaggagcggcgtacggcactttcggccatataatgcttcatacggagccatttgcaaactagcttgataactgttgttatatgagaattccgcgtacggcaaattcttatcccaacttccaccaaaatctagaacacaggctctcaacatatcttctaaaatttggtttactctttccgtctgaccatctgtttgagggtgataagcggtactgaaattcaaacgggtacccatctctacttgtaatttctgccaaaacttcgaagtaaactggctacctctatctgacactatcttcttaggaacaccatgcaaacataccactctggccatgtataactctgcaagcttattccccgtataggttgttttgaccggtatgaagtgagcgacttttgtcaacctatcaaccactacccaaatagaatcatgtcccgccgacgttctgggtagaccggttataaaatccattcctatttcttcccacttccactctggaatcttcaacggttgtaacagactggctggcttctgatgttctgccttgacccgctgacatacatcacatagagccacatattctgctatttcacgtcgcatactggcccaccagaattgttgctttaggtcttggtacatcttagtgcttccagggtgaatggaatacaaagtttcatgagcttctttcatgatagtatccttcaactccttattttctgggacgcaaattctttctcctaaccacacagttccttgctcatcttctacataaccgatggcttttcctcttctcatgttcttttttatttcttggatatcaagatcattcacttgagcttctctaacttgatcaaacagagtaggttgagcctgtaaagtagccacaaaacctttgctgactatatccaagtttaacttttcaaattcttggcataactcccaaggtaaatgtcgaccttctgacatattacagtagctcttcctgctaagagcatcggctacaacatttgctttccccgggtgatagtggatttccatatcataatctttaatcaactctaaccatcttcgctgacgcatgttcaaatcaggttgagtgaaaatgtacttcaaacttttatgatccgtatacatctctctacggttaccgaaaagataatgacgccaaatcttcaatgcatgcaccacagctgccaattctaggtcatgcgttgggtagttattctcatgaggacgtaattgcctagatgcataggcaaccacctttccttcttgcatcaacacacaacccaaaccgagtcgggatgcatcacaatacacttggaaacctttcctcgaatcaggcaaaattaacacaggcgcagtcactagccttttcttcagttcttggaaactttgttcacaatcctctgtccacttgtacttcacttccttctgaagcagacgagtcattggtctggcgatctttgaaaagttctcaataaacctgcggtaataccccgcaagtccaaggaaactacgaatttctgaaaccgtcttgggttgcttccaacttaacactgactccacattgcttggatctactgccactcctctagacgagatgacatgaccaagaaacttcacttcggacaaccaaaattcacatttactgaacttggcataaagctgatgctcacgtagtttctctaaagctagacgaagatgctcttcatgttcttccttcgtcttggagtaaataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcaccttctagttgatcaaacaggtcatcaattctgggtagaggatacttattcttgatagtaacctcattcaacgctcgataatccacgcacattctctgagtatgatctttcttctccacaaagatgactggtgctccccacggcgaagtactgggtctgatgtatcctttctgaagcaaatcatccacctgtctcttcacctcagctaactcattagctgccattctgtatggtctcttatggatagggttggttccaggtaccaagtctatccgaaactctatgtctctcttaggtggcatacctggcaaatcctcgggaaacacgtctgggtagtcttgtactatggggatctcttgtaaagcaacttggtttaagatcacaccatgatatttaggagaggacacaaagaaagaaacggtttccccattgctactgcttaaagtcaccttacggttggcacaatctataactcctctgtgacgagataaccagtccatccctaagataacatctagatctttggattctagcaagataagcgaggatgggaaaggaacttcttctatttctatagtaacggaaggacaatactgtgtcgaaaatacttgattgcctggggtattaactagtaaaggtctcccaagactaataacttccatcccattattgctcgcaaaacttttagacaaaaaggaatgtgtagcaccggaatcaaaaagcacagatgcgggtatagagttaacaggaaacgtacccaaaaccacatctggtgcattctgagcttctgctgctgcaacatgattaacacgtgccttcggtgctggagcattggagttgttcggggctggaacgttcttcacgcaccgaggcttaggacacttatcagcataatgtcctggatcaccacaattgaagcacacccctggcttgcttccctgttccttcctgacggactggttctgagctggagttgctgcaggacgagcaaccatgttgcggttgtcattgccacgattaccagtattgttgttgtagaactggcgttgggggcggacaactgatgaagatcctccttgagggtacgatggagcttgaggtcccgtaacgagacgcggcctctggttactgccctgttgtgccttgaattgcgcagccctgcgcttcttctgctccatccggttatacttgtcttcctgacgaatcgccttgtccaccaactgctggaaatcccggaaatccgtagacatcaaggcataagacaactcatcattcagtccctccaagaacttctcctgacgctcttcatcggtaagaacatcttccggagcataacgagctaaacggttgaaatcatggaggtactcggtgaccgaacgagatccctggttgagtgctctaaattctctcttctttagagctacaacacccgttggtatgtgtgtcttcttaaaagcggccgtgaattcctgccacgtaataggctctccttcagccctgccttggcgaaaatgatcccaccattcagcagcaggaccatgcaattgatgcgaagcaaaagaaactttctcctgctcagtacactggatcaaatccaacttcttctccaccggatgcagccaatctcctgcttctactggattggtggtgcttgaaaaggtagggggtctcacacgtaagaaatctgccagcttgttttagggaggtgggggtggattctggttctgattgtttgcctgctgcactaacagattgatcagttgtgtttgttgggccagaatctgagctagcgtgggatctcctccattattagcagctccgcttccacttccacttccacttccggtgcgcgtgttcaccatctgacgataagcagagacaacaggaaagaacgacagagagacacccttagaacggagttatttaattaatttaaattctatattgctcttaactgtgtatgattacatttaaattgcattaacactatctcaccaactatcttacactctgacaagcaaaagaactagactcatgctgttacatcccaccaatgatgtaagcaacaactaaacccacacactcacaagcaaacttaaacaagcaatctaacacagcgaactacggcaacgatctaactaagcgactaatcccgccttgcgtcggaacgaagcgacggatcttcttcctctggagtagctggctctctttcttcagggtcttcctcttcttcctcatcacttatgatgtcgatgacaggttcagcacgattgggcacagcttcacccatcacacgaatcttcgaagctaactggagacgaggtggcggacaggttctctttcttgcgatgaggcgaagcttgggtgttggcggcggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccgcatgcatcagagcggcactctcttcaccatcaggacaggtataggttccatagtcttgaccatgaggcttgtgaggatgatactggaaagctgatgaatccaactcttcttcaaagcgttgacgcaactctccaatggccaccaaagctgcttcttgacaagcatggctgtacgatcttcctccagcttcgaacttaatggacggaaggtcttcacgatcactagccaacgtcacacgaacatgacacttctcctcgttggggtcatgggaaatccggcgatactcaggagcaacttcatagcctacctcaaaagccatcaacctcaactccctgacgaatcctaacacctagatcaaatttctcggtgaatggggcggcatctaaagaaacatagaagagaggaattaatgcatatatttttttttaagttagctgcaccatctagacttaactgatttgaccaaagaggaagaaaattaaaagaaaagacacatactaagctattatatatatatatttttagaatttaactttttggacagagacaaataatttaatttttttttgacaaataactaaaataaaactaaaatacttatgatctattataagcacggtacagtgtcaccataagaaagatgagtagtacttgtgctaccatgattgtatcgataccataatagatgtacagtgccgactaatcaatgaagtttactaaggcggaataagaaacattttgagaagaacaaattttttttttaaaaaaaagaaaatgaattaaattgattttgtgcataaccttgcatgtgctgccaacttaattaatttataagagaatagagaagagcagttctatttttgtcaaaatattttgaaggctacttaaggtttaccatttggcttatcctaaggtcagggtggctctgataccaacttgtcacgcccggaatttctatccaaaattccaaacgcttacatgtgtgttaaaccctcgtccaggaatcaaccgaggcacacaataacaaaattgataatagagtacaaataattaactatttaatattcgcaaataataaattgctacagaggtagatagtttctccggcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaagattattgcgtcagcgggctagggtttcggtggaccgggcgcacgggcggcggttcacgcgaacggacggccgagatcgatccaatccaaaacggacggctgagatcgaacggtccacgaccggctcacggcggacgaccccgatgacgtcggcaatgacgtcaccgacagcggcggcggctcggcagagcggacggctcgggcggcgcacgctcgccggcgaacggcggcactaggacgcaaacggaggccaccagcacgtagaggacgacgcggcgaacacaccggtgaccaaaacggcggcggaagaacaacggacgacgacggcgacgaggaggaaacggcggaaaccttcgggttgatgacggcgacgaagctctggcggtcttcggcggcggcgaaggggcggacgaggacggcgacgacttggcgaccacgacggcggtcttcccgagcgacggcgacgaccgagacggcggcggcgcacggctggagcgacggcggcaacggcggcgctagggcacacggcgctagagcgattccgacgacgagaggcgaaggcaagggtggcggcgggtagaggagacaccggggatccttttaaaggggctcggaggcggcggcaaaggcccacggcggccggtgacgaggaaggaaagatcgggaagaacgaatccgagacaaactcgaatccaacgctttcaaaaacgatttagccaaagattccaaaggagaaaaggtagaggagatcccgaggatcatttcccctctatcaattcggccggaaacggaaaggagcggccggattggaaagcggcggcggcggcggcgcgctagggtttcggccggaggaagacgacgggcctgacaggtcagcgagggcgcgcgcgcgggcggcggactgggccggctgggccgaggagagagaagagaggttttgggccgactttcggcccaaagccaaaagaagacttttaaaactttttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttttaggcttttaaaatcatttctaataattccttttaaacaacaatttataatttaaggattcttaaacaagaaaagctcttaataattataattagatcattattgatcaaataattactgaactgttctttgtatcatttaggaattgagctccgaaaaatctgagaaaatttcagagagttgacttaatcatggagaatttaataaaaattaaatccatccatgctttatatttaggaaattttatttcccacatttaacttcacttgtaaattaaagaacatttaatataaattctattattaatttattaaataatttataaatcctgaaacgaaaatcaggatgtgacaaaattgactcgggaaaacaaaaactcggttttagagataaactcgaaaacgagttcgattcggacaagatactcaacgattagctccgatttttgggggtaaagatagaggagaacgagaggataaaaactcctcaaacaatcggaagaaaaagggccagattaggtgcggatttggaggggaaaaggggcggctcgggctagcaaggccggccggccggaggtaggagaagggcccgacatgtgggccccacatgtcggtgtcccatgagaggaggggcgggcggctcggcttgagccgactcgggcggccttgggccggctccggcgcatggaagagagaggaatgttgggccgaattcggcccaacggcttagggaggggtttttgaactttttaattaaaataatttgtgaaatgttgtttcaattattaaaaatacttcccttgctcaaataattcccagaaaattctagaaaatagaggaacaagcaaagtacttaataaaattttatctagctcatttttatgttgaaaattttcctagattattagggtttagcttgtaggcttttaattttaattctaataaatgatttaaacaatgcatttttaatttaggcgatttttagggcgtgacaaagcatgcaaccaatgagtatttagatgactccttgggttataatcaaacatttaatttatctcttcatttaagtcttgaatacataaagactacaaataggaacaacttatttggaaaaactcaaatgtgaaatatgtttaacttttgtgaatggagggagtatcattattagccgattggtttctactggattatacttcctccgtttcatattagaagactttctatcattgcctatattcatatatatatatatatatatatatatatatatatatgtgtgtgtgtgtgtgtgtgtgtgtgtgtacggtggcgctacccagcgccacacacaggcactggcgccacggaacaaaatggcgccacacacaacgagcagatgtcatcccaccaaatctatccaaggtactagggagttaaaatttaactggtggaaattgtggcgcaaacgaaaagactgcccactaaaccaaaccaacggactgtggagttaaaaaataacttgcggaaaacatggcgcaatgtgaagcaacgaaccctctcctaccggaccaaacaaaaccgaatgtgaagttgaattttaactaataatatgttgggtgatgcgctgcggtgatttcgttgttgagttaaaattttacctatgttccggctgtatgaatgagccgtcattaacttaaaattataggttggtggttatgtagttaaaaatttactggtagattcttttttttatggatgtgtgttgtttctgatgacaaggaatatgatttaaattttaacttatcgtaaactggtacgagtagatgaaaaactttgagacattaggcagtgatggtgatgtgtgacgtaattcacactttattattagagttttattgttttgatgcacatctccccggaaattacatcgatggaaattaactgatgattaattcaccggatagaaatcaacaccatgtcgccggatccgccagtccagaaactacgaaatcatagcgtgcattgatttggcgttaattcaataagctgttagaggaggccccggaataggcggaattttttttcatgcgatacatcctgttgtggtggataatgaacagagtccttgatccgaaaataatgcttgtacacctaaatttagttttctctccatagggaatggaatttctgtttcttttaggtatggtcagattcaactatcgtacatcatttagttacttttactgacaaattacaaatagtaaatattttactctaaacattacatatagtacttttttaattgtcaatatactgatatgtagattgcaatttttttgcaagatgtctggatgcatctaatcatataggaatcacatgtattagaaactaatcacacacaaataatgcaataacacatcggtgagatcaaataacaggacaacgtccaaccaaaatcaggaaaaataattgattgatggtgttgttgatcctggcagctttcttctccttctggatccgtcaaatggaaaaaaggtggctctcgctggtttcctgattgagaacggaaacaatgggctgtggccactccttctaccggtgaagaagatgaaaatggaaaactcggagagaggcatgctcggtgccgccgtctccatggatgcccgctgctccatggatgccggagaagctcaccgccgtgaaggttgccgccatcttgcctcctgcccatagtcttcacccatgcaggatccacgcgggaggaagggggcgccggatccggcgcgtcaaccgcgctggatccgcgccgccgtagctgcatccgtgcacatggggcgcagagcggcagccggatccaccgccgcatcgcctcctggccacagtcacccgtcgataccgcacatgccaccatcgcgcccgtccacgcacctcagcgccaccggatccgccgctcctccttgacgccggtcctcctcatccccgaactgccaccgctcctcctcgtcgccaagccatcaccggaactgcctcgccaccactcctcatcccctaatcgccatcgccgttcctcctctctgcacaagaaaccacaagtcgtcattgatccgtaaaatgtggagaggaagaggaaagagtgggtagacgatttctaagatgggaatctgtaatatatataccagatagagtcagtatgtcgacttaaaatttaactgtgtggtatgcatcagatcgagtatgcgtgggggtgggtagctgagctaaaatttaactgtgtggtatgcactagatcgagtgcgtgtggggaagggttgggttgtgggtcgctgagttaaaatttaacttgcgcgtgggggtgggtggttgagttaacagtttgtagcttgcaccaaatcaagttcacgtgggggtggcggggtggtaggtcgctgagttaaaaattaactgcgtggtctgcgtggggcaagggggttgattgtgtcaggcgccatctaatacgtggcgcctgtaataccatatatatatatatatatatatggtgcattagataccatggtgcccgggcaccatggtgccccatatatatatatatatatatatatatatatatatatatatatatatatatatatatatatggctctagagcaatcgtgttccatcatgttcactgatcaccatcagatgtacctactggtggagttgctatataggcacgatatatagtaggtaccatcagatgtacactccaattgctagtgtggctattgatgtcagtggatatattcatgacgttggaggagagagatttggcctttgagtttttttctcctgacaagaagtaaattccggctttgacctttcatttgttcactgttgtgctgattttcttcagcaaactaacctgccactacagtcgatactctaatttgtgctgattttctattcttttacactaactttgcacgtatttaatcatgtgtattttttatttttttatatatatggacgtatccacacgtatccttgtttcttcgaaaataatatatccacgtatagcgtatatgtactcgtatccccgtatctaggtaatctatgtagagagtggttaactgattctttttaattagattcattggcagcattcaaattactccacgtgattagatattaaacatgttgattttaatgagttaatataaacagcttgtttagtatttccaaaatttaatctaataagtttggttttattgggatataatatatcaagatggttctccactcaccatgcaaaaacaatattggcaaaaaaatggaatttcaaaaatgtcatttcgcaaaactgatgtccaaaaatgatatatcacttgacatatatttaaataaaaaaacacatgactgttatttttttcatatatatgatacattctaaaatataatcttgttataatctacagagaaaataatgtagactacagtttgttgacaattaaatatcatgttgcaaaattgacatccaaaaatggcattgtaaaaatgatatatcactagccatatattaaataaaaacacatgattgttattttacatatttatgctacattcgaaaatataattttattataatctatggagaaaataatgttcactatagtttgttgatgcgaaaaatgtaacacaatgaaaatatcattttgcaaatagatgtaaaaaaatggcgttgcaaaatgatactccctccattccataatgtaacgaacaactattttttaaaattgtttcataatataaggcgtgcatgcatgtatgcatgtcattaactagctcatctttttcactaaaatcttattatttaaattctacacaatcaacatctctaattttattgggtacatgtattatatttattagggtaatctaaactataaggtgataataattatttgttggtctttaaattaaattaagagtggtttttatattttgaaatagagggagtagtattttccgaaatggacatgtatggtacgtacattccatacatggatacaagaaaagagaaaagaaagaatatttaaatgggagaataaatactacacgatgaggtcaacttcctctcacctaccatctctctcattactcaggaagtgcatgctccatgtcagagagttacacatgcatcctaccaccctaatcttattaactctcaatttgtgaaagtatggtacattttgaaagcacgcatcttggaatagttgaacggatgtgattctgggtgcaggtgaaccgtggttctattttgattttccatatatatatatatatatatatgtatatatatatatatatgtatatgtatatatatatgtatatatatatatatatgtatatgtatatatatatatatatgtatatgtatatgtatatatatatatatatatatgtatatgtatatatatatatatgtatatgtatatatatatatgtatgtatatgtatatatatatgtatgtatatatatatacatatatgcatatatatatatacatatatgcatatacatacatatgtatacatacatacatacatacatatatacatatatacatatatacatacatatatacatatatacatatatacatacatatatacatatatacatatatacatacatatatacatatatacatatatatatatatatacatacatatatatggtatatgtatgcgtgcgcgcgctttgattcattagcatctatatgaatgtgagcaatactagaaagtcttataatctaaaacagaggtagtaatgttattttattatattatcatcaactgattgcctttatattattatttattcaagtattataatatacattggatatatagccgattgttgaaaaccctatcgacatcagcgggtatcgttccatcggcttgcagccgatcggctctttgatcttcaatgctaggcggatctccaagctactgtgttcgtcgatttaggtcgctccaacacagatctagtaccatcggtagagcgcggattttcgctccaacacagatttggcacgcccagtgggacacgagttttataccatatctctaaagaaaaagtcaatgccaaaaaagattaagaagactcaacttcccatgtcagtggttgaaacacttcaatataaagttgatgaaacagttcatcatggcttcttcaatcaatttggaattctggtgaataaattgtaaaatttaaacaagagaacacttgatgagttaattgtttgaggccagctagtgggcagattgaagaacaatagcaatatcggcttaggggacaggcacatcactatcagcatgataagtcaaattgttccttaaatattatatggtagatctaaagatgcagcatgtcccttaattatattgtactttctccgtgccaaaatatagcaacctatcagcatgataagccatggggtattcaggtgtccacatacattaattggaagggtcacatccccttgctatattttgggatggagggaggctgaatcctgctgatgacgacccggactagacgtcatcaggagataggacccgacgtgggctgacgtgggctgccactgctcggcatgctttccccggggacacgccacagttattatggacaaaaaaataaacagcaactattaggaaaaaacagattgtctcacgtgatggtaaaaaaagtaaacatcagctattagggtacccgcaatggttatctatagactctctataagagatccatatcagcatattttcctacttaaaagagattaaatgcaaaacgagagcaaaattatctactaacctgaagatagtttatagagaaacgaggcaatagcttagagagctataggtacccatatagacatactattgaggtggtttactattaatctagtctattattgagatgtacatgttttatagagagcactttactttaccattgcgggtgctcttagcaaggttgtctcaagagacattgcttgctactccctccatctacttatgatagtcatatttccaaatctgaataatttatttttgatagacatatttcaattcaacaacctatcatcttaatgactttttcggatttaatacgtgactctccattcttccgcacaagattggctacatgaacatcgagaaatgtaaatattaatgaatcgcttgagtatgaatgaccagtagcatgtttaaatggatgataagtaaaattatttattgatatatgtgtcaaaataaaatataactattaaaagtagatggatgaagtattaattactaaaggagtaatggtgacgagatactctcaagtggtaaataaggaatggagcgtctctagaagctgattcttaaattatgtggttgtctattaattacaaacatgtagtctttgtgtcaggtaaattttaaatctcgatagtgtttgttccaggcctgcggaactgcacgttttgttcgagcaaggaagcacacaaatatttgatccaacttttccgggtacgtttcgtgttgcaccactccttccatttaatattatttgacgtttcgaaatcaattttcaaacctatagccaaataaatttcaa

SEQ ID NO: 68995 - DNA, 21122 bp, Oryza sativa
ttcctgcagcccagaacatgtaacaatatcacatactagattaaatctgggagggaggtgggtagtaaaataaatatgaacaattctctcttcaaatttattattatttgaattgattatattaggatgtataatattgttgtctagattgatttactagtccctaaccctaaaccctagaattttatgatgttcagattcataatactagaaaatgtctcatccgattttaaattctaatatattaggacagaggaagtatttttgaacagactcaatctattttcgaagagacgaagtagtacgatggctcccacgtcataactatactgtactatattaactgctgtctagtttgcacgtgaaacatgagcagctagattcgcgagagaatggttaattacctcccgatccgatctaagcctggctaggtcaatgtgtatcagtttccaaataaaggtttatccgattcgaaggaataaaaactttttgaagaggttagagtggatgcaaacattttgaacacgatttcgtagtacatatgcactctataatcctaactatttgcatatgcgatttcgtgcataccattgccatgtatatttcttttttatataactaatatttttaaactgtatattatttcagtaaatttcgggcatatttactttgctaccattttcaaccttaacaagttttggtattgccaaattttggtaaggttatcaaaattttagcaaggttgtcaaattttggcaagatttcatatgtatttactaaaatttagcaacaaactaaatatagccaaaattttagcaattttaccaaaaatggtatggttgaaaatgacatcaaagtgaaccggcctttcataaacccccaaattatataaaaccagagggattttaacacatggcatataaacctagatattatatatagttctaaagtgttacaaaaccaaattgttaactaattttacatactactatatcaaaaatcttaaaaacctttacatgcatgcatgaaacatttatacgatgaataaaaacttataaatttgagatgtgattgtagacattaaaagtatggcagataaaactaaaaactctaacattgtagttattttaaataacgtggagaattaataccatctttacttttaatacaataatgaagagttactttgtttttagtagtgcagttaatactaatcccatcttactataaagttgatgtccactaactactaaggccatccccaaccctctatgtcatctagtgtccagagcatttaatacattgccacataagtaaaaatgtgatatggtaagagagtcaatgaggagagagataaaaagttgaagaaaccacaagatgataggtggataaaaggagagagaatatagatgattggataagaatttaatttgaagataccatctattggatagatagtttttatgcatagtgtctatatgacatggcaagtatgatgactactaaatgatttctgggttggggatggcctaaaacttaacatgcaaccataccataacaccacccactaacaataattacatatttaacttcatgcaatcatacaaatcgtctatgatttatttaattctacaaaatcaacatgcaagtatatctaattatcaccgatcacatcattttcacaagattttaccaaatctatctatcattttataatatttaacatatacttatcaatatgttacccattaaataacgggtattatttgtttgtttcatgataagtaccgataaaccctcacattttatcattttcttttcttcttactcctagctcgattgttgaaaaatatatattgaaaattgcttattaattcttgtagcaaagcgtgaggaatcacctagtgctataaaatgttactttcctagcactgtagttacttctaacaacttgatttttttttagatttactttcatgcttatatttttgttgttaattttatatttacttccctgtagcaatatagttacttatagtggtgaagagttacttctaatctagtgaaaagttactcctacttttggtaagatttacttcccttcagcaatacagttatatataatatcttgaagagtaatttctctattctttcagttactttcctgcagtagtattgttacttctaatatcacgaatagttacttccctctagcagcatagttacttataataccgtgaagagttataaaattacttttttcataaaaaataatacaaatattaattcaaataaataaaacgcatgtatgtatcttcgctgcgtttgacatgtgaattataattcacatagtattttttttaagaaacacagtgcaaaaatagatgctcattacacccacacactcacccctataaacgcatacatgcacaccctaaccttatgagcacgtaaaaacacacaggtgcacactcaacgccctatgatgcagacgtgcaaggggatacaaagatggtttgtggctttttgcataaaggcatattaaaacattttattaagcaaaatagtaaaactgttgtgtaattaaggtaatattaaatctccactgatcaacgctacaccacgttgaacaggcccaaccatcccacctgaactaagtgcattgagtcgatttattaagggtgagactaatcacggtgaatctggtcgatcgatcataaccgcgggcacggctattcgaatagtttactctggccagagatgcacaactgtacccacaagacacaatccaccggcatgtcaccgcgtcatcatgcgcctatgaagaacacgtcaccatgtcaagtgattgtgacaagacccttcatataaccctctgaccaatcgcacaacacctcaggttacgcccccgcccccagcaggcagccccctctcgtgtcacggtgaatccgaaagccgatcaactgaacagcccggatgacccaaccccatcacgcccaccctagcctaggaacatcagccagaggaaagctatactacagatcaagcagttacccattcccacttgtggtaagcgcggtaagtcttccagtgcatccggcgaaccggtccttaattgccatgggtgcgactagcaaaactatgcacccacagcccaccattcagtcgcattttagttggataattacaaccaatgaaacatggtcgggtgtctcgagcacgcagctcgtcatgatactaaaaaggtctaatactgcagttatcccatcaattgagctagtggtaattaagcatggctaagcgtattgttctagctagatcacataagtaacatgagctagtcgaattattacccaaggttgacaaaggacagatatcaagtaaacatggcacaagtgactagattggtaatacccagatcccatgtaattgacaaaacatgcatatttatttgcaaatggtaaaacatttataaattgggatcaacatactaaagggtaatgtgtgacttgccttgcttcttcacaacaaccttctgaactctgatccttgcgaccgcgaacttccgaaacaacggattctacacgctggcacgcaagataaggaaaaactctaataaaaaccaaggaaacagtacattaaaaagtaaacaaacatgtagatctcaattttagataaattttgcaagttgaatggcccaatttagagttcgtataaattagacatgaattttagaagtttttagccatttaaatgaatttctataattattaccgatttatgacgcaattattaatggctgacattgtcaaggggaaggggcggcgccggcaagcgggccccaccagtcagcggcacaagggcgccggttcaccatggactgggaccacggaggcggttcaccgccggtccacgggaaccgacggcccagatcagcccaagccgatcgggcggcgacgaggcggcgcagccaaggcacaggcgtggcacaaggccggctcggccgagccatggcgctgggcggcgagcggccaccggtggcagcagctggcggcggcgcggcgagtggagccgaggcatggcggcgacacacaagtggtggccggcgcggcaaatagagggaaagaaagggaggggaggagggggctggcggagctcagggtggagagaggcggcgacgcgcccgcaagcgtgcagcgccaacagaggggcggccaaggagcatcgtgacctgaggaaggtgatgggtgggttaggcgagcgcggggtggccggaaatagcgaggagaggcagccagaggcgacaagggctgcggagctcaccacacgcctagagaacggagtctcaacagtggatgacgagggcggagtgttggccgggcatcctcacggccttgcgaagctgaaggtggagacaagctggccccacgtggcgtccatagccggcggcaagcggctagagatgacgatggctcgggggtgctcggtggaagggtggttgcggcagcggattggggaaatggagcggtggccggtcttgcccttgcggttgcgaagccagtggtggagagcgtgagcccgagagctcggagcagtggggaatggcggccggaggtggacggctcgggttggtggtggacacggtgcttcgttggtagtttggggaagaggagcggtggacggggtgcgcacggtggctgcggtgccggggaaggcgatggcgcacagcggggtggacgagagcggtggtggtgcgcggctggagtcggcgtcggcgggggagagaggtggtgcacgtggtggcggcgtttcggggtggaaggagggaaaaggagtagaggccggggtggagttcggcacggcgattccgatagcggtggcggcgcagcgcggtggccatgcacacaacgggaaacggcggccggagcactccggcaagcggcagtggctcggctttgcgtggggagagcgggagagagcgcggggagctcgggcgaggaggggaaacgagagaggaggactgagggaagctttttaagggatcgggagggggagatcatgcccgggagaggcggatttgaaggggaaagggtcgccggtgacgtgcgtgagtggggctctaccggcgccgtttttcgcagggtgagggggggattggcgcggacgtcggcggtgaccgcgtccacgcacgcgcgggagagggagtcgcgcgggagagacggcgacgtggggtggtgcgggtggcaatggcggttgccggcggggatagatggaggttggggatgacaggtgggcccacaggtcccacctgtcggggatagagagagggagaaacgggctagggaggcaaaatggacttgcacggggaggcaaaggggctgggccgagggggaggaggagggggaattgggccggggagggaaaggggttggctcgagagggaggaaggaaggggaatttatattcgttttcttttcattttaattgagttaatgaactttgtgctatttaaattatttcttgagatccgaaaattcacgggaaatttcagagagtatattggggcacaaagaatattacaaaatattctcggccaatgatttttaaaggaaattttttattccctaactatttcacttgattaaattgctttaacttttaatataatttctggaaatgcattatttaataatttttaatcccgagcgaaaatcggggcattacaacagctctcgtgggccacataggccaaatttcaaatgggccaggatgtcacaacccccctcccaaaaaaaaaaaggacctgacgtccccgttggtccaacttacccgtatagctacacaggcataggaaaatgtccatgaatgtgtcccctcttagtgcacatccatacgtccagtgcaaatgccatatgccctgccatgtgcttcacacaacgcgcaaccgcgagggtcagctcagataccatttctaacagctcaccctctagagccgcttagcccaacctatccgactggagggcccacttacagataccactctgcttacatttccattcatacttcatgtgaaagggttaactcggggaacatatggatggaggaacaagcccttataagttagttccacccttcctaaactaacaaagtggtactaaacatgtgcacatagctcttgtgaaccacacatgccaaatcctaattaggccaggatgtcagccttgggtgccggatgagaatgtgccccgagcacaacccacgaagggtcgtgctttgtgggatgaatgttgatgagccttgagcacagcccactagggggcgtgcttcgtgggcttcatggagcatccctcttcgattgtgtcttaatccagcagtgcgacgggggccctagtacccatttctctgacagtagcccctggccttgaacccgggaacggggccagatggtaccaaggttgaggcttcttctgtcaaggcggatgtgcatatctttgctgtttgttgggttggttcattggccacccatgcttgtgctcaggtgaccggtgagctcaagagttgtgggatgccccccgaatgtgcggtttcaagttgaccgatcatggcacgaggacttcaacagtgcctggagtggagctggccggaccgagtacggcagcgcatatttgatatctagtctagcctgatagaggtgttttgcttgaaacctcgggactttggcaatacttgggcacggtccaagttccaaactctgttaacaccaaaatttgctacggttctttagtacattcgggttgaggaaagaagccaattagtatatggaagtttagtaagatcaaactgaattcaaagaagaatcgtgaagaccacagcaagatagtgtcatatttttagtatatctctaaaatatgcaggattagttatttttcttttcttgttaggagtcttatcttgtgtcccattaggacttatatcaacccgagagtataaatatgtactccccggggtctttgtaatctatcgccacagatcagtacaattacttgtaagacccggagacattggatcttgtacgatataacagaaactctatcccctccgagtaggactttggaaatcacttgactagtagagatattttctataatttgcaacagatttcaacggcgtacatgggaacaatccgtgtacatgaaggtatgcaatattcgtatatttcataagtcgtaggataggaggtatgccttatccgtaaccatgacacttctgcccagagttttgagtcattgtagattttatatgtttcgacactcctcttaaaccaagaggggtgatacatttgtcgacaaaagtggccccaaatctatattttcctatcatttttaggatgtatttcttgtaagctttgctaggggagatttgctcagcctacacagagtaggggaccgtggacacaccatctaggatcccctacgtttaacaccttaatatatggattttgcacgtcactatgctccaataagtggagcatgcgtcatgtacgagggcaagagtgtgtccgggccccaaaacagtccgggttcctggtcacttgtgaggacccaaaataggacctcatatgtatatgtgctaatccaagatccacctagcacatacagtgacaaagataatatgacacccaacataggcaaagataatatcacaggaaagctaatatttattaataaaatgattgtaataagccttatggccccacttaattacatttatttaccttaagggcaactcaagaataagatagcacaacggaaaagaacataaatgcacaaaaagctccattcaacatgccacaagcagtcaactggggcacacggcctagtcctcaacttcagcagcaaattcctcaaagaacagcagaaactttccttttggagttgaggcaattgtaaagtgagtacatcaaatactcagcaaagtacaaggaaatatccatatgcacggctgacaaagaaaggctaaagctattttgcataacatagctgttgcagttataaataatgggtgttaccattcgactgcccacacgggacctgtccacataagaccacacagctatattcattaacctgcacaaaagtcattctcattcaatgttttcgcaaactacctctcatgagatatcaccgagcatgtccatgaccgcggatgcggttattcgaatagattagtttaacactctacagaggttgtacagcttacccacaagatacatcatctttttgacggccagttcgacaatgtcaaactttagattgtgtgcggccaaggagtctagaacaaggctttttagaaactccaccgcaacactgccttacccaatgaaacacattccctcacataaaggagaaagtacccatggctaaccttaacacctatcgtctagccacctgggtgccaagactcggaatcctactaggccaagtccttcccatcaggacatgtggttgcacgataggcttagatcaacggcttatgaagtgaagtccttaattgaccaagtcaacttgctaaactataatagcacacatctcaacagtaggctcacatagagaccatgcccgtcaatgattacatagatacattaccgccaaactaggttcacacagaacaacccatcaccccggtccaaatcattttatccaaccgttgtttactacatgatgcaacacatgctactagaaacatagtacacagccacacagatcatataaaaaacaattataagtatataattaatcaaagttatgttttgcttgtgaaacaaccttgagcggggctaagtataactactctaccttgagttgagcccaatattcaactcacaatgactagggtaacaaggtatcacaggtaataaataataattaaaggtaggatataataacaattaggtcatactactcttcgataatttataaataaaatcatgcaagttcaaaacaaaacattttataaactaggttcaatatgttcaatgagtgtacttgccttgcatccgagtactgtccttgccccgtgtcttctgcaaggaatatctcctttgctccaatgtctacacgatcgcaaacgagaaacaaataaacaaaataaaagctagctaaataacatcaaatgaaacaacaaaaagaaccaggaggtagagctcgattttagaagaatttaggaaaaagaacaggtcaaatcagagttcgaacggaagaactatgacctctggaagtttgaattcagagaaaataggaggataaaaagaaacggaatattccgagaatattctctggatatttaattccaggaattgaattatttttgtgaaggaaataaaaggtggggcccattggtcagtggatcagagtgtggtggactgccacatgacgacacgtgaacagaaaaagattatgtggcgatgacgtggcgctgacggggatagatctagggctgacatggcatgggttagggttatgtagatccgacggtgtagattgaatctagggaattggatggctcagaattgtttactgattttatgttgtggggcccattcgtcagtggcacacagaggagggaaggaagcagagctcggcacgctctggccattgcaggaccgacggcggcgtgacggcgttcgtcggcggcggcgaaaggcggcgccagaatgtggaggtggagacgaacgtggtggcgcggcaccgagctccgtgtggcggcatggacggcgcacgacggtaaggttggtagcgccagagagagaagacaagagggaaacagagagggaaccagagctgggagatggagaggctttgcctcgcggctcaccggctgtggcagcgcttcgggaggatggggcgacgacgacgcggctcccatcggcgaaacgatgaggcggcggcggcgttgattgcgcacgggtggaagtggcggcggcaactagagctcgggaaaaggaaaagagagcgacggtggtggctatttatcgaggatgatgagctagggctacaagcagatttggaaggcggcggctccggatttgtcggcgacctcgaggggatttggcggcaacacggcgcggcgcggcctcaggtcgcgacggtgtgggccgagggcggcggcgtgtggagaaggagaggagcggccgggacgaggcgcagcacgtggactcggggcttggcctccctgggtcgagctgctcgggtggaggagagagcttcggctcctggcctaaggaagaagaaggtggagggaaaaagcagaggggcctaactgaaaaaaatgaaaagaagggaaaggaaaacgaggaaaaggcaggggagttcccggaaatttccaaaattagaatatttgtaattttaagatgatttaggagattaggaattgaataagaatatttttgaatttggatggaatttgattaggactttgagctccacaaccgaaatacaaatcaaatccaaccatctcctgttaagaaacaacaaagccgatgtcgtaattaattagttaatcatattaaatccttttgattgacgaaactttcattaacctatttaaggcgaacaaaccaaaggtgaattttcacgattcgacagaaagaacagaagaggaaaattcagggtatgacatcgctcctcagtttacttctctaagatatataaatgctaaagcacaaaggataaggtctcggaccccgaggtgggtcctagttgccttgtgctaggtacccaactacttatggttcaagtgttaaaattataagcacataatgatttaatttatttcataaataaatcatgacattgcagatgtaaactagtatgaacgcatcattagatctacatatgtaaattaagcagtaaaacatgaacagatcaaatatgcgcaacatgtcgaacacgtatcaaggtggccgaaagaccggttgctcggcaggaactactcgcggttgcgggtgtcgacgaacgtgcgcagcacgcgagcggagaggaaggtgagccgtcgcggacgaacagggagcagtcgcgcgaagcgcttcccaaaaaccttattgccgccttctcccggtgtaggacgtcgaaggcagaggttccggagacctgctctcccgatcgcaggtgcacgccggcgagcatgatgaagtagtctacgagcgacggcgcatcacagagtaggaggcaaaccctagattgatttcgcgtgtgttgcatgaaggcgatggctcggtttatacagagataggttgcttgatcagggtgcccgcacgatctccactccgcgtaaccgaactggataagtcgtgcgtaacttatccggactccatgccattttcacgcaccggattttttagactgtttccaaaacgaaacaaaccctaatttcccgcagcaaaacaaaactgcaccggatttttcagaatgtttccaaaacgaaacaaacccgaatttcctgcagcaaaacaaaactgtaaaaggaggctgcatctgtgcaagggtgaggagccagcgagcgcacgcgtgttccccctcttctctccaccatacatgcttcaagtggctaggaaggcatcttcccttttaaggaggtcccctctcctagaataagcaaggtgttactaaactccacatgcatgccatcccatgaggtgggtttttgtgattttccaaagaattaatcttcgagtgggctaaggcccatctattaattccaacattaagcatgccatttatcttaattgtaagttcatacctaatttatcggggtaatggggtaccctagtttccttatgaagagaattattcccagtcatttggggtagaataaacctttaattgataaatgtcaggaaagatggtaaaagtaaggattaatgcacattcaatcaagctctgatgaatacaaagtacaaaaactgccaatgaaaattgaaaaactatctatcacttctatgattttagagagcatgactaagttgtatttacttgaatgttatgcactggaggagggtgaaatatcgaagaatacaaaggtataaatcatcttgtccaaaagccttggaaaaaataataggacaagaactccagttccttaaatccctaaagtaaccggagatgtctcatgaaaaggggatgaaaggaactttcatactcataatcaccaaaagtaacctggaaaatggtatggaagttctgaagaggcacgccggatattctcatcaaggtagaaatctaccagttggagtgcacaccaacggcagtacactgaaatgattattcccgtaccaaagaatcaaacaagaagaagaagcattacaaattacatgtccccatatattcatggatcctcgcaaagtgtctcatgcaactaacagaagttggcaacgagacctatcatggacaatattttcttcagacatcaaaactcattggtagtcaactagaagttgaaaaataaactaaaagattgacttacatattgatccactgttgacaatgcatagctaaagaaatgttggattgagcactcaaatataagtatgagaagctccaaaccaagatggtgatccgaatagtgtgaaaatacatatgttcctcggtgtcacgcccggaatttctatccaaaattccaaatgcttatatgtgtgttaaatcctcgtccaggaatcagccgaggcacacaataacaaattgataaaaagtacaagtctttatctaatttattaaacgaaaatatagcattattacagaggtagatagttcctctcaataaataaaattctaagcagcggaaaataaagataaaagggtaggcgactcctctccacaagcagcaacttgacaaggactcagcctaatcctcctgagcatcaccttcgctatagaactcctcctctgatgatggatattgcaaggtgagtacttcgaatactcaataagccacacagcaaatatgcaagtgcacatgataacacaaaggatggcataatatagctcatttgcataaatagcatttaataaactttagagagtaataaaacaattgtagtaattagacattattaaatcaacactatacaacataccggttgtataggcccaaccaaacctgaataacaaagctcggtcgtacagatcaaacctccaactaggaattaaccattccaaaccaggagtttaactagaatcatcattcaccacattattattattattgttgttattattaatgaatagtgtgggactaattacgaaagacattattaaacccgcccataaccgcgggcacggctattcgaatagttttactttgatcagaggtgtacaaatttacccacaagacacaatgccacagaatgtcaccatatcatcatgtgcccatgctgaacatgtcaccatttgtgtagttgtgacaagacccctcacataacactactcaaagcagcgcaacattcctggttcatagtcacccccttataaaaccaaggtatagactcccgagcgacccccgtgggcttatctccgccacttctcagtctgcactccacaatgagccatgctatacaaagcgtctagtcatttcccactctggcttgtggttagtactgttaatgtttcacaacagtagctcgcgaactggtccttaattatcatgagcacgaccctcaaaatcttgtgcttacaacccaccattgttaggttttagttggcaattcattaaataactaatcacaattagccatcgtgagctaccattaaatatatgataataagtgaattatatgttatcccattaatgaactaatgtttctaagtatggctaagcatcctaatagctttagctagaatatatattactccctccatctacttttgatagtcatatttcatcttggcacacagaccaaggataagtaattctacttatcatctatttaaacatgctactagtcattcctcgtaaacaagcgattcattaatatttacatttctcgatgcccatgtagccaatcttatgtggaagaatggagagtcatgcattaaatccgagaaaatcattaagatgataggttgttggattgaaatatacctatcaaaaatatattttgcagatttagaaatatgactatcaaaaatagatggagggaatatgtcctagctaaccatattattgaccaatttacaaaggataggtaatcaatagcaaaaaggaccatatcaaaggaataggttcactacccgatgacattaaaaaaaatgcacattagaaataaatagagactataaatatagggcaacatgctcaaagggatgtttgggatctgagtcacttgccttgcgttgctttgtaagcttatgaaccttcttcagcgtaaacggtctcctccggaacgtcggaaactaaagcaattgaacaacatcaacaaaacagtacataaacaagcatgaacagtacatgtggatatttttaatctgtagatcttgattttagacaaatttagagacttgagccacctagctaattccgagttacgatgaattagttatgaattttctaagattaatatgattttagccttatacataaaatgatttacgattaattttctagaaaagaaaaaggctgctgaagccactaacatcagcgatgacatcatcatcggcggagcggctcgggaccctatggactctgtcgatctagggctaggcggcactagctgagggtaccattgcgacgagtgtgatgcggggaactcaccggtgcatggcacgacaacggacagtgacagtgacggcgaaggggcggacgaggtgcgtctcctcctcacgaatccagcggtggcgatgcgagcggaggcggtggctacagcggcgccgcagcacagctagaccggcggcggcggcggcgctagggctgaggcggcagtcgggacttgagggaaaggtagaggatggctaggggaggctttatataggcacgacagagagagagattgatcccgcaacgagaggaattggtgtcggaaaatctatggtttagtttggagagataaactcgaacttgaattcgattaggattatctacgtggaattgtgctccgattcttatgggagaagatggaggaggataaggggatgatttcccctcttccggccaatcggactcaggggcaaccgatggcagcggattcgactgagaggcggcggtggctcggactcggccaggcggccggaggttgaatacgaccccgacgtgtggggcccacatatcggtgggagggagattgagattgagagagatagagaggagtggcacggctgggccacgcagtgcgcgcgcgggagggaggagttgggcagagattctaaataatgcattaaagaatatattattaaattaagcgattttcaggatgtgacactcggacatagttcaccaattctagcaagtaatatggttcgaacttcgtccaaacctcgaaaccaatatcaagaagaatatgtgcgtcacaccaactttaatagactgtacgaaccctataagtcagggaaaaatgttgcaatatttgactattggatcatcacttgcattatcttttgaaaagatgcaagcaactgagttcgaacggttgaaatttaaagaacatgcaaaattcaggggaataattttgctagtctattatcaaagcttgatctaaaaaaccaagtacccaaaaccaactaagaaaaccaaagcaagaatttgaatagattaaactcatttttttttctcttagataagttttccttcactcttataaaggtttttaaccatgcgacatacatgcgcatgctttctccagtttttcccattatgtttttctggagatttaaaaaggcatagacatcacgcggtgagtaccaaaaggactgttaaaaaactttaggcttggcacatgaaggccgggctaaaatacacttattgtgtctatcactgaaccttccatatatggatttgcactacataaatagaagagggctgctcacttgtacatttgaggttgaaaagagatggttcccattatcctcgagttcttagtcaaactcagcttcatccacctttcatggatattggcacaggcaagcgaaggaaatgaatggaataaaacaatacagtctccacatttgtcgatagattatatatatgttggattacttagtagcaggggttgtataacaattgttagactttgcactaggatcacctaggttagatctagtcgggtggttctatttgggattgatgtttgaactatagagattgaaaacgggagagggtttagatagaccgaccggttgaggtgttggaggatgaagaagtgccggccatcatcgtcgttggcgctcggttgtcgtggatgcggcgccggtgaggtcgacggcgatgacggctgcgggagtgacggtcgtagatgtcccggcgatgaggtgtggcgcggcggtggcgcttcccgtcactggctgcgccccctctcgatcggattagggtttgtagggtggagttggcggcggcggtgaatctcgtactctctgccgtgccggcctccacccctcttttatatggcgcagtgtgacgggcgcccaccagccattgggctgggcgcccccgatcagggcgcggtcaaggcccccttgagccaacggctcaaggggagagagatctatctaacattctcccccttgatctcactttttcttttagctttttctattccatcacagatttgtaaatatagcatgtttcatcatcacggtcaatcaccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaatatagtactttatgtcaatgtgtttggcagcaccacttgactgattgttgtgagcgtacattactgcgggttcgttgtcgcagtataactttagtggtttctcaatactatcaaccacctttaaaccgggtatgaacttctttagccagttcacctgccccgttgtctcatagcatgctataaactcggcatacatagtagaccctgcagtgatagtctattttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataatgcaagactttctttattaatttccagtgctctaggcctggattactctgaaatctgccaagtaacccggtaacaaatgccaagtcaggtcgtgtgcacacttgcgcatactgtaggcttcctacagctgacgcatatggctttgttttcatttcattgagctcatactgatttctgggacattgcgatgccccatacttttcgcctttcattataggagcaggtgtagtactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggataagaatttctttgtttcctgcagtagactgacatcactactagccagtagaatgtcatccacatatagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggattccaaccattcagatgagcgagcgcttctcatggcctcttcatatgaagtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatttatttgaggctgttgtagctcctcctctggtgtggcaaccatttctgttgaatcctgtataacaggttcctcactctcattcaatgttgcgacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggatagtagaaacgatagccttttgatctttcaggatagctaataaaatggcagctgactgttttggggtccaacttcccaatatttgagttaaatactttggcctctgtaggactcccccacacacggaggtgagttagcgagggtactcttcctgtccatagctcatacggtgttttgggcaccgatttgcttggaactctgttgagaatgtgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccagtgcttctaatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaatgagaacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttctatttctctggacttatgttgtagttgacaataaaattgtcaaactgctttggcaatgaggccataaccagatggaccagaaagtcatctgttatgcccaaatgtcacgaccggaaataacccaacgggcgttccttacgtgcgtgcattaatccttgtcccaggaggcaaggtacaccaaaagttgatacaattcaaagtttaacaagcggaagcgtaaatagttaatttattacatgggcagcgaaagcccagcacacacaaagacaaacgacaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactatagagggttagggttgcagtaaacagcatttaaagacattagttgctcagggctattttgcaaacacgattctagtactatacaatattatttatcaaagccgtgaacccacacgaacctgccttaacccaaagcctacgatgattca

SEQ ID NO: 68996 - DNA, 7895 bp, Oryza sativa
gattagtcaggtcaggtgtgtagtttagacatggaaaaaccaccgaaaactgtgttggtagtagaagtgttgaattccgaagtgtatatactcccataatctaactcatgaaacatacagattcacaaaaaatctgtcttctttctctgttccaatcgcgatggcgaagtgatgaggtgcgatagttggcgaagtggaggtgtacggcaattcacagtcgcaaattctcctggtctatattccattaattccagcagataaatatttcactgccatggtgatatatctcgacgagacgacggcgtccagggtcaagcaacaatgacgggggaaacttcgatggtcgacaatggtgatatataggcaacattagagcaatataatagaacggttgttgctggcattggctcggatcggcagatggcggagtccttgggcttgaagcgtgatggaagcttgcggggccaaaataagtgaacctatatatttacaaacgaaaaataatttatgaataaaatttttatatacgttttcttaactatctaaaaacaaatactgaaaaataaactttgataagaaaacgttaaaatcagctctaaatttaaggctgaaaattcaaattctagctgataagtataaacttaagcgaaaagatgagactcttagaatatccttgtggcaggaacaagattgtgtgaagattggagggagcattatgaggttgttaaaacgttagatatgaaaaggctttcatatcgatgtgtagtaagagaggagtgagtgttcgctgggaatcggcgcgcaccaccgcagaccctgcccactgcactaggcgcgattctcacgtgtatactttacatgttttaaacaattttttcctacaaaatttatttgatctacaattcagttacaccatcatatttggtacaagtaaatcttatatataggctgttacaccatccataattcgattacaggatgtcacatgattatatattttttaaaaaaaatatatccgtacttaaaaaatatataccatatactccctccgtcccataatgtaaggaattttgagtatttgcttccactatttgaccacttgtcttattcaaaaaattttggaattattatttatttttttgtgacttactttattatccaaagtactttaagcacaacttttcattttttatatttgcataaattttttgaataagatgagtggtcaaacactagaagcaaaaacttaaaatcccttatattatgggacggagggagtatgaaatatcaagttaaaacgaatgaaacattataaaaatacttcctgaaacatccagagaagctttgttcggaagttggttactgccggctggcagcagcagcttgaacaatatttttgctgctgattcagttgttgcaggcttgtagtacagcgttgtggctgcacaggaattgttgccgaacacaggccactatatacaattttcacaaataaaactagtgaaacatcgtaaaatacttattgaaacatccaaataataccatcagaaatatttaaaaagattcattgcaacgtaaaacttaaatgtgcaacggaattgaattttggttgaaacattgtttccaatacgcaaaacatcaattttcactaattgaaacatatgtattttatatgaaatcttgatgtagagttttaattataacgaatagaacaatataatcgaatcacatatttgataaataatttagaagaaaaatcattttgaagattgctaggtaaacaattaatgcatattacatgaaatatgcatactcctttatggagagacagtgaatgagcactttccgtggagaggaaagaataaagaacaactcgcgtacaatgtttttccctttgcattcccccaattattttggttgttcaggagcggacactgtgtaggttataggaattcacccaaacttttttctcttgaaaagaaatactatatgtaaatactagaagatataatgatactgcataagtaaatactttgctgggcctaatacctcgttcttaggcctaatactctgctgggcctcctcccgactcaccggcccaataactgcccaggacgcttcctccctaatcgtcatctcctcccggtccccgtcccccgatccccaatcattcctcccctgacgccgcgccgcaactcgccgccactccccgtcgccgccgccgccgcttgtcgaagctggtttgggggattcggggatttgacggattagaggtgactgaactctcgctctcctgctgaaatcataccgtatttttgtgatgatttatggggaggaacctaggttttgatgagagaggcgaacactgatttgattcatccaacgcgttatattcacatcctaacatccagcctttgcgcctacgcatcaggaatcgcagtcgcagatggaggccatggacgacatggcggctctgacggaggacatcctcctccagatcttctcccgcgtgggcagcatcaaggacctcttcaagttcgccgtgacatgccggcggtggctgcgccgcttcaccgacccggccttcctccgcgggctgtgcctggacagcggcgagggccaccgcgcgcgcctcctcggcttcttcttccagcagacgagattctatcgctgcgaaaagatgatcaagatgcgggtgacgcagcagagctcggtctgtccgcccaccttcctgccggcgccgtggtcgccgctcggcctcacggatcgcaccctcacctccttcctcgccgccgacgacgacaccttcaactacgccgagcccctcgcagcgcgctgcggcattgtcctgatgcggcttgtcccccgcaccgcgctgatgatagcgtgcagccacctcctcggcgtctgcaacccgatcaccggggaatgccacgttctcccgcctctgaatctctccggcctccatcgctacttgaccagctacgccatcatcacgtccaccgacagcgacctagatgggaagcagccgccatcatcatcatcgtcagggcgctccacgttctcgcagctgtacctcgtcgtccaacacaagaaagactgtaacgagtacttctactcctactctgctgctacgtgcagctggagcgctccccccatgtgcgtggacggccgccgcttctccctggtgggtgagagatccgccgtcgttcacaagggcgcggcgcactggctgtttattgatcgtgtatctagcgcaacccaagatgacatactgtacaaactccccgcggcggtggacacctcagaaatctccttgacaaggctcccctttggtgctggaggctcaccgctcctctgcgtcagtggagacggcaaactttcggtcgcttgcgtgtttcccatccacatgagagtttggactcagcaagatgacacccctgcaacgtggctccgcactgtgatcaggataccattggcggtgccttacccagactattcccatatatgtcagccccgcgagaagtggtttaacttcaacaggggatcaatgctcgtgctgtacaggagcaacggcgtcttcatcctcgacctcgagaagaaggtgatggaaaaggtcatggactgcttactgcccctattcagtgataaactgaacaggacggctgtggcgtatgagatggacttggttgagttctttgtgctccagctcagtggtctatgtagagggtctacaggataattacagatgttatgcagtgggaaaatatatgttctagaataagcaagtttaagttaaacaacagcatattacatggatcatatgcaaactgtgcaaactggcgagtgatatatcttgttctgtaacacggcattgtcattgtggatatgggttgacctttactgggttccactgttacataccttctctggaaaaacaaattctcttgatcttacagttcacaactacgcaggtggcattttgcggcacagttcacaattttctttgtttgcctgttacgcttgctagcaccttaatttgtcaacttattgctagtgttaatacttatacatctgatggtgtaaatcaaaatagtttctttcatctgagaatccctgattgatctgtttgtaagctgtgttcttgttttgtatggtctgagtaccagctgctttaggtagagtaactgactgtcagttcctgagaatgccgtaatgctagttgtattccatagaactgtgattccttgcagtttacattgtctttattttatattcgatttcttattattattcggctagtaaatgcgagtttcctctggaatctgaatgtaccactttgagctcttaggagttgaagtgagttggagctagattgttagatcctgacgtttttttcttgttactgtgaagaacctgtttgtgctttctctaaaattggacttatatgcacgatatccttgattattttgtctactgtcaaaatctgatcacccatttatcagaaatcatgcattagtcacatttgtgataattgatcgtaggcaagaagtctatattgatgtttgacatccttgagtagtggttgctgatttgtcagctattgtctagacatggaaaagctactgctgaaaggccttcgagttctgaaggttatatactcctacatcttacatagaatttggatagaatgcgtctgttttgtttgtagttagtggcttagtgcacactgttgaatttgatagtatttgcaatacagtgttatatgctgctaaactaaggctgtgttcgtttgtgtgagatagggtgagaaaacacctcgttttccgcgcgcacgcttcctaaactactaaacgatgcgttttttgcaaaaattttctataggaaagttgctttaaaaaatcatataaatccatttttgaaatttaaaatagtttatactcaattaatcatgcgctaatggctcatctcgttttgcgtatcttcccaatcttctcaatctcctatctctcaaactcaccctaagtgaaaatggatttccttgtgaagattgtagaaacttcactaattgccaggattggtctaatttgttccaaggtttatggcattttttgtatttctttactcctttaaacgtttctggtggcgccgccaccaccaaatgacatttgggctccacataactagttgcagaaaaaaatgtgagagtttgcgtgctcagtgatgtcctgaagagtatgtgtaacacaaagatgcataacagaagactagttatgatcacgccgttgccaaaggttatcatcaagttccttgtatgttgtccactatgacttattttggtgtatccctactttttaatctctagatataaaactatggccaatatattgatagaacacagctgtaactaaatgttgcgtttctgactgcaggatacatatggaaattgagtttgttggtgatcacagttacaggtctggtaagatagttattgagtttaacgattgaacaaggtgtctggaaataccaccaggtgcttcaatctttgagcaagatttttctgcgctctccattgttttgtgttgtgtttgtttgcagtctgaaccatgaaagaggaaggagaaagaatgtgagaggaaatgttcttggatttttctctagcagagagatttatcttgtacgacaataaatgtttgctgaattcttagtgtcatctcaaaattcgatttgtctaaacaggaaaaactgacctattaatcaaaatatatagagtttaccctgtttttaattattattttcttcttatttacatgctgtttatggttacagactccatggcaaaaagcccaaaacctgaacccaaagaaagaacagcccaccaccacagcgctccaaaaacggggcccactgcacatttttctttgcaacgtcagcgatccgcacggaaacgcatcgcagccgtctaaccgaaaaggcaccggacgtcacacattcatccacgtcatcgatccgcgggacaagcctctccaccaatcagcgcccacttttacccactataaactcaccgcacccgtgtcctccttccacaccgcaatctcgcaacacatcagcacacaccgctccaaagcaaaacccacggacccgcttcccctccccgagaagaagagagaagcatccatggcgcccaaggcggagaagaagccggccgcgaagaagcccgcggaggaggagcccgcggcagagaaggccgagaaggcccccgcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggttcaccccgacatcggcatctcctccaaggccatgtccatcatgaactccttcatcaacgacatcttcgagaagctcgccggggagtccgccaagctcgcccgctacaacaagaagcccaccatcacctcccgggagattcagacctccgtccgcctcgtcctccccggcgagctcgccaagcacgccgtctccgagggcacgaaggccgtcaccaagtttacttccgcttaggctgcatgccttcctctagtttgttagtagtagtagtagcagtagattgatctgtttatgtggtagtttaagtggaaatgatgattgcaaatgaagaattgtgcggggcttcttttggggaactcactgatctggaatagtaatgctttttatgtcatgtgaacatatctctggttgccaattgattttttgttttgtagaattgattacatcgttgatgtttgcatcgtcttgaaaatactctgcttgtgactggaatatgattttcggaacatctgtctgtactccctctcccaaaatttgaactggaaatttagctaggactccatttttggtactgctcaagtacccattggctcaatgtattttgtaggtttgatggaagggaagcttgatggccattttggttcatgatgttgcatttggaacataaaaactgtgtactattttgagctgataactttgaaatctgaaagtaagttttgcttcagcttcatttggtactgtttcaaatcgaaatatagaagttgaaatagtaactgaaacgccatatgtcttcgcttactgtttcaggagaatgctgttctctttactccttcctgttctgaatgtccgaatgggtgctttttctttgttactgattcgcttgtatgctagtaactgggaaacatgaggtatgcatctcatctctactgccacatcttctatcatgcttgctgttgtggtgcctgcagccctgcagtacataccatgcctgaaaaatgtgaccaaactcttgtgggttctacttgtaaattgtaatgttatcctttctattctctgtccagcatggttgtttgaggtgtactcaggttctactggaagattctcttgtagcagcatttttggcacgctcatataaaagcttcggtagctactgtggaatgtgatagaaataatgggtctgatgtttttgggaactctccttcatttctatttggttaactgtttgagcatttaagcgtttatctttttcgatagcataaattgttatggatttgatattctgtgtttaatctgtataattgcaatatttgttgctgtgtcgtatatgttgaatctgagtcagggagttagaaattctgcaactatggatgtgtaggaattggcaatgaaatcttactcacattgtgtaagaagccaaaactctcgtacttctacatcgtgcaatcaacattattgcattctgtatgcatctcttacactgacatgcatct

SEQ ID NO: 68997 - DNA, 613 bp, Oryza sativa
tccagattcgtagtactaggttaactaattttaggagtgagggagtaatatattccaggaactgagcagtgtacagtgagcaatttatattgagaatattcatgcaaacaggaaaaaaatcaagaacccagctaaacaggttacaggggaaaagagattatgcaacagagaatatagagcaactcatgcagagttgtaagataactggaagaaaaattatatccaagaaacaaacatccttcaaaatgttgtacctactaaccttgcaatctgataatatttttcaaagccagagaccatcaacatttgcttgaacagctgaggctttgaggaagagcatagaacattcctggcttcaaaaaccatattggagggcataaggggaacatgaagctcttatttgaagaagtttcaaaaattcactgcagaatgattagacctaccgccaaaaagcactagatatatatttatgatactcaatagagttgtactttcataattgtcactgtttatagttaaaataaacccaccggagaatgcaaaagaaatgtagaatgtagtgtatcccacaagaacgtaggcacaagggaagtcttacaaaaaaaggtcttac

SEQ ID NO: 68998 - DNA, 8600 bp, Oryza sativa
caacggcaaaggaaactcgcggcttgaaggaaagaggtcgatccgaatcgaactcgattccacgaacttccaaaccgatttagccgaagattccaaaggagaaaaaggtagaggagatcccggagattgtttcccctcttttgattcgaccagagaaggaaaggaacggccggatttggaaggaaacggcggcggcgcgaaactagggtttcggcggcggcggccgaaggaggacgaaggtcctgacaggcgggaccctcctgtcagcgacagcgagagggcgcgcgcgcggcggactgggccgaactgggccgaggagagagagaggggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctgggcccattttatattggaatttattaattaaaactagatcttctcttcaagacttttaaaattatttctaaaaattccatttaaacaacaatttataaattttaaattttcagggtgtgacaatggataagtatgaagcaattgaagaaaagtctgacagaccaaattgagttcggaggatgtgtttacctgtgattatttccggtcggggacgagcaggcccttgtactttagcaggagagctagaccctagatcgacattggcatcttttttaggaggattgtcaacttgagcttctacttcgaggatgtccttgtttcgctctgtacccgactggtttccagtcgggggctcctgattagcgtcgaccctagcttcggccgactggtttccagtcgggggctcattgctgggacctacattgtcggttgccggctgttcgtcactcaggcgatcccctgcagtcggctcggtctcttttgaaaaacctgtctccatgccagtcggttcggagtcttttctagaaggatctatgtcagatggcttcctacaagtttgagttatgctatcagtataattttaatgaatgagcgtcaatccaaggaagaccgccaaataatttgtacctagaagacttcctgatttttggcatgggacgactggatgttttcttctttgggttagcctgccttggatgttttccagtcacccctttgctgccagccttttcagcatcatcgtcgtcactcaggaccaatttcctcttacggaaatctgattggttggccgactgagtggtggtgggatgagagtcagaacggatttttggccctccactagtttggctagtcttcccacaaggagtgcggtgttgggtaatcggaggatcagacttcatcaaggtaaactcctgtatattacaagtttttagtcaacctcgcggaagataaaagcatgctttttagaaaggctgagatattaaatacataccggtggaggggggttgaaagcattgtatggtacaactggcagcagatgtgaatagctgacaacgatagcatttgagaagatcttgtacattctttccttcatgaccttaaagtcaagagagtctggatcttcacgatttggatcatgtttgccatcaaattcaaaagccgtgcgggatctctctttgattggagctagccgacttttgatgaagtgccgagtgatctgctttccctgcaaaccttgttccttcagttttagcatgcgctccatcagttccactgcctgagcagcttcatctcccataggcaatgaattccatgtgtcctggcagaccggagggagacaggagtactcggggagtgctggttcaggattctgaacgtaaaaccagtttgcgtgccagcctttgtttgaggtcttgaagggcatggagaaatacttttggcttagtgttcctctgagttggaaaccagcgcccccaacaacgcatggtttgctcttgttcggctggggcttgaggaagaagatgcggcggaacaaagcaaaatgaggtctaatgcccagaaaagcttcgcaggcatgaataaaattggcgatatgcactatggagtttggattcagatgatgcaggctaattccatagaagttcagagttcctcggaaaaatcctgaagttggaagagaaaacccgccataaaagaagtgagaaaataccacgacttcgtgtgtatagggggtcgggaacgcctcgctgaacgctggtcaccacccgatgatctccttcactggaagaacgccgtgtgctaccatttctttcagattctcctccatcacatcggagggcgcccactgactctcaaaactttctctctcttccgccatggatgcgtgtggaatggtttgatttggtccaagatatagctggaggggaatgaggaatcggagcggaggacgcgcggagaagtttcgtgggatttttgagaatggattggggcggattgatgaaccctagcttcgtcggtgcggtttttaactgtagcaaggagtggggaaatggcgagagtctcggcggggaagacgaagcgtcgcttggacttcggtgttttgttagggtatcgggagtactaatgggcctgggcctgtacagtacttcagcccaatattattatcagcgtggcccgttgtgatccctagggacttaggcgctttttgctttggcaatttgtgctcataatgatgtgactcgatgctgctaaaatcctttttgatgcagttagataattctttggaattactacgatgcaaataaaaaggtgcccaacagaaaagtgttatactaattttgtaggccttttaggctacaaatgctgttcgggttttcttgagatgattggttttaatgcagtcatccattcggcatgttatatgcttattttgattatggcatgagtcatagcctaggctatttaaactcatcttttatcaaattttatgccacgtttgataggtcttttgagagtttttactcggccttttatcatctatgttgatttataaacctttagagtgcttctcgctcgggtttttctttatgtttctttggcgcattaaaagcagtcggcaggaggttttatcagatgctgcacatgcttagccttagaccgtttggtttaaaaccactcggatggatgtcttgatgcactctgactatatgtttagttttatttaactaaccacatagtcgggggctacacctaattaggtgcatctagtcgatgcacctgattttttctattcttcagcccttcacagtctttgattttattactcgggagaccaaaacagaggaagttaaagcactcggattgtctttttggattatgagagaagactatttcgtcgactgtaaaggtctcaggggctactgtggagattatggataccccatacctacacggcatgtataaccgactgggtatggggtgccatgtatagatagaatatctttaaagggactcgggttaaatattaaacttgtatgtcaaggaaatatccaaggttctagtcggttacgattgtattttatctgtaactacctattccgttagggatatggtctgtactttgtaatacggactcctcccctatataaggaggggtccgggtgcctctaggggcacgattttttctcccagatcatacaatcaataatatactcggcggatcaatccccggacaggagtagggtattacttcttgaataagaaggcctgaacctatataaaattccttgtctctgaacccatctactttttcagcttgatagccacccccttttagtattgccgaaatcttgtttcgacactgcgtggtcagagaggagaagggtgtaggagaacaacaggaggaagaagggaaggtaaaggccaagcaattttggggtttatggtgacttcgcaactagtgggtttgttcttaaattctagtatcctcgctgcaacggtacttttgtttactttctggaagcataatattcaaatagaaattgattcgatagccgcttacgcaattttttttaggtcgttgggtacgggctgggaaacgtattttcaaatctggtagtaaacaatcaggtttcgggttatgcatcctaaataaagtttgtagtaatcgtcgatatatttctaacaccactggtttcgctcgattccaataaacggtttaggagaaacaacagaaacagtattattgaccgggtctgttttaacatggacaataattagttttacttcatctgagaccaatagaggcttaatctgattttgtgcccaacatgaaaaatttagacaattttatctagatgtccgaagttgtattatttgctagattatattccgttagatggcataaaacagtaatagaactgctgagtattctttactcactcttgtgcataatttggtttttaggtaccaaatgatatcgatcagcatgggacgagagtaggacaaggactacacattttattacactattgaaatttggttttagatcatgattttgcttagcataagttttgcgtagaacttgtaatggtcaattaaagttttggttcacatttccttgtggaatttatggagttaggatggttagcaatgtgctgattaattcgttattgatttatcttatgacttcctgtcgtggatgtccctatttttaggtgaggctctgccgaaatttctaataattttagaagttagtggttttgagtgtattttggtgtggcactttaggtacgtggttacctgggatgttacagttgagaccaacatcgattcggagtcggcaccggcatcgctcgggccgccccacgccgtcaccgctcgggccgcccggcactgtcgtcggatggaccgccccgccagccgccgctgctcacccccagccttcggcctcatattgttctgccggttgggaaaaaaaagaaaggagagagatagagcggaggggaagatgaaagtgaaagaagaaagagagaaagaggggtagatgaaaagtaaaagaaatggtattggtgggacccactataatcaacttgcactgtagagcatttagcttacaatgttcttagtctacgtggcatgtgaaaaacagcaaaaatggaggacaccctgctaatacccgaatgctagagctgctggagcagtgtggactggtttggatcgctgcttcactagggagttgggttggagtggtttggatcgctgcttcactagggagttgggttggagggggaccgctagttggcgcgtatgcgccaccggcgcgcattttttctggggataaggtggttagactaatcttttagttttagataacgatagtttgagataataatggtagtagataagattttctttttcccgcgagatttttttaacgaacaaattgaaaaagaaaatctatatctgaagtcaaattttcaaaattttaaacctatatttgaaaactttcaactcgaaatttgaattttaaattcaaatttcaaaaactttcaacttttcatcccaaatttgaaaactttcaacttgagatttgaaaattttcaactcagatttaaaaattttcaactcgagatttgaaaattttctactcagatttaaaaactttttaactcaagatttaaaacttttaactcgagatttgaaaattttcaagtccagatttaaaaattttcaagtaatgatttaaaaagttttaacacaaaatatttgaaaacacgcgtactgaaaatttaaaaaaataatcagaaaaaagagaaaaagaaaagaaaaaatcgtgaaaaaaaacaaaaaaacgcagcgccggggagggaccgccaccagctggcgcgcgccaattagctttcgcggggtttggagcagttttggactggatgtcaacccactagctgactagaaggacccagctgttcgccacgtgtgcgtgttgacttccacgtcagccttgcccttcatcaggctcaggagctctagcatcgtcaaaagtcctagcggcgggaaaagcgcggcagtttcccgccaaacgccaccaaaatccccaatctcgcgctatcccgcgtcccacaaacgcgccgacggagagacgggagggcaacgggagggcttagcgcgtcgctcccaacggtgattcgagccaagacctagccgccgccatggagatcgtgagatcccaccggcagatcgcggcggaggcggcggccggcgtaggatgtggcggcggggcgggaggcctgccaacctaccgggtggcgccgcagctggaggtgcggttggaagagtttgagctcttcgccatcgaccgcctccgaggtgcgggcgcctcctctcccctccccactgtggcggcgtttgtagagtccttttttcctttccttcctcgcattctgtgaacgatttgacatctagactgctgctgtgttggtcagtattgaaggggatcgccgacgggctctcgcgagggaagagaccggaggaaatggagaaattggtgagccgtcctctctctatatatctcgttgcaattctaccacggagatgcgaattccttcatgtatttggggcaaattaaattccatttcttgctggacttttcgatttcaatcttgaacataatttcgcggttagagtttcaagctctagttaccaagtttaccatattttctttaacagtaatcctatctgttttccctccttgtgcttaggtcaaggaattgtggaaagcccatatgaggcaccaggatcctacagagactttgaacaaggacataatatctcactttgttctccgtcttgtctactgcagaacgtaagcttaacattcgttacacttgagtacttgacattccatagacagtaagccggtggtttgcttctggtgctttcaagtttgaacctttgactaacttctcaaaggctttgtgctatacccgcattctagggaggagctgcggaagtggtttctctccatggagactacgctttttcgctatcgctttcggctcgagagtcctgaatcacaggtgactttctgtccttttcttgcatacaaggaaagctatcatgctttaaccgttccttgccacactgtatttttcagaggatgcttatgagtgagtttcgacttccatacaaagcattgccacactcggaatttgaggtatgtgttatggtcactctgttgacttggaccttgatgatttcagtaatatttacagtagtgagatgttcttgttttcacgtttttaggctgtcaaagacaagttgagccaagttgcacgcaccattggtcaatctgcagctggtatggaacatcttactatgtgatacctgttctttatgttgtttcagcacaatggtgcttcgctgcttgcaggtgtgatctttcacttgctaagtttgttctatgttttcgttttgcagttgaatctgtgttcttcaaggtatttgcatcagtttattttacctcttcaattccatatccagtagaaaaaaattgttcgtgtgattacccagtctaaataaaccttgttcgtatccatgtaaggtgccttttgaagaagttccagatcttgttgccagccgccgagtatttctttcaaaaggatatgcttatgttgcgatgagtcaggtttgctgcgaaaacgagactggaaacttctatgtactttttggatgttgtttcctgcccattctaaacatacttgtataatttaataggttgtttcgcttgtggttacccaattccgctgcaatatctcgaaggcacttgttttaacaaataggtacatggtacaaatgttctactttactctgcctagctacatatcatgtccgggaagtgtgctttcttagttctttgctggaaaaattgttgcactcttaggtgatataattaggaacattaacagcattgtctactatttgccaataatttacatagaacaaaagccccttgacagttggatttatttctcaacttagaacactctttagtacaggctgtactaagctataatataaataattcgatgtacagaaaatggacggccaccattaaggaacaagaaaaggataggttgactcctgtgagtatcaattaaccacttcccgtattcctccagacaatcttttcataacttttataatccacactttttatcttaacagattgtcgaagcattgagtaatgcatattttggacctgattactctcaggtatgttgctttatctataggtgtttttccagatattgttaatgggattttcttcaatgctaatgtttactatatttgttattaattgtctggcttatcaaatatccaatattctatacagccaaaggatgctgttgagatttctctgaaggatattgaccaactggctaaaacttctttccctctttgtatgcgccacatgctagagaaggcaaggcaccttaaaagttcacatactttgcttaccttatgatcaggttatttagtgattgcttttatttttcagttgagagaaaaccatcatctgaagcatgggggcagaatgca

SEQ ID NO: 68999 - DNA, 723 bp, Oryza sativa
attttggaaatggcagataagactccaagtttgtctggtaaaaatacattcaaattcttttaggtaatagtgatgaataatgtaattgaacagtctgtccaattactttgttacagtttcatggcgggggtgttccaatattattgtcgatgcgatagacacgaacaccacaacacggggccggctaaggccttgtttagttggggaaaaaatttaggttagttgtcacatcggatatacggacacacatttgaagtattaaacataatctgataacaaaacaaattacagattccgccagaaaaccgcgagattaatttattaagcatgattaacctgtcattagcaaatatttactgtagcaccacattgtcaaatcatggcgtaattaggcttaaaagattcatctcgcaatttcccggcaactgcgtaattggttttttatctatatttaatacttcatatatgtgtttaaatattcgatgtgacaatatgaaaaaatttgtttgggaactaaataggccctaagccaaattggccagatgtgatcgatcgttcaaatgggcaattatgtttgctaggcaaaccatgtggccggaggccatgcatgtagctatagagaagactctggacgaaagacttgtggagttaacggcacgtacggtgccgcacagggttatccttgacacttctgctttctatcactgctgctgctgatgatga

SEQ ID NO: 69000 - DNA, 740 bp, Oryza sativa
catgctatatttacaaatctgtgatggaatagaaaaagctaaaagaaaaagtgagatcaaggggaagggaaaaaaattttggggttttttttaaaaagggaaaattagatctctctccccttgagccgttggctcaagggggccttgaccgcgccctgatcgggggcgcccagcccaatggctggtgggcgcccgtcacactgcgccatataaaagaggggtggaggccggcacggcagagagtacgagattcaccgccgccgccaactccaccctacaaaccctaatccgatcgagagggggcgcagccagtgacgggaagcgccaccgccgcgccacacctcatcgccgggacatctacgaccgtcactcccgcagccgtcatcgccgtcgacctcaccggcgccgcatccacgacaaccgagcgccaacgacgatgatggccggcacttcttcatcctccaacacctcaaccggtcggtctatctaaaccctctcccgttttcaatctctatagttcaaacatcaatcccaaatagaaccacccgactagatctaacctaggtgatcctatcgcaaagtctaacaattgttatacaacccctgctactaactaatccaacatatatataatctatcgacaaatgtggagactgtattgtcttattccattcatttccttcgcttgcctgcgccaatatccatgaaaggtggatgaagctgagtttgactaacaactc

SEQ ID NO: 69001 - DNA, 15416 bp, Oryza sativa
tataacgttgaccatcaataactttaaaaatatttagtttaaagaaactagaaaaacatatatagatttgtctttcaaaacactataataaaaataaacaagtatttatttattgtatatattataatagaaaaatagggtcaaaggtatattttgtagagcgtgtcattgtccaaagcgtcaattaaaataaaactggagggagtagtacactatttgcatgcccgtaagcaattgtttttaacctctcgtccttttctacatgatatacaagtaaaagtttgactttagagcttgtttggtttgataccaatttattaccctactaaaattttgttaacttcaataatagcaagtgcatgtttggtttgctaccaaatttacccacaatagtttaaattgaatactactcctactcaatttggtagtatcgaaatttgccaacattttagtactaccaaaattttggtagggcaaaaattggctcagaaccaagcaagccctttttgtgtgtgtgtgtgtgtgttgggccatgcccaacaaattaattaattgcatgctactagtacttagtagctacactctcaaaaaaaacttttaactacgaacttagatataaactatgtccagattagcatactctccatccttaaaacacgcttataatcttctcattcaaaaagacctaacctatattgaaatgtaaaatttcagaatgttgtactgccacatctgattttaatgtaggttttttttttagagaaaatctattctataccactgagtttgttcgagttcaacaatttgtcatcggcattgtctctttctataatatactgacgactttatcaattggtccacaatacattgttgggctggaccttcttttcaaaaatacccgaaatacccttagagagatataagattaacaattgatttatctcataaaaagtttcaaaaaaatataaaaattttatgtggcctccttacacaatatggaagtttatatacaagttttaagttttttttttatatttattttttagaaaaaaaatatttttatggggtatatgagagagaatttgcttatacaagacataatagcacaaaaatatcttatgtagtgttatgaaagatgatttatattaaaaacaacaataaaaaggtattttatatagcatataacaaataagttatatcttttataaaaaatagaataaaaaagttgaaacttctatacaaatttccatgttgtgtaaggaggccacataaaagttttcatattttttgaaacaacaaattaggtaaatcaattgttaacactgtatgtccataagggtattttgggtatttttcaaaagaaggcctagcccaatagtgtattgtaaaacaattgataaagtcaacggtatattatagaaaacgacaatattgatggcaaatcgttgaactcgaaaaaactcagtggtataaaatagattctctctcttttttttacggaggaagtacatcataccagtcaaatagcaaaatataactacaacattatgattttttttaacggcgcgtagtcccttctactcgaggagcacaacatggttaggcagtgcatgatcttcgcataacactatggttagactatcatacttcaagctacaaacgtggagcggtttctttcggatgtcggagtcggtgaagacccagttcaaaaacagattataattgttggatgttacatgtatatataatcaatataacattaatttagcaatacaataggcaacactatattaattaatggataatatatcgtaataactatatacttaaatgttaaataacatgaatacatagtctccataatataaaaacgtagctacacaagtgtgagatgagacgataagagcctcagactaaggagtctaggttaattgataaatgatgtgatggctcgtgttgtatgtaaccagatctagcggttacgtgggttgacaattttaaattatccggcatatggcctatcggataacccggtagaaatatctaataatctggatcactggatctagagatactatattcgtattcctattcacaccattctatttgcatccgcattcatatccatcagatttctatacaactatactatatccgtgtttcagacatatttgaagggggagcggagcagatatttcttttagattttgacctttattcctagttatctccctaacattttttttcttttgcccgcgattgatcatcagagagtgataagtgactcaataataaaaaagattgatttggtttgctacatataccctattcccaaaaaaaaaagttctgcctacaaatatgaacataggttatgtccagatttatggttagaagttaggctttttctcttgacggggaagtaggaaatattagtaggtaggtaaggattatttgagtagagcagatagcaatcataccaaacttttgcgcttagcaaatggaataatgtcgaatcaactcaatttggtgatacatccaactaacacactctaccaagttctggtaatgcaaaaaactattcaagtatggacacttcaaagatttgatagcaacgcgatcgagttaaaccaaactaaaccttttgacatgtgcaaagtactagaataacattatatgtgttttggaacggagagaaactaattaccaaatcttttaacgacaattcattatttgcttaacaaattggcctagctccttattggccccaagtgaaacattgctttctacatgcgtgcaccctgattccaattattaacgggaccaatagactgttactcagttcatcttttcaaggcattttcatctattcctgagcaagtactatgattatagtaaatatatacacactcatcgatgcaagttagagggatacgtgtctctgacacgtgcacccatgagagtgggtcctacctaacagggatggatgtccctttaactttacgtaaaaagaactacttccatttacattatgagtgttggtagccctaaaattttaaaaataattttaggggcggagtttagaatggagcagtggagtggtccaaactctactctatcattctagtttattttaagattactctagcttgttccacttcgcttttagatgaaattaaaattgtttggttcagttttagctagaggagagatgaagctaaaggagaagctttgccaaataaatcctataggatgggaagaccccaagaagtacaatggcaaagtttggttccttgccaatatttttgacatcaaaccaaatggacccattactactttgccattaccaatttttcctttttgttgttaaggttgagaatggatgcaatccacaagcccccctaatcccaggtccccgcaagtgcacctttgatttggcggagaatgatttggttggttggagtgctgtctcagactcaaattctcagtgcttggcgctgacagtgaaggaaacatcatccagatgtttgttggttggcttttttggtttactatatatactttggtcactttggtgagtactagtggcaaagaccagaaaagtgcctcatttttttctttcccgaatttattttaccttttaaatattaaaaataaacatatcaaattttatttttaaaaatatgaacattttgccacactatcctgacgtggcaaaataacacgtgtcagttttatgctgactacttcagtgtgaaaaaaaaagtcagatttaaaaataagtattttgggggaatttgttttttaaactagttgaaaccccgcgcgttgctgcggggataataataagtaaaaataatgtgtcaaatagctaaacaacataagattatgtaagttaacatggtttatgataatttaagtttaaataatatatagaatgataattcaaatgtaaaagtaagatgctatgattttatgaaagtagaaaaatgttgagatagtttggacagtatattaatcatctaaaggctaaaattaattaaggtgatatggattaatgagagaagaaaatgagagataagttggaccatagattaatcttttaagcactaaaaataattgatatgatatatgacttaatcagagaaaaaagaaataacattaactaagagaggatgaactatataggtacatagcatattataaaaataatgaagatatatattgaaatataatatgaattatgtgggatgatgatttaacacgcttgcattttgaaagctctaaaaatttaataaattataaaattatagataatatagcatgtttgcatgatgtttaaatttaatgattgttagtggatagtgatatgacatctttgcatattaatatttagtagttagtgggttacaactttataataagagatgataaataattattagaaagtttgaacaaataaataaaaaaatcgctgccatgtgaacaacacactagggctcccatcggatgacctattcagccaaagaaaaagcaaaaatttaaatttttaaacttaattttgacattgattttgagatatttttaacgtaatttctttttcagcattgacttttaagtcaccaagaacacatatataaaagttttacctataaatttatttttattctttaataagtcgttttggcttaatacgaaaaaagccaaagaggcccctaggagagtggcaccactggcaaagcagagtggagctgtggaggatcagcagcagcagctttcccttagctcgcgagctcatcagtcatcacagggcggatcgagagatcatcgatgggcgaggcggagctgagcctggcggcggtgcgcgacgcgctggtgcgggaggaggactccatcgtcttcgccctcatcgagcgcgccaggcgcccgcgcaacgcgccggcatacgcggccgccgccgccgccggcggccgatccctcgccgagttcttcgtccgggaagccgaggttctgcacgccaaggtaagcccgccacctctcgttgttcttgagtcttgactccccattgattcatgattcagtatcctgcccaactagatccccttacgttttctttaccaaaatcgatcctttttataccatgttgtagtgtagcatagccatgatgaacttgtacaggaagatttttttttgcctggtgaaatttctgaggccaatctttctattcagtcaccttagtgattagtaaactcatggctgaggaattcgtatgtgaaattcagtcacacagatcttacaggctaggcttgtatttcgttaccacattgtttttttggcagtagtttatctaccttggtctccactgtaccatgatgaattgaaagatagcatcggagggtaagatgctgatatgtccattctggtaatcatgcggcattgcggcttatgttggcttgacgaattcattttgagtacctcgaacggacacacagtatcggatgagatttatattaacaaaagaatggctatgctacatgtgtaggtaaatcatgtgttttaaaggcacttccatttacggatcattcaacaagtgaaagtgatcagaagggaaaaatagtgacgatggagaaaaaaagtttgaaccgtaccatcccctattaataatagaaaacataaatgatttactattatttttcttgtactttactaaatgggaaattttgttatgctatttttcaacttgtatatcttatccagcatcctattaaaactgtcaaaatcaatcaacataaaatacagcattggtatagctatgttgacagtcagatattagcatattaccatttccaagcatccctctacagaatctaattacatctgtgaaatctgataggccggacaataccaaaagccagaagatgttccattctttccccaagatctcccttcacctctatttcctaccaaagattacccaaaggtaaatactaagctttacaatattagttacaatgaactgatgactaatgattgttgaggttctgagtttttattgctttgttgttaggttttgcactcttttgcatcatcagtcagtgtgaatgatgcaatatggaagatgtatttcaacgagttgcttccactattcactgtggatggagatgatggtaactatgcagaaacagttgcattagattttgcatgtctgaaggtacatgttctgtgtttattgtttcttttagatattccatcaatttggtcgttctttaaaaaaaacataaatctagttgctactaggatatgttctttcaatctttcagcacgcgaaagcaaaatttgcacaaattattgcaaattaatggtaaattgtttccaatcagtgtatatctgtgaaatgtattgatcatttctttgtaggccctgtcaagaagaattcatattggtaaatatgttgctgaggtgaagttcaaagatgcttcccaagattatagtccactaatccgtgcaaaggttgtttttagttaacatctcatactcactacaccaaattttcttaaacatcttgcaataaacggttgatttatagaaattgtgaatactccttggtcttattctgattagcttcattcttatctagcttctacttagtttcatgtgttagatgtttaactcctgcatacactccatttcttggtaggaactgcctgctaggctgctagcattgggcctttaaatctttaatttattttttgaagctgatctttaatttattatatccctctcttttcaacaggataccaaggctctgatgaatctgctaacattcaaggcggttgaagagaaggtgaaaaggagagtagagaagaaggccaggatatttggtcagaatgtcactttggaggacaatgctgacaagcaagaaggcaatgcaggtgacagtgagtgcaaagttaatcctgaagtgctatctaagctatatgatctgtgggtaatgcctttgacgaaggatgttgaagttgagtatcttctccgccgtcttgactgattcgccaaaatattttcagctgcaaatatgatgaacacaattatgtaagcacatataaatagacttattgaatgtggcatgaggaaatccatcaagaacagctaacagcggtgacttgctgtagaatttccggtactgtatcttggatctttcttcatctccgttttcggagctgagacatatagggcctgtttggtacagctctaactcctaaatttagctccaagagttgggtctggagtggagttgtggagctgcctaaacccagctccacaactctagttcattttgtgagagagctccacccagctccactcccagttttggtggagctgaaactgtttggctgagctccagctccaggaggggtagagctggagctggagctgtgccaaacaggcccatagattgatggcaatgatctgcaacccaaaaggttcatcctacctaactgtggtggctgatactgagggcctggtgaattcccagcaaagatgctgcaactccagtttctgtaacaatctgtaactcctgttattatatcaccatagttttgtgctacttcttggtagtagcatttctgttcaagcttcccttaacatcaactaagtttttcttgaataaatatttcaacttgttcatctgagttgtgtacaaggcaattgaatttgcttctgatttgatatgcatatccaattatccattccatcctcctgcatgatgtggacagcaaattgaaatgccaaaaagttttttcttcctccttaaattgggccgtactcttgttgggcctgggcctccatgtctccccccttcttctccgaccagcaacggccatggcagcggcggcggtcgaagcttggatcgcaccggggatgcaggtcttcgctgcggaagacgccgccgccggagaggagcccggagggtggagaggagagcagcgacgccaccggcaatgccaagcccagcatccaggtccgtttcccctcctctctgctccaagatttcacctctcgtagaggtgacttctctcatgtggttttctcatgtgattccatgggtggccttcctgccctggtctaactgatgaatataaatgcaaatgaaaattgcacacagttgattatttattttttttgaacgaatcgacgaggctgccaatttcattgaatagaggagacgaaaactgtacaaaaaggataaggtacaggaaaaaaaaaacagggccgtggccctaactataggcagttacattgtcaaccaggcggcgagattttttccgcccgccaacccccatgtttttcttcctcctttatcttggctagcagagttagcgccggcaactccttgtgctggaaagtcctccggttacttttgttccatatctcatagctaaagcacacagttgattagaggttagctcatgtggactatcgtcctgcctcctgatggagacttatattgtcgttaaatgccctgcgatatgaatatcagcatcaaatgtgcttcttgtttactgttcaacttggtttaaacatgttgaatgctgactggacaggactagatatgaggcattccaaacttagttgacaggcattgcttttgacagcgtaggtggtttatgaaataatttatccttttcctaatgttgactgccactgaactattttcattcttttcttaatgttgactgccactgatctaatttcatcgctccacgttgtgtcaagacagatgaagtgggatgtgacaggaggggagttgttttggtggtgagtttgagtaccagtggtatatatttttgcattattgtgagtagtcttctctagtaaattactgtttcagaaaatagtttatttatctgtttgggcataatttacaatgtcttgggactaaacattatcatccactgtataatatttctttaatgatgacttggtgccaccttggcaccttctcattttcctgattctttccagcaaatctactatttttcctagtcatttgctttcttaacttcagtacattcctcatgcaccagcaaggccaattaaagggtattgttgttgcatcttcttttttgtctaacttttctaataagatcttttcttctttgctcaagtggatcactagctgattggacgtttttttttatctctggcaaattgtagtttttagaaatctagaattcagcgcatagtttcatgcaggcagattggaatgattatgcgtattccatgtccacattgcggtcttcattaggcttaggtatggtgtcaggacctagtcataagttattctcagtctgcatatgagagccaacaacaaatatgcttttgtgtctttaatttgtagcctcctatttatgttagttctttagaccaaaaaatatcaaagaatgttctttgaatagtttgaataaattttacatgacatctgacataaacaattgcacttttgtcttgatacaaacagaatatcttttattctgttctgatgtcactaagaaaatgatttatatgcacctcaatgttgacttttaaacttgtccttttgtctctactaatactcccttatgtccttttgtcgctactaatactcccttactcccggtgaaaaaaaaatgtcatgtagttccccttagaccatcgcatttcctcgcttgtttgatatcgtattcctaaccatttaaacatcatattgttatctagtatctttcatacaggttatttcatttcctccaaactatctcttgtttttctttgctattcttggctacactctgtggacgatgctagaggaatcaatctgtcagtggtcatgactttgcttcttatgatcttatccaggttttagaggaaaaataggaggacactaggttatgaacataattatttgttcttttgtttgtatgttgtttgtatctggtattattgtctgaagaaaatccaagttatgattaggtttatgagggccttgtccagggcctactgattagaatttgagttccttttcatgccatatggggttggtacgatgtgatcctaaaatggatatttttcttctatggacttagtttaactggccccatcaaattgatgtctgaaagtttctttttttttaaaaaaaaatcctgggatgtatgaatttaatatatcatatgtgatcttgtgcaagatgaaaaaattgctacaatataagtaatcacacccattttttattatcctttgctttctgaaactttactcattcagtcaatgatagttctttttttttttcagaccagagaattcttcagatgtaattgttccctttgaattttctgattgatgacagcaagagaggacccaagcacaggctgtctgaatctgtgatttgcacatgtgttatttttctcttgttacacagttaatctggtccattttgatgatggaatcttcagggtttagacttagtaggaggcaagtgctaattgaacttactacactattggggtgtaatttttttttatctatattccaagctgcaaatttgcaatgaatttctttttttttttttgcatccatttgcaaagcttgcagctcacacacgtcatgtatggtgatgtatttacaacgtcgtcagaataccaaaactgaatggagtttcagaattcccgagggtccacgaacaggacggacgacggcggcgccgtcgtccagtcgtcgtcgtcgccggcggcgggggcggcattgccgttggcggcgacggacgtgattttcttgatgcaccagacgtcctcgtcgcatgagaagcgtcgccagtgcggcacggcggcggcggccgggtcgtcgggcgcgacgtcggcggcgacgacggcgcacgccgggttgttgcgcgccacgttgtgggcgtggcggcagagcgtgcggaggagcgcggcgcccgccgggccggacatgtggaggccgtagaggaggtaggcgccgaaggggcggaagacgtcggggacggaagggacgcgcagccacggcgcgcggcggtcgagcgcgcgcgccgcggcgagcgacgcgcggagcagcggcggcgcgccgccgacgcggaagctgagggagcgcgtggcgtcgtacacgctgagcaccgcaaacgacgacggcgcgccggcgccggggctccgctcgacggcgaggtacgtgccgcgggtgagcttgtgcgcgaggagcgccgggaggtcggcggggacgaactcgggcgccgccgccgccgcggggagcagcgcggcgtaggccgccgcggcgagcggcggcggcagctgcagcacgcggtgcgcgcgcgggacgcgcgcccggtgccggtgcacggggtggccgaggaaccgcggcttccggaacagcgcgtacttgaaccggccctggaacagcgcgagcgacgccgcgttcgacgccgtcgtcgccatggtcgcgtacgccgcgcccctcgccgcgcaccactcctccgctctccgcaccagctccgtcgcgatcccgagcctcctgcaaaagaccgaacacctcgtcgtcgtcagcaccagctagctcgatcgccatcgccatggcacgtactacaaagcttagcttggacacgcatgcatggtcgtccatggcggcgtggatgatcgatcacctgtgagacggcgacaccctgaggccaagaagacacgccgccttgacaaacttgttcgtcttcgtcttcgtcttcctcaagctgctgctgctgcctctggtcaccatcctgacacacgccttgatcactcccacgacctcgtctccacactcagcgacctatacacagatcaaagcagccaatgacagcgcattaattacgcacgcccaagcaactaatcacatcaagaacatcactgtaagattaacacagtgcatgcaacaacacagtgtcaggctgcctgtcgagattcgctgtactaggacatatttcatctggtcctaaatttttatattttggaacggatggagtagctaattaccaggatgacgtggtccggagcatggcgaacccgggcgaacgggtcgccgatctgctcggcgtagagcgacatgcctctcttcttcttcttgccgccgccgccgccggcgccgttgtcgccggagaggccggcctggcagaggcgctcgagctcctccaccgccggtaagtccttctccatgatgaactccctcactctcaccatcttcttcccagctgccatgatcttctcctcctcacccatctcagtatatacttctagctaattgtcttgtggttttgtgactaatcaagcttgtagctagcttattagctagctgatcctgactgatcttgctgggtgatgaattctctgctgctgctgctttcttctcagatgggagggaaggagctgggaatttatacacataggttggcaggttagggatgagagtggcaggttgtgtgtattacatgtgggggccatgggaggagaaacaattaagtaattaagtaattggttaatgggtgatatgcaaagtaagcatcagaaggaaacaatggtggccttttgtataatagcttgtgtgagagcttgatttgatcattaggaggattaacaagtgtgtgtgtgtgcgcttgtgtatgatggcatgcaaagctagccctggcataaaatatatatctttgtgcttatctaataatgtaggacctagctaatgctatctctcacatctctctgcagtcatccatgtcctatcattagcttgcatctctcctagcaaatgtgttaacctagatggagattaatggggcctaattaattacaagtttacaactagttagtgatccatgttagcttttagctagatgcatgcatggtagaggcatgcatgcatccttgaattatggattatgttgtgtcaagttcatgacaccattgcaattaatttagctaccaagctacaatgacatataccatgatataggaacactactctttaaataaatgagattctaaatgtgtaactttgcgttttctatatagactagctaagatcacctagcttcgatcctgtatatcaaatcaaattaattagaacatttttttagggtgagaaaagtggcataaattaattagatagaacataggccaaaacctatcaattctagggcatcaatccaacaaatattctggacaaagcaagcatttgtgattatgtactcaggatataatcttagggcatataatatatgtctctcctacacaagtgagatatatatatacatggaagaacaaaaataataatcaatccagggaaaaaaaacactttgctaactagagaaactttagatgtgatctaatttattttggcaattggcatctttattagatcatggcagcgtaatgattgtgtgcattctctcgttaatgcagagacaagaagttgtactttcattatatctttaaggggaaacataagagattaactttggatgtgtttttctctttcctcataaaaccaatgtgctctggaggatgatgatatatgttggatggtttctttttcgtgagggatacatgcatatagatgaaattaaagattcaaattaattagtggatttgtcagttgtcacaatcaaacttaatttttttctcctaatttcatttcaattataagagagaagaagtctcaatcggttgatgtgtcattctgtcatatatataggcactatttgggacagaatctccacaggaaatctcaaggagaaaacacgctgttttcctgaaaaattccctgttcttgcgtctttccaaatgcagtggtgatgtggtgattgttacataagtcttgtatattctgatgtgtttttttagacaatataatactaattaaaaaataatctgatcagtatatgctcaagctatttcgtactggtcagttaaataattagtatgtagctgcaggtctctattaaccccaattagttaagaataattactagtacttcacttgtggacttgtcgctgtgcgtgttcaacaacttttggtcgattgatgcttccttgatcctctagtaaattgcacatgtcttcttcaatcatatatagcttaaattgtactagtgttaagatataattaattaccgggaacttgctaatgacttgctgagtgttttcttgtccaatcctaggaaagtttctgccctatataatactacatgcttgggttacagagtaattaagcttatcgatgacgaaaggttaatttattctatacacgcagtcaagtgaattctgaattaaacaggggacaatgtacctttcgtaaaatcttgtttaggtgatatcatacaaactaatatatacaatcattacacattcgtgcacatttagcgtaaatttatgtgccttcccacaatctataggatatgatcggaatatttgatgtatttggaattttcgagcttgtgtagagaagaccatatatggcgttcacgaaaaaagatgtgttcgggaaagaccatatatggttgtagatgtagtaaatatgcgcgttatacttatttgtcgaaagatgtggtctgcctattaatttttctagaattaacgacaaattaccatttaacaaaaagatttaacaacttgacgttaaaatgctttctctatcgacagacatctgacgcgaaatctggatcatggtgtaatcaacgtaagcataaatttgagatcaaattaagttaaatcgatcagagagtgtatttcaagatatgtatttacagtcgcgttgaaatatttacagttgatggagcatatttatactactttgagctagggacgtatttacagtacagtagatcagagatccagtgggcgagggtgcaattatcgcctctgttttagtaatatggtagcgtaagttagaaaaattaatggtcgattagccaatgaaatcttgatcaagatatagtgaaaagacgatgaaaaagaaaatattggagaggagtatatttgtacaacttgtgtagcttattagctaatgaactaccaataatgctaattagatattgagcatatatgaaagcacatattgactaagctagtggcgtgttaataattaaggttgacatcgtcttgaccaggcgagcataccgggttcatttccaattaattagtgtgacatgtctacaagtgtagtaccattaacatatatacaatctcccctcgaggaaaaaaaactttataatctatacattagaggaggtcaaaaatagttgtgttcacattgagtgaagtctatatacaaaattagttagcctgtgtacaatgcattctgaattttattgcctccaggagtgctatttaatttagctcactgtctgtttgtatgct

SEQ ID NO: 69002 - DNA, 11032 bp, Oryza sativa
acctgcaattttttatatacacttgttatatcattcattactgttttgtactgttttgcacgcagctgaagtgcattattcgtattctctagccacagttaaaagtacttttcttctgacttacctagtgttcctgacataaataacaagattgtatgatgaacagggactgcatgtcaagccaacagctggtggatttcatccacgagcatatacagaaggtaagttaattttccttttctaattccaaataccaacagtgaactttggaggaggctgtagtacttaccaattcagtacttgccgtgtgaaaaaacaaaatgcaggagagcagtctttctgcagtgtgcgaaagagtgctcgacagatgcctagctccatcaacaattggtggagagggatgtgacaacatgaccatggttctggtgcagttcaaaaagcctattactcagaataaaaaagccgacgtaggggagcaatctgtgaaaggtgtggaagaggctgagatcaagtgagtagaccttcatgccaccatatctttctttcatcaatcattttatgtaaccccttgtcagtgcactaactcgaaagctttgtgaccagtgctgctgaggagaatggttcttgacgccgatgattatgcagacatttgctttcataagcaggccgagtggagcagcagtcactgtgtgtgtgtgtgtgtgtgtgtgtatatatatatatatatatatatatatatatatatatatatatatatatagatatatatatatatatatatatatatatatatcaattgtttgtcaaatgatgtatctgcacacattctgctcaagaactcggagataaatggcactgaatggagcaactgtgaaaacctaatgcgcagtttttgtgcgccatccaccattcgttgtcatgccaaaaagttgaccgtcctgattgtggatatgatcacaattgtcgacaattagaactgatcaagttgctgttttctgttctttgcatacgctgtaaacgtgggcgagttttttgttctgctgtttttttttgggtgtgtgcgtgtgatagatatgtcaattgcaattcatgccccatttgggttattgcttcagatcatgtccaatctgaatccagtttatcatgtgatatctgttggttagttcagtgccgtgctgctgcggtgctgccctggtgtggtgaaaatgtatgcctgttatgcatatggaagtatggaacaatttggggattttgcaaaaaggaggcaatgcaattacatttcatattataaaatttgtctcaaacccagtatgtgaaagcataatatctgacaaaaaaaatagattatggcatgatgtgaggctttaggccgtcaattagattatttataatgtgacaaaggaaggacaagatctacacggatgcaatagggaatgaccctccagtgtacacatgtagtctgataagacagtctatttcaagggacattcgcctgaatttcatctaaattcgaccgaatatctataactaaagataataatcatcacatggttcaaacactaccgcgaaaacaaaaggctagtcagccatctctacattgacaaaaaccacggcaatcgagacaaataacagttgatttcacctaggattagcagagctgtgagacttctgtttcgccttctctatcaggggcttcaactgctgcctctcctcaagaatcttgaggaaattgaacaagaatggcacatagttgtgcttcctcctgatgttctctgtcttccacttcttccacttctcttcctccattatgatcttctctgttacagcctcaatatgagcagcaacctccgcaagagagtgctcaacagatggcgcgtgcctattggcggaaggatcacccatctgtgccaggaggttctccctcttcctctgaagctccttgagttctaaagtgaacttctccctccggttctttaggatagccatgacgctgaaccttatctcattctgagagaaccgatcgatgcgttcctgaatgacaggctgcaccatcctcagccaacctatgtcgccaacgccacctgggcatttccccaggcttattggcccttcctttagcccatcaagctcatacaggacaccgtccacaggaacatagctaatgaaatggtagacatcatcatccttgacagatgatttctgctcctcggggacttccggccttgcaaatgaattactggccaaacggatgctctcagaattgactatagccaatcctttgagatctggtggcaagtcctttgcaaactcctttagctttttgagctcctcactaagggtgatacccggagagtttaatagaacagaaacgatagcttgggtggcacatgcattgttaattatctgtaagtgaagcattgagttgatcataaaaggatgcagaggagtgaaggctacacaaaaataaacatataaacagctctgacctgcttagcaaagaaaaggtttgggattgggtccttgataggacgctcatctttttctggaggttgccatttgtacagcacaatgagcccataaactggcctggaaagcaccaagttaagttggtttagaaaagaatgaaatttatgatactgctagcaggtattaggattacatactgaagatcattgagggcatccagatcgagtgaatagagttcatcaacctgttaaggaggaataacatagaatgtcatatattaccattcaaggtcataaaaaaaattctagtgtcacagatataagcaaaagtagaacaagatctccaaaaacatatgccagtacattgcatgcatgttttgccatatgttttaccaacaaaatttggcaacaaggttgtatttgaaaagcatagtttttattattcgtgagctaagctaaaaatagagtttcaagaaacaacatcacacacaaagtgttcaatacctgaaggcaaaaacatatattttcagcaaactttagagcataacaaagaatggacttaagtaaatgggttacatgattacttacttgaagacccttcagttgcatctgttgcaacagttcagtaaaaatgcctacagaagatatacaaaagaagggttattgcctacttcattggggaaaaaaaaagccaagtggccaacatttacaggggaagcaaggaatttaacactgaataagaaggtgtaacatggcagatagacctagccttttccaattccaatgaaatttgagttatcttccataacagctaattgactgcgcctcctgttcaatgtgtcccttaggactactggactagaaattaccagagaaaagctgtgaaacaggcgtatctgcccacatctcaatccgctattaccatcgaacactaaacagttaaaccggcagctcagaacaccaaggtccaacagcaagcttggtaatctcatatgctacttaaaccatagatgatgtttctttagggtagtcagaaaaatggcccataacttcaggaggagttctctccaatcttgtgatgagtaaagtggtactacttactactggtagtagttgtttattaaaacacaaaacaaattctaaacaacaaaacaatgtatagagtcgagtcgccgaaaattcagaatttgaatgaaagtcacaaatggaaggtagcgaaactcctccacggatgcgcagagaaagcctagttgaattgttcatatactacaatccatctcttcttttgtatttctactccataaaggtaattgaattttaccaggatcattctcgattgcagcccaagacatgtcgaagaagaaaccctgcgcaccctcctgcaggtctgcagatataatttcgcgtatcaaattaaattgaagcatcaaagaagttatggagaaacaagagctgcctgctgctgcaagaaaccaaatcttgagctaaaccaaattagacgaaagaagaaacaaatccaaccaaagggcttcttcccctaccaacgagagaaaccgacggtccgacccggcagaagctcctcctcctcctcctccttcacgaaccgcgcgcgtcgggccagcgtcgacggaggtggcgcgcggcgcggcggagggagcgaagcggattcggcggcggcggcgcgttggtggactgcgtgcgtgggtcgtcggcgatgggtgagattggactggagagagaagagagagagagagagagagagagagacggagatggttgggcctcacgggagggagtagggcacgggcccatgaaagaaaaaaagtccgttttcaatccctcaacttcacgtcaagtttaattgacgtcccaagtcgtaatcccataaatcttcaccctttatctttgcaaaaccattcacaaaaccattcaagttatgaagtactaagtcctaagccaatatgaatgtgtggttttgactgacgtggcattagaaaaaaaaaacatatggggctcaagtgtagtagacttccacctctcgctgcctatcccctttcttccccatctctcccttctcttatccaacagtagagagaaggccacaaggggactcgacttactcaccataaaaatttaaacactaaaagtagctatattttaggaattgggatgtaacggatgaagtagcaatgagaactttggcacccctttagtaaaaattgagtttattccaagcaattttgttcgaggatggatgaatttatagtagaatttcagtttgaaaggcagcctcaattttccttatgtgaagttgatgccatgtgctcatgcgtgattgatttgtgagggtttgcatttttgaaatggaggaataaagcgaaaaacagtagtactttctatatctttgtcgacgtttgatgtcgcgattcctgtatttgcatagtatggggatcgttggtactaggatatattcgagattgtagtaaaagaagatggagacaaaaattttatacaggttcgggcccctgaattgtcaggtaatagccctatatcctgttggccgaagccggttgttgctcttattcaccataatcacaccagtacaatatttagggtagcctatctatctgttatcgatatagcggactgaagtatcatcgcgtagtcgacaacagagtaatcttcctcctcgaatccgtgccctgcgagattagagacagcgctagattcctctctttggttcccgtaggtaccatatggggctttgctaggcttatctctgatgtcgatatctggcagcttgtcttggcgtatgtaggtttgtattggcttgtggctttgtggcgtctatgttgtccgtgtcccctctcctcttagggggccttgtatttatacccataggtgtctccttatccaagtagaactaggaaaaccaatatagatacaatccgagtagtccatgtcgtttccatgtagaactctagtcatccttccttatgcggaactcctcatatatcccaatgttgtttccgtataagacatggtatgtggtgggtcctaccaagatttagtcaactactattaggtatgtggtatctataaccatcacaatcttatatagtcacgattagcataaagataaaaagaaatattattggatcaattcaataaatataatgtgattaaagatatcaagggtgaaggattaaaaaaactcccttaaaaaggatttaaaaaaacaaatttaaaggagagaggtgctggttaattacattcacgtatatgtaaaattataagcttttttgttataacaaatttggccatgttatttttgttacacaaatctaaacaatagatatggtcaaagctaacatataaatcttggctgcccagattctgaaatgatactacctctattttatattttaacttattttgatttttttgtcaattttttttaagtttgactaaatgtatagaaaaatttagcaacatctacaatatcaaattagtttgattagatgtaacattgaatatatttttgataatatatttgttatgtgtaaatatattgctacatttttactccataaacttagtcaaacttaaaaaacagagtacatttcacaaaactacaggtattttgcacaatttatcacgaaactacagatttaagagcttgtttcacaaaactaaagatttagtgtgttcggttatcacaaaactacaggtactttgtacaatctatcacaaaactacagatttaagaacttgttttacaaaaatatagatttagtgtattcgtttatcacagtgctacacatttagtgtcttcatttatcacaaaactacagatttaatgtctccattctcacaaaactacaggttttagcattgttaaaacgtgtagttttatgagaatggagacactaaatctgtagttttgtgataaatgaagatattaaacctgtggttttgtgaaacaagtttttaaatctgtagttttgtgatatattgttcaaagtacatgtagttttgtgataaacaaagatattgaatctgtagttttgtgaaactagttctaaaatatgtagttttgtgatagattgtgcaaagtatatgtagttttataaaatttactctaaaaaaatattaactatgaaaaaaaataaaactaggattgagtactactcatgtgtactttgcattatgaaacataaaaaaattactatcatgtctcatattttgagatgagaagaatgccaaaaaaaaaaatgtatcctcagattattcaatttgtcatttacccatctctctctctaccttttctcttcaacgatatcctctatcccaaaaatcgagccttttcctccccccttcctcctccaccgccgcccatctcgccgccgccgccgccgccgatggctccctccaccgccctctctccggtggccttcaagtcctccttctcgccgctcctcttcaacccgacccgtaagccatcctctccctccatccttctctctccgcgcggcggagtcagccgtagccgggcgctttccgtcgtcgggcgccgctgccagcgcgcgcgcgcgcgcggaggaatcctccacggcggtattcttcggagcccaattcgatcggggtggcctcgtctccgatgccgccgcggcccaccgctttgcctggcgttcgtattatcgggtggcctcttaactctaattagtgcggatgcgagttgggttgctgtgcttgcggttagggtttcactgggcgttaaaagagagaaaaagaaattcattaagtctcaatttagttgaatgtttttgcggcggtgtgtggggggagattgttgcgtttgtgctgttctaggtgacggccggaaatatttggtttgtttttaggtttgacaataatcttttcgtcggttttcggggtccttgtacaattctatcatttcaaccatgtacaaagatgttccttttttatgttaggaattggtttcatttagttctagtggacatacgattctggcatgtaggtaatttatttcattatggtaagttttctgttgtagtagtatctgtttattcagggaattgtataaaatggagcattacacattagcttagtccttgggcttccgttctccccttttcttttgatcggtggagctttgatctttgttgaccagtgcgtccttgttgattatttttcttatgttatagcaacacctgaacattttgcacctgttgtttctttgttgttcaggttctaagataaatgtcgaaggtgcattctgtttgccatgttacaataggaaaaaggctagcaatagatcctttcgcgtgtacagtttatttgggggaaaaaaggacaaagacgagaatggtgaagaagcaccatcaaaggtaagaaaattagatgccttctttcaatttgaacttctgttgtactcccaataactaaaagagtatcttcatggatgcctgaaatgaaaacaattgcaaattcacaggtggatgtctaccttaatcagttcaatactatgtgctattcatatctttatacttttatctgaatagtaatatgctcaagataatgccttgctcattgcaaattctgttgaagtcttaaactcctgtagaaaatagttaagagtgtaactcatcatgttgatatttcagttcgtgctgaaattaaattctgcatataattttaagggaatataaaatattttaactaatatgtacttttgttatcacctctactttatagcttctatgttcagttttcttctctttccaatgaatgatgccacttctaaaatgataaacttttactttatttgggtatttgtatagttgactaagatgcatgagctgtattcactatgttcccttgtttgtgcacaaatacctagtatagtaggcatttttatttttgtttgtaaacatcttgtagttctcatttttgtacttacttttaggcaggaattttcggaaatatgcaaaatctttatgaaactgtgaagaaggcccagatggttgtccaagttgaggctgtccgggtgcaaaaggagcttgcagcgtatgcatttggatatctgagtaatatttgatatgttatcgctaaatagcacagcagtgtgacttttttcctcttgttttaggactgagatcgatggttactgtgaaggggaactaatcaaggtatgctttggattagttgattaatgttgttgttaactgaattcttgctagctgtatgtttcattgtgccttgaacattgaagggtttctttgttaaatgactgacattttagcattgttgaaaaagcctgttgaacttgagccaggctataaagatcacatattatcactgacaaacattgatctttgtttcactgagaaagggcggtcatttcctacagtaaaaccaaatatattcccttatatgttcttatactgaagaatggcatgtattttttatgatcttaattaggttgatcgctatatgaagtaattaaaatcatttggtatctcttttagctttggcttagataaagttatgttgaaaaggtaccatcttggcacaagaacactgtcaaatctgtgggcagggaggtggttataagtcatcaaatgatttatggtggcataggttgttaccgtttgaaaaggtcactgtcttaactcttaaagccatttgaaaatgtgcatgttaataatgtcttagcttttcaaatgacaaaaataacgttgcaataccttgacattttctcccatgagctaagtgctatgctggtatattttgtagagccatatgctgtcaaagtttgctaaatcttatttgtttcttataagtttagcaggactatccgattattacattcctttgcttttctcgaaagtagaaaatcacatgcatatacttccggtgcaagtatttgacctgattcattaaccaggtaacactttctgggaaccagcagcctgtaagagttgaaatcaccgaagctgcaatggaagtgggtgctgaagtatgtattttatctaccattttaatcattttctttgacgatttcttgcatgttcgcatgatttttggcatgagtcaaccatttcaatgttcacacatgaatttgataaataccttatgtatgtacccgttagcagaccaaaacaaaaccaaattgttcaaagtgtgatatatatagtatcctttcagaaactttctgagctggtgaacgacgcctacaaggatgcacatcagaggagtgtccaggtgcgaatcctgctattactttttgcgtagaaattgaaacttgcgttctatactaacacggtactgtacttaaaacctgcaggcaatgaaggagaggatggctgatctggcacagagcttaggaatgccagcaggccttggtgatggactcaagtgatagtgtggtacatgaatgcttttcaataaaaaaaaaagtgtatctcaattttgtatactagctgtattgagtcatcagtttaaaattcgtggcgagtactgttagctgtgtaagaactgtaatcgagaacatctgatcctgttttccttaatcattggcacaccataatgcattgacgcaagtgtgctgttttacaactgctgttgatgtgcagaatgaaatctgttccaaacagagaaatgggtggatgtggggaggctaattcatggggcacttggcacttggctgagctttatatagtttcagaggccttaatagtatataatggctttgtttggcccaattaaggccattgttggggtcaatagtatataatggctttggttggagatgtgccaaacaaggtcatgttaggcccaacttagcagttgttatttctgtgagtgttagcatgagatgaaactgtctactgtcttaggctgtgtttggcacccttttcccaacctctcttcctcgttttccgtacgcacacttttcaaactgctaaacggcgcgtttattggcaaaaagtttctatatgaaaattgctaaaaaaatcaaattaatctttttttaaaagctaatacttaatttatcacacgttaatggaccgctccgttttccgtacgtactgtttctggaacaagaaatggcaaacacagcctaaagtactagctcgctccgttttccgtgcgtactgttcctagaacaataaatggcgaacacagcctaaagtactaggctcgctctttcatgaacttccatggaagatggaaccttctagttcgagtctacactctacacatatagtccaacggtaagcaaaaaattagaagaaaagaaaagaagatgtatcactcacctttttatcagatctcaaaagggtgaaattaaccacacttccactgaaagctcacacaaaccttttaatcaaatctactttcccaaaatttaattaaccacattcttttccaccgcctgctagattttgtagctgtggtaatagggcacgtaagcctaatcttagtggcagttaaatataaacacaacaaacaaaagaaacccacagtgatgggtgcaggaa

SEQ ID NO: 69003 - DNA, 9355 bp, Oryza sativa
cttgacaaatagctgtacttttcacctttgctatactttcacaaattctctttctaaaatcatgttaaccaagaaactatatagaacgttcagttaatcataaagcttacactcgactgcctgcaatgatttaatggaaattctgacttatactagcatgattgcacaagaggaatccaaatacggagtattacaaaactaaggctcctttcatccttgccatgccataggttttcacaagcatgcacatttttcaacttctggacgaaaatagttcagatcatcttgttttggagaaataacagcagaaacgttgatgaaaatatggaattagtaaaaactccataaatctaactaaataaagttagttagttagttagataatggtttcagaggagagagagaaagaggattactaaaaacaaccctacttcctccaccccaaaatgttacgtagcatttttttaggtgggcacgggtattaaggaagtaggtagaaatgattgaaggaagtttgtgattggttgagaagagaaagtaggtgaagaaataaatggagaatggttgtgattggttgagagggtgtggtagaaatagctacatttcaggacggatgtagtactaaatataccagttgctcagcacatgtaaatcataatattctaagacctcttttaagattctaaaagttatagtcagcttcactgataactgaaacttcttcccgaaggaacgaagtatgatgaatttggaaatgcttttaagaaaacatataacatgagccatcattatccttatatgtcagacaagtaaaagtcatcccaaaattatttacacttcactagatggaaatatggctatctgtgtgcttttccatacagtccacaagcaattagtcaagcaaaattatttacttactggaataattattgaatgcgtttgaatgcgttttgtcaagcagaaatttgtacaaccctcgtgtctatcaaacgcattcaatagttggtatcaactttgtagatacataagcagacaattcacaaaaccatgatgctagcgaaaagtaaaatggtgaaaaaatatagcatgaatcatttaatgctcgtggttggcctctggattccgattatattggccatatggccatctaagatgaagcagcggtaccacaagataccctcttctagaaatcaagtattttttttcgtttacctactgcccttctttggaacagaccccccatctttggactttccacctgccattgccgaatgaataaaaaggccggtctcttgattaattggagcaatagaagaaacaatgtatatatccatcatgattttcaatctacaaagagtaaagccaactacaacaaggtatatgaaaatgtaaaccatatcactaaccttcggaatcaatcctcagcttggcattgggatcaatcacacctcctcggacaaacttcgacccagatgtgctatcacccttgaatgactccacaaattcctcgtacacacgtgccgcttcatcttgctctctctacacagatcagaagcagttaaaatcagatatggatagaatgtgcgtgcaaaaaagtataagtagaggtgtctccagaaagagatttgaaaacccttaccttcttcctcgcctcttcgttctccttatgtcggtggaatggaaccttcttcgaactcatcctaatcctaacataaaattatcaacagatcatcagaatatgagtagcaagcacttgaaaatcttattactctaccaccctgcatgccatgggcggatctaacatgggacatgggggttcattcagttcaacccccaaactttttgggaacaaacaaactgttattagtagtattaaggttaaggcaaatttctagaacaggagctagggttaacgcaaattcgataaaaaaaaaaagtgcgtgggtcgagagagatgggaaagaggatgtgctaaccaggatgctcgcttgcgggatggatggggatcggcgcaggcggcggcggcggtggcggcggaagcagcaggatgagcgacggcggcgcctctgctcgctcgagggacggattggggatcggagcaaggccctgccctgggacgacctactgatttttgttgcctctctaaacccgaccgacctgtgttccaaccggtgaattatagaggtgtctcccggcccggcacgaggtcagtcgagccggcacggcccgaccgtgccttgccagcccacaggctgcacccacggcccaggcacggcccaataaaaacgggccggcccgagggcacggcagcccatcgtgcttctctatagaataagtctatttgtactccctcaactctttgggctgtgtcttacatggctgcctggctggaaaaaatctattttgtattcctcatttttttttggccttgccttatatggttgattaagtctaatttgatccctctactatattttcttcgaccgcgccatgctggatcggcccaccgtgccgaagcatcgacctaggcatgacccaactatcgggtcgtgccgtgcttggaccgggccaaatggtcgtgccttgggccgggccatcaggcctcgaaccttatggctataataatgttatactatattttatttactctatgctttgaaaaaatattttgtataaatatttttatatgtcacttgttatgttgatatatgttaagtttattttaaatttgttctaatgccaagtagatactcaatctgctcaataaactgtttcatattaagtattagactttcttcgttttctagtggataggcagtagcttatcccagcaacacagcagaacgtagccttaatcagccaaatgagtatcttagcttcatggtgactaacttgtggttttacacgctcgttgaattgccctacctcacatagcctattcatatgcctcgcagtttaacatagtaataaaaacatggttaaaaacacatgcatctataaattactggtgaaagtctcttcggttttcacgatagtgttgacattggactagcctgatttatatggaatatacatgtggcttttttgccttttttttctcttactcctagcctactagtaaaaaatgcggagtttaaggctttaggcgacaacatgatgacttcttctgcatgcacaaactaactactatcttgttacttgatgatggaagtaaattgataattttattttgaattggtcactctatttttttacttgaatatattggacgcgttcgctagttattgctacagttgtgttacatgttgtgtgtggcggcggcaatacagtgcatgcgcaatacaaccaatcaaacatgttcatatattagaatcaaactcattggtaatgatatgatatttatattttttgtatagtaaataaataatataacaacaaaattcataaagtcacatcgaaaataattatagtttagagaaaattggacactcacgtgaaaaaaccggaggggaagaaatccacggtattctattccctacgccgcttacccttccaccggaagcaacactctcctctcctccaataattaactccaacgtaaattctgtaatctacaaggacccattcgcaaaaacatccccgcagcaattctgtatactactcccgcacggtaagctaagcctagtccacttttctattcaacccctcgacatctccctttatttactttgcctccttccccttctcgtcctcctcttcctcatcctcctctctctctcacccctcggtctcgctggttcttgctaacgccacgcacgctcgctgctgaatccgtcttcccggcgaagaaggaggaggaggagggatcccggcgaggcggttgttcgcgcgtgacccgctcggtgaggtgaccctctcggcggaggagtcggattgcgtcttggagaccggttccgtcttgtggatggtcttggtgatcgagaagaaatccgtggcgggttggtgaaccggagacggggaggaattgggggaagggaaggggggaggaggaggaggagctgtgtgttcttgggtgggcgcgccgcgcgttcttgcgagattgggtggttggttttgattgtggtggtatggtagaaaaactgcagatttaatctgaactgcgttggggggagtggaagaggaggaagaaagatcgggtttcgaggcgggggggggggagatgagttccgggtcggcggtgacgggcggcggcggcggcggggcggaggacgcggcggcggtggcgctggggcagaagctgccggtgcacgtggcggagaacggccacaccttcgagttcaagtgcggcggcgagacccccgtggaggcaatccagcgcaccatcgagggcctctgcggcatcccgccggccgaccagctcctcctctgcgggaacacctcgctcgacggcgcccaccatctcgcctactaccagctgccccgcgacgaccgggaggtgttcctgtacaacaaggcccggctccacgacggcgcgccgcgccccgcgccggagtcgatcgaaatcccccagccgtcgatcccgccgccgccccggccacaggattccccgccgctggatgtgtcctccgacccggcgctgaaggccctggtgtcctacgagaccacgttcagataccacttccaggtggggaatgccgtgtatcagtctagcgtggcgaagcacgaggtgtgctgccggctgctgcgggaggggcaggtgcaggagcgggcactcgacaccgcccggagcaacctggagcacacggcccggaagctcacgcagcggtattcggatttcgtcaagtgcttctcgcagcagcatcgtggccatgccgagatgctggcgaatttcgagagggatgtggagaggctgcgcgccgtgaggcttcacccggcgctgcaatgcgaggggaggcgctccttgattgacctcgttaaggagaatgacctgaggaagctggcagatgggtgcttcagctcacataaacagtttgatgttaaggtctcacagcacaaggccaaattcatggaattgaagaagaggcttgaaaatttgtttaatattatgagctcgactgggtgcaaggatcttgaggcgatgataaaggaacacgagaaattcatcggtgaccagaaaatcatcatgcagtctctaaggttagacctaggctttgaacatgttttttacctagttatcttgctgttatgttacatgccctccctgaactactattactagtgaattccctgaatcatctaaatttaataattactagtgaattccctgaatcatctaaatttaataatttacgctatgcctttgttctatggcttcactaaactacttaggagaaatttggaaaattgtgcttctattgtgtcactacacgttaagtgtcaccttccactcggaactacttttactaatgattgatctggatcataggtgcggcgtgttttgtgctgtagatcttcatgaaactacttaggatgaggaaatgtttcagcatggttagttgatggttttgcaaaaggaataggaaatctttcagcgtggttacttgatgtctgcaaaaggaatatagcttgtcatcgtacttacttcatttgtttaattatttcatgcactacggttttctacactaattgcaatgtgctcagtatgaccaagtgttttgatgcttatatgattatatgttatatcccactctaagctggaatatcttgtgtcctgcagtaaagatgtgactacttcaaaaaagcttgttgatgactgctcaaactgccagctttctgcatctctccgccctcatgatgcggtttctgcagttggccgcatctatgaagtacatgaaaaggacaacttgcccagtgtccataatatcgatcgcttgttcacaaagttgctggagaaatgcaaagccaagaagaatgaaatgaataccttggtacatgttagcatgcaaagggtcaaatctgctcagattgttatcaaggaaatgatgaacgaactccatgcattccaagaggtgatgggtcatcaagataaaattttcgatagcctaaaacttgccagtggcatgggtcatgcgtacagggcttgtcttgctgaggtcgtacgaagaaagtcttcttttaagctttatactggcttggcagggcagcttgctgaaaagctagccactgagcgtgaagctgaggtaagaaggcgagaggccttctttaggacatggagtaagtacattccagaagatatcatgggttccatgggactttttgattccccaagccagtgcgatgtaacagttgctccatttgattgcaatcttctctcaattgatgttgatgatgtggaaaaacttgcaccccaatctttggtcgggtcttttctgaaatctgagagatcacaactgccaaagtcctccttgagcaattctggtaccagtggaaatttgagtaaatccgagcaatatccgccgaatgctgatgataagatggatttccaagactttctggggggttttgacagtgtggatattgctggaactagtaaattggaagttgaaaatgccagattaaaagcagaacttgcttctgcaattgcagttctctgcagttttggcgccgaatatggatatgaatctattgatgaagggcaaattgataatgtactgaaagatgcaagggaaaaaacagctgcagcactttctgcaaaggatgagtatgctaatcacctgcaggcaatgcttacagcaaagcagaatcaaaatttgtcctatgagaagcgcatccaggagcttgaggagcaattagcaaaccagtacatacaagggcacgtgatttctggaagcaaagatgcatctgattccctcctttctgcatttaaagctaatgactgcaacttgcacatatctggagggaggcaaacccaagtacgcgatgaatcaagtgtggccatggatgaggcctcttcaacatctgagcagccatctaaacaaacagaaggtggggatgagaatatgaccgacatttcaggtgcactgaacttgcaattgctcgatccaatagcacgcactaatttggatgctttcatggcagaattgccacctgatagtgaacataaaattgttgattctgataaggaagggcaagtattgacacagtttactacgactgatacttctggggttcctatagaagatcctcttggcatcttaaactccagaactaacgagcatcatacctcagagctgagaaacaaagagctgcttgtgtcagagttgcaaagtactctggaagacaaatcaaaaaggttagatgaaactgaaagcaagcttaatgccttggtggatgaggtcaactctctgaagaaagaacttgaacacacccagggtctgcttgatgagtctcaggtaagtcaagtgggaggtagaatattcagcaatagttttttttttcatgctcaattgaaattgctgcttactttcttttacaaattttaatatagatgaactgtgtgcaactggagaactgcttacacgaggcaagagaagaggcccgcacaaacaaatgttcagctgacagaagggctgttgagtatgatgccctgcgttcatctgctctgaggatacatggtctgtttgagagactaaataactgtgtcactgcaccaggcatgtctggttttgcggactcactgcgtgctttagctctctcattagcaaggtatcttactgctctcattcgcttaaactcatgtgtagtcagttctgcatttcatttacaaaccacccacccccaagttcgttgtgctgttgggcttgatccatgccaagtctatggaactgataaaataaacaagaaaaataggatcgaaggaacttctaagatttgctgtatcttggttcaacatatccaagttattagtgatttgtgagttggcagtcagtgagaccgacaaaataaacagcagaatagaattcatggtagcttccaggaagtatgtccagattttctgtatcttggctcattgttgagatttagagaggcgctggatgttattttagcgagacatttttgcataatttgtagtaaacagagctaggaagatgttagatgttatttaaccttggcatgctttctacagtgagtagtaaactgttcttatattttgggagatgttcttatattttgggacggagggagtagtaaactgtattttgtgcttacagtgaaatattggtcgtcaaaataattttgtgttccttcagatgattgtatgtttttggtctttttgctcagagtagtttcctttgcatagagttctgttactttataaaagtattagcattttcttcctttggatcccctactgctgtagagttatcgaaacagcagatttactggctgagtaatacttttttattgaaacagtgcaaagaaggatgaaggtgatacaaccattcagtttcagcaatgcatcaagatcctggcagacaaagttggttttctatcacgacagagtgctgagctgctagaacgctactcaaggattgtaagagtgttggaggagaagaaagagtcgattaaaaatttgtacagtaagcttcaactggaaaaacaggtacgagtcgtaacttcttaagccactgtttttattaaaataaatgaattcataagaagccaattactttgaaattgttttagtttaaattccgcgctaatcaataataagcacatattactctatgggttaggttgagtctgttaaattttgttgattgaaataacaagacagtatcctcggttgtcaatactgttcaacaggctagtaaggagaagatatcattcggccgtttcgaagttcatgagctcgcggtctttgttcggaaccctgctgggcattacgaagcaatcaaccggaactgctcaaactactacctatcagaggaatcagtggccctattcacggagcagcatccacggcacccagcttacataatcgggcagattgtgcacatcgaacggcgcatagcaaagctgccctcgcacggtgaccagatggaagcttcacgccttgatagcggtggccgccggtcgcccgcttccatgctgaacccgtacaatctgcctgtgggatgtgagtacttcctggtgacggtcgcgatgatacctgacaatattcgttgaaaacgccttcctgatcatgcctatggctgctgaaatgaagggagaaactctcaactgtaaatatactgaaactgaaatttatagacttccttggttgcttgtggcttcttcatcctgggctgcagga

SEQ ID NO: 69004 - DNA, 85647 bp, Oryza sativa
  unsure (1)..(85647): unsure at all n locations
tttatttcttttaggattgtgcgtggatattctttggttatttatcaacgtatcggatatttatcgatcacgggtattcaggttatctgactgttgcggatatctcgaagacattaggaacctatagcaaggcaagtcactacactctcttccttgaacatattgatcctagatttataaatattttgtttacatataaattgcatgctatttataaagtgcgtacctatacttgattatgcctacccttgatattgattacctttatacatgttgtatgcctttgaatgcctgagtcatttatttatatgcggtcatttattgacattgcttagcactgccattatagacatacgcacactccatatttatgttagataaatatggatgtgggatcactcgatgtgagtgatcgatgatttgcaggtggaggcatgagcgccacctgccacacacagatattttgcgaaaaccaaaacttaatgaaacaaaactatttcgactggggcggcatgagtaaaatatgggtggtttaggaaatggttggtcgccgaccctagttagttaaggaccgagtcaggaagctatgcgggaaacaaaccaagtaagactgcacttcttacgtatgagcggacccgatggattaggaagctcttgcggggcggcacctcagtcatggtaagttctgtatggatacgatgttgaggattgcagtgtcggaaagtgagtaaaagccatggtaaaccttaaaatgcaccctataattatatatatagtaaatatcccccaatccctggagcgccaggactcccctcaccatccgatagtaggtaggttggagtgccggggtgcaatgggggctcatagtccttggagcgggtgccgaaatgcgagagcgactaaaaaggcgggccgtggcaagtctcatgtgttgggcaagccgcggagtgcgggattaaaagcatgcatccactgcagtgtgagtaaaccaatctattcgaatagccgtgctcgcagttaatgagcgctgggacctgtactgtgagatgctggaaaacccggggacttgaatcccggttcctcctcatgcgtgaaccgtgctagttccacgatcaatagctagcacacgccttcacaatcttgtcatcacatccatacaaggaaatacatacatatggatacaaggcttacataacttagcgcaaacggatgacatacatcactttgggccaaatggccaataaaagagagttaaaatgcagcggaaagaatatcaattatatatgttcatcggtatgcccatctaccaaaccacacaggcaaccgactaggaatcaccctaaaaagaaccatccttgaaactccggtacccgtcgcaaacactcacatcctgcaatcaagactaaaaacaacaagaggtgggtcaatacatacgtattggcaaaccctacccaaaaccttgggaaacttaaaagtacttgcaagctgagatcaatgagggctatatttgtagttcattttcagcataaagcaaattttgattcgcaatagtaaatgatagtaggttgctatgaaatttgtaaaacaataagcatgtaagtagagcatcatagtagtaatataatagcatcataatcatcatagtaatatcattcttgtgccctccaaggcagcaagcaacatgtctcattctcagcccacaatgggcaaaatcaccatttcccaccttacccggtttcaccaaacaattgaaagccataaaactatactcatgacacttcaccaagttgctcatgaccgtgagcacggctaatcgattagttttagactctgcagagtttatacaactttacccacatgatatgaacactctagtttgtttcgtgctcgcgaagcactaccacactctacacattgaatgcggtctagaggtcatgacaaagccgttacattgcttaatgcctaaccttgcatgagcacggcaagtgtttatccacactaggagcaacccaagtgccgctaggtcggggggccctcgccatccctagcgccgtggcagctaacacatccgttcccccatgaggcacttaaccgttatattggacacacttagacgcctaggcacagccacactaggtagctcctataaaccatcattccgactagttcatactactacggcctcccaatgcaaggtcagacattaaacaacttaataagctaaggccatcccattcctagcacatgtggttgcacggtatacttagatggtgacacaaagtttggtccttaattgactagggcgagcactccccctatcgatatgcaactaccaccatatgcacatcacttgctgccccagtctaaaatcatcatttttcagttttcctttttcacaaataacagaggcaacccctctgaacaatatttccaaatatcccgagtttgaagagggaataccatgtatttgtaaccatcgtaaattttctaagcatggctaagcaagtagctttagttttagctcgaatatacccacattggtgcttagacaacacaacaacccatcctaggtgtatcaacagcaagggtaatcaataagtcaaggtaggcaatgcaacaagtaggagtcgttctaccataacccaagtttaaaacatcttatgcaatttataaataacaaagcatttgcaacatataggattcaacatgatcgaaggaggaattgaagagggcttgccttgatttgttgtcacataatacttctctggtcctgctcacatcacgaatgaatccacaaatatgccatctattcaattttaaacgtaatccaaatgaacaccaaataaacaccaaaaataaattatgcgcaaacatgcatgatactggtgcagtagatagaacattattttagatgaatttaggtgaaagaattttaaattttcgataaagcatgtgagagatattaacagtcaaagttttatatgcggtcagcgacgtaactaatacttctctatttaaactggcattgcacattctagttttgcaaaatttgaccttacagcattaaggaaaatattattatagacctaacaaaatttggttcagtcgaaaatgatttaagatgaattagttatgcatttttgaagtttgcctatttttcagttttccaaattccccgtttgaactgtgcttttgcaactcgaaccctgagcttttatttttattacaaagaggtcctgtcttcttctccaaacgagcagagacagagcagagccatggctgagctcgatctcgagctcgcctgcgtcaaacggcggaccgaatgaggtcggggttaaaggagaaaatgcagataaggtctttgtgattccgtttctctattcatcccagccggcggtggacggagatggccgggaactcgtcggcagctgggctactcaaggactgcacatgcatgtggcaatgcgtttgcgatccgagcaaagagattaagagagacatgcaatagcaccctgtggctcacaggaagcttaccagggggtcggccaagggttgacgagctccggtgaggtcgggcagcggggtggcggtggagtagaccggcggcgacagtgacacagcgatggcgggatctacatcatgcatgccgaaatcattacatgcaacatgtacaacaccatcccaggttgctactactgcaagcaatcgaccaatggctcaccggttggacgggaatcgacgacggaggcgctaggtcggagtcagacaagacggtggtcgatctctctcctcgatggaccattcttggtgattcttggggcatttcatagaggatgatgagacgaagctagtggcgcagcagctcattcggatttgcctaggggcggcgggaagacggaagacccttctacttgggcatggatcaagctcctaaatgattatagcatgcagaaaaatagagggaggtggcagagctgctcaccgcataagcctgtccatggcggctggcaagaacaggaggtggcgatggcggcaaccatgctccagcgacggaatcctgaactgagcggggagatcgacggcaggcagcggcggctcttcatgccgaggaggaggacgacagccatggtggatggtgcaacttcaactggcttgcatgtcatcacaaacatcgaaaacagagctatttcgatgtggtacacgcgttcccgtgtgtcctgtgagctttggttcgtcggagtggccggggacttcatcgaacagctgagggctcccaccggcggcagggaagacggcggcatttcgggcggatggaggcagtctttgatgggcgaagtgagggtggtgaaggaggagagtggtgaatcttgtgggcaaggtcttgggcgctttggctgggtttacgacataagttggatggggatgtcacgagctcgtattcacgttcacggcctcactgcacagcgccctgtcctggcgacatccagcagaacggatgggacaacacggatgggggagtcttcaaggctcgaatggctgccactctgccagaggtggagtaaaggagaaggatttggtcggggcgtggaggatttggccgggacggcgaggtgacgaggtcgacacggctcagccatacccgcgctggggcgcgtccatgtggcgcgggaggttgggtcggcggacaaggggttgtacagcgtggcttgggtgcagggtttagtcgagaatgaggggtggagccaggtctgggacgaattgaagactggggcgctcgttgtcttcttcggaagacatagcacgccacgtgttcgacggattgcccaagagggcagagtgtggagaagaggaagggaatgggttgggcgtctcctggggctttactatggatgacaagtggggtcagtgcttccagggcccacgaacagaggaagggtgagtagataggccagtaaacacaagatttagtcaaattccaggatttttccctctccctctctttgaaaatcgatttgaccaagatacctaagggtagacattatggttgatttttgtggaggtaggctgtggtgcataggttccatttttcaagatgccactccaaatttcgaagtggattgctcccagaaattcaaataaaagggctcttgctgaaggtttgttgaatttttagaggggataaactgactgaataaattctggaaaatttatattacttcatgataaataaactagtatcttaataaattatataatgtatatgtttctgttcaatttgtttactatcctagggatgtatcggcttagccgatgatgattttgaattaatttaaatttgatgggtttgtttgggctatcaatctaactgagagctatctatgatgcttagtatttatgttgagtttactggaatttttagacacatagattagtcaggatgatttcataattggttgtaaggcatatgagtgcaattatggatgcatataaaatccaaaaacaagccaaaataaacatgcaacacacagggggcacactctattccttagcagtcagcacaagagattacacctcgaaatgcttggacttcgcggtactaagatctaggcaggctatgctagctcgcgcttaattagttcgctcaattcgccttaacacgtggcctatgcttcaacatactcgccttttatgcttgcgcatggcttgctcttcagcttatatggttcaaaaatttgcaagccatttgataggatttatttactgtacccaggttcaatagcttaaattttatttgtcgtcccatatttcttgtgtgtgtaggatttgattagtcacgccaactctttaggttttgttgataatatttaaaagtgtcatggcattctctctagattaaacactccttatatttgaccttaattatcattcagacatttagtaaaaaaaacattttctagtgtcttttattctcaagcatgtgtgctcgaatgctctattgtctttatgtggccgtgtctaatttattacttccccacatcttgattttattttctttgccaaaaatgcacagggaggaacaactccataagtttttatttttaatgatttcagaataactgattttcatatttttatttcttggtatgtcacatgtactacccttgactagactcatagattttaatactgcatagtgtagagatgagagacatgagaaccttgcctaatgagtgggaaggttagtatagagttggtataagatgaatgtgagggtaaaccgaaccaagcgaggcttggagaggtggatgaaccctggataattacaacttcaacattaacgttgtttttagttaaaactgctaagtcataggtttgtgaaatgaattgtgaaaactagctttatgcaaataaaccaagccatccttgaacccctgtgtacattagattcattttgtagtagtggcttgctgagtacgtatgtactcactcttgcttaattaaatcttttagaaaggagttggagtcgattatattcatgccatgctgctatcaagtacgtgtcgaagacgatggattagggatcatagattcaccagtcgttgcctgtggagttggatggaccgcaactgcttcgcttccactattcggtatacttctttggaattttgtaatgtatgtgaccatgcttggtctattcaggacccatttgggatacccttgttttactattgtagaaacatctgtaaatgatgtcagttgtgatattatattgtgctatgtgtgtaccacctattgatccagagagtgatactatatgacacatgggattaccggtgtataaaaccgggggtccccacagacatactttgtaacgtcccgcctcttttgtaatgtccagcctctcccaggtcgagcccgcttacatctggcaactttcataggtcatagactaccctcacaagtcttttctgcacactttgtctactgatccagagtggtactgtatgacacatgagattaccggtgtataaaacggggggggggggggggagggtcccacagacatactttgtaacatcccacctctcccaggcttaccctcatagcctaccctcaattgcttcaggcctcccaggcctatccagagtggtacatctggcagctttcataggtcatagcctaccctcaattgcttcaggccaagcactcttaacctcagagttctttagagatcggcttccggaaaagaagttgcaacatgttgatatgagtattctattaatcctattaagccctggtccggaaaagaagttgcaacatgttgatatgagtattctattaatcctattaagccctgggccgggatgtcacagggttgttacacatcaagtggaccaaatagaactttataatatgtggtaatatgcgcttttaaattcgcatcaccatttatcatctcgtcaccattttgtaattgataaattcttgtttacctatgcttaccatttgctgccaaataaaaatatttagtattggagtctcctttcaaaatatttttagtctttagtcacaatataattctgtaaatacattgtaattacactcgacgactatttgtattgcaatgaaacgaaccagtcatgggcataagtagcttgattgtctcaacgtgagtcaatgcgttaatgataaaactgggtccaatctaacagctcaatcggttaaaaatcaatttgctcattgctcaataattatgttcttgcgggttttggctgattggatagatgtgtatgggaattatatggatttgcttctttcctaatcatttttcaatttgcgagttttgacttttggttgattggattggaattctatggattttaggtcataaaattccatataatttgtgagttttccctgacgtgaatgctgtgcaatgtagattntgtggatttgcttcacttctgtggacatttttatgttgaaccaaactaacaatgatgctaatccaggctacatgcttgttgtatcggtttattggctgcaggtttgttaatggaattttggagaatgagttgtaggatcgaaggttcaggtatttttctacctcagcttgtgctagttattttgcactattatatctttgtgatttccacattaggcaccaattaattcctttttttctatgcaaattgcacttccatttgttgtagttgccatattttagtcatgtactctgcttttgaatttctgcaacttcaattataattttcagcaaataccttttgctttcattatagctggattttctcttgaacatgttgcgcataataaatttttagccaatcatggattggagaaacaatacagttttgtttctgccgatataggatgaatatcgccgtttttgcaaattctattataaacatatgcaactttagttataaattttgagcaacaataacttgccatagttctggctggtctctgcgggcttgtgattgtttttgtgtgtttggctctaaacatctcttgttttaaatttgtttcttttctcccttatttcttgatttgcctataaaatagaaccagtagaaatgaaattttagatatctagcatcttaaaaacacatgctatatcgacatcatatgaaaactatgttgattggtaacgtttttatgattattgtcaacatatgtcgagggctatatttgttttttggcatgcagtagaccatagatccaccctgtggggctcatcaggttgatttgctttttgatggggatgtgatgggcaatttttaaatcaatttcatgtatgttgattcttgatttgattttgtgtgttttgtgttctgataattttctcttacaactagacaaaaaatttgtttttttaatagcatggctttaattaatttttccattctagtaacgtttatgtttagccatctacaacatgcagttcaacagtttttccattggtaaaattagaatacaaaataataaaaaaatgttgttaaatttgttctatgtcatttttacacttccctattgttgaggtcgccattttcaaatctgcaaagttttggttataaatttgtgtaactttagttataaatttgtgcaaccattgatttgtttttctgtaattatttcatgtttgtgtaggattggcaaagggacaattttaaatgttccatcagaagattacgacttgttttggatgtaattgatcctaaatgtaatgtgttcagtgaaacagatctttgtattacgagtatttaccttggaaaactttgttatgtgacatgttcttccacaaattatgtcggttagggggagaccataacagaaggcaaattttcagccatgtgtggtatcaaattttgtataggtcaatgcatttgttgtttctaaaccagaagcatcaactaatttgatttgcacatatactattcttttctatcttaattctgcataggctaactttcgttcttgatgcttcccaattgagtttttttaagagaacacatgataatggacaaaaagccttgaaaattaagttcttttgcccaacaatggtaaggaacaaaagcctgcccaacatgcattggaaaaaaaaaggcccaaacgcgttcaactaaaaaataaaccacaacaaagtctcataaggatttagtgggtacccgttaagaattcatgtgggcccattaaggttcctagttcttgtgtatatatgtacatgtgatggcttcttttattgtttctctgcccacctttagatccgcagcggatggcctaataaatccattgatggggagaggtaaataccatacgactgccaaataggcaatcccaatttaattagtaattgtttgatcgttcgtcaggctccgtcggatgctagctgcctaaccttgcagctcttccacttatgtttttttctttcacgtttcccctaattcccattccgttgtttcacacatatttatattgctaatccaaaaccatctctcgggtggcctctattcatttatacatggccattgaacatatcaagccaacatatcaattatgtagttttacagaagtaatcaattactaatggtctatcatctattatagtgcttcctattactgatctatataacttggagtagttttgaagggacataaatcaattactcagttttattagccatgctaatcgatcaacaacttagtatttttaaactgggatcaacaacttaattccttcaccccttcatcagtttggccgacagcgccgggtgacccacctatttctactataagtgggttcgttgattggcccgcttgcgcccttacagccggccaaataacgagttagcaaaaataacaatattaatcattgatttgttgtgctgtggtattatgatcaaattacttatctatcctttaacttaaattttaagtcaagataccttttgtcataaaccgttaaattagaagcaacgaacatatcttataaattccaagcacaataaaaagatctcatatatgacacctcttcaaggtgatgggaaacaatagcccacattgataagacccgtttagattcatcttcaaagctttgcatatactttctcataacagaaagtatcatagatatggtttgagttgtcagtgcatgattaagtggtttaaaccatattgtctatatacactcacaagcaagcacgcctttagtaagaataaacggaagggactacccattaattttttttcaaaaattggtcaaatgtaaatacagtgtaattacattgtagcttatatgtaactgcagtctaatttgttctaacatcctgaaaattaagtagtattttctaattatgcatcatgccgattcttatgttcttaataacctcctaaacttaggaaattaaaaattagaggtaacctcctaaaattaaccttcatagaatccgtctatattatttaaaatcttttgtggtttttattttaaaattgatcttgttaaaattgaggtattttctttgatttgatttttgaatcttaaaccttcttataacaaaattcctttattcaaattatttgaaatccttttatgaattatggtccaagaaaccctccaatattacccgtaaacctaaaccaaagcaattccaattttattggaattatttcttaaacccaacctttgatctagaccttactctaatacttctccatccaaacattttatgattccttcttctccatccaaacattttatgattccttctatagatattccaattatcaaattcctatctagtctccaatttaatttatatagctcaattccctcctaattctctcactggcacaagaatagtattattaaaaatattgtgagtaattgctcttgtgataggaaaatatatttgatccttccatcccaaatccaaaacctcatttagcccataattaattctctaataaatatcataccacatattttcctccctccgtattcctttcagattctcaaaaatatattcaaattaggaaccctactattcatattcataaatacccctccctcatttgagtgctttgatatttagtccactatattttatctctcaaaatattcaactcaaactggaaaatatctctttttagaaattaccttccaatataatttcctttcaaacattcccattcaaatacaaattctatctaaacaaaactctctcaaaaatttagaaacaactctctgggccggaatccacttccttctcctctcggcccatctcccttcttccgacccatcccttttcctcttctttcccttccctcttccttccggcagcagtggcccaataatttggcacagcccagccgccccaagaggcagccgcctccttcctccttcccgtgggtgctgccaccgtgcgccatgggcgccaccgtgcgccgctctaccattgccacccgccgcttgtatggctttgagtaccgcctccactgacctgctgtcgatgccagggaatcatcgccgaccttattcatgacgtcatcctgctgaggtcagtgtgccgttgtcgcccagacgaaccaacattatcgtccaatcagaagacgagggcggcggttgtgctcttcttcttcacatcaccgtcatcgtggccaagtcgacaatcgcctctcgccgcctataaaaggacgatgccccctcccccctcccccccccgatgaaccctgatctccacttgagaaactcacgtctatgattggcccgatctttcggtgagttgaagataattacgattcgggataaacgttgacctttccctcgggctacagtgtcgccgcccattgtaagttcaagtgccttaatttggttttggtgattaatgacaaatctaattatatgagactaacgtttttacgagcctttctttgactagtcttatttggatatgaaaataaaaatgatgagaggtatgtattaaacttcacatattctaacttggtctctcttgtgaatccaaaatatagtgtgagctccctcattgatcttgattgattatgtgcatatgtgttcctttatatccatatgtatgcacatcttgagggggagcttattctatattttgtttattataagatttctatcttgatttgaaatcatcttccatctcatctctctaattgtttatatcaggttattatccatcaccaaagagagaagattgaaagatcttggattaaacaatttgtgtaattgttactttggtgatagatgataaaccgatgtttatgggattaacctctcttttgcataagttgtctactaggttatttcccgataatgaggtgtggaagacatgcattattttttgatggaccttaatcatgacaaggatgaaatgcatggagataaaacgatatgtaccacttcttatctcctactttttgataggttcatatatatgatttccatgttattgatatataagtgtgaaactaatgtttactcgagtcttatcttatttagtctcatttacattgagaacatggagatcatgaaggtatatgttttatgttggtctacatcattactacatatgccttctctatgtgtataggataaacccccattgatcattctctaattatgcatacacttgcatctcttgtatatttatttgtatgcatatatttagggggagcaaatcctatatatttattgtgcatgttctagatctatgttgttcactgttggcggttgttaaatgccgattctataccgccaacatctgcataaagttcggataataaaacatccaacatagtgataggtgcttaatctcacatattccacaagtgttggaatatatttgtatgcagacgacaaaccccgatgttgggaggaaaatcagactacagtgaggagattcacgtatccatataaggaggggttgtaaacttcatccaaacaccaataattcaacccaaaactccgagaaatggatagaggaggtccaggggagaagatgggccaagagccaggccagatgggcccagcccaggttcggccgaaccagagccatccaggctggggttttgatgaggacataactagctcggatataaccatgactaccttatgtattaatcaaataaaggtgcatatgttctacattagatttacttgttatatatttgaacaaacgttgctacacaataagtttcgtgtgtttttgtttgcaaaggtacttacttgggcgaaagaaaagagaccgagcgtaaggaatgcatggatgaaagaagacgatgagggatgttaggtcctgatcttccgataggtattgataaacagtcaatttgggcggagtcgcgacacaactcgatccggcttctgaatgaatacactactgagccccgcaatcgcagcaccacgtctcctctggttatcaaccgtgccgaaatccggttgacctcgccgagagggctaatccctgcatgcgaatcgaagaacacaagcaagaacaagatagattgcaaccaaattgcatatgaatgattaagcactcgaatttggggtttcacaaaccaatctagcggcaaaacagttcttgatagaataatctaagcaaaacccaactctaaacgatgacggctactgaattaatatgattagggacgtcctagggttgtcctagggcgcacacccccttggcctaagcccacgacataattacaaggcccaaaactcaaatcagattcggactggatgagatacgtggtttgttttgcagtttcccggcagctcggtaggaattttgacgtgggaccaaaaccatctgaaagtagactccataagctttccaacaagtactcatgggccgtgaaattccttctagatcagcggctaggttcatttgaagttgatgctgtcaggaggcccgaatccgaatccaaaacgtgtaaaactttatctcttgttttctatgaaccaaaagtgacgtggtgagataaaagaagacttggacaaggtcttggtttggtccccaatcaacttcttcaatcatccatgcattccttacgctcggtctcttttctttcacccaagcaagtacctctgcaaacaaaaacacacgaaactcattgtgcagcaacgtttgttcaactatataacaagtaaatctaatgtagaacatatgcacctttattttattaatacataaggtactcatggttatatctgagcaagttatgtcctcatcaggtttggcgtggacgctccagatcattccctaatggcggttacggggcatttcggacatttccccttcgccaaccgtcatatctacccctatataaagacatcagtccctcacttcacacacacacttccaagcttgagctgaattataagaggctctattgtactatattgtatactagaataggaagagagtagagtaggagttggaagaattccggagttgtcgctaatcttctcctatttcttttattctgtttattactctgaattcaatataatattcttcttgagtaatttagatttatcttgtgagaattatctcttggttagttcctaaatagcatataggattattgttcactataattaactaaaatatagtgattgctttgatgagttataaacactaaagtagatattaattgcttagacgtggtgtttaggtaattgttatccagtaattgctgcgtatcccacagtacgtttgaggtgggtgtagaggtggtgacagccctcgagatcacttaagtcctccctgttcgagtacgtagtagagcgacatctggaaacagtgggttgccagtgcctgaagtattgcgttggaattgaagttaagctttccctagacactgtttctcactagtgaatcctctctatcctggcctatcctttgcttggtgtccttggatgaaccagaggaagatctgaccacacacgttcccttggattcgatacccttggaatactccgtaggggaagtgctacatcggtatatccgtgcgcttgcggattttatttgtgaccgtattaaataccaacaagcatttctggcgccgttgccggggaacggttgctgatcattttcgaacccagttcatcctttatcctttttcattttttattctaccttcacccctgctatcctagagaagtattcctgtcaaactcttctcgaccttggagcaacctctttttgagctatctgctcctcggggcgaattctacgagccacctccttcatcggagcccatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagacaagaaactgtgcggtggaaattgttctcgttctctcttcaagagagagcaaagcaatggtatacctctaccgttggatgtgtaaacggtagctaggaaaagctgcaagacagattctgtcttgccttcttcccagttacttgtatcactgcccttcgagtagaaattctcagttttaagcaaatcgaaaatgaatcaatcggtgcagcttggtccagattcactaatttagtgcagtccggaccaaccctgtccttacccgagtatgtgcttctccaacatttccatacgggtttggataaggagtctgcattctatctggacataactgctggaggatcattcatgcacaaaacgccgtcagaaggaaaaacgattttggatcgcattctagaaaatacttccttcatgatgcagtccaatgaaccccagctggaggcatccgtgtccaagatagaggaacttctaacaatcgagccacttgctgaaccatccacttctgctagctcgattgatgagaaggttcctgtgtagccgtccgtcgggaatgaagaaattcagactccggattgtaccgtaattatgttcagggacagttttgacgaagactacggcaataccctgaactattttagcaagaggaaaccacccgttcctttgtcacctcccgatcctatggaactcgggttcctgtgagaaactgtccgagttgacatccataatgagcaatgaatggctaagggaggtagagctttcatccgaagtaattcagataaatacggctccccgaatcattccatgccatctagaagggaacgatgtcggtattctctacagtccatctgtcggggccaacctcgtctctgagtcttttgcactcgcttatttaagcgataaggcagtgtccccgacaaacaaattcttcaagcatccgaacggaaatatcatcgaagggtttgggattgtgcaagatgtgcctgtctgctttgaagacatggaggcgatcttggatttccacgtctttgaaattcaagatttcgacattctaatcgggcttcccattgagcaacttcttattaacacaccccgattaggtagcctcaaaataacactgggagagaatgaattttcaattccattctcgcgggcaaggatcaccttgaccgattctctcccagaaattgagtcagcggaagaggttaccgcagtccctcctcatgagtctcctgaagcccttctggaagatgaggtcccagacttcatcaaggaagaagcagatcccggtgagactctcgacctgccaatcatggaaccgccacctcgacctccgcttgagcttaaacctctacctccaagcctatgatatgccttcctacataatgatagagaggccctgtcacaccccgaagttctcctcccaagcctaaatttaatttataaatgaccctaagaaaataccggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctttttttttcgaatgggccgccggcccattctttccttcctccccctcctccctgctgggccggccgcaggccgaggcccagctaggccgccccgccgccctcctctcccggggtcgccgacaggtgggacccacctgtcgggtccttcccccacctcccgccgctcccggcgcgccgccgcgcccgcaaccgccgccgcgcccacgtctccgcctccttcgggcctcgtcgaccacgtccgcgcgtgcgcgtctcccgcgcccactcccctctctctcccgctcgcgcccgcgcccgagatggccgggattcgattttcgaatcccgcctctctctcctcccccactcccccacgtcggccggcgattcccgcctctcccggccacgtccggttctctctctccctatttaatcttctccgtcaccccctctcgctttttccccatttcgccgaactctctgtgcctcccatcgctcccgcgccgtgcaacctcttgccgccgccgtttccgctactccggccgccgttagccgccgctagggtcgccgccgcaccacgccgtcttcgccgtcgggttcgcaaggctaagccccaccccgaccgccccttccccgtcgagtttcgtcgccgaaattcgcatcccctcgcgctccggtgagttcaaccgctaccgccgctttcggccgtgaataccggtcgccgtggttcatctccctctctctaatccctctcttctccttccttagggcaccccgaagctcgtccgccggttgccgtcatcctcccgtggctcgccgtcgccgttcgccatcgtcttcctccgcgccggccaccctcggtgaggcatccctcccctcttttccccttcctctcctcctagtgccgcgccgccgcttcaagtcgcgcgccatcgccttcgaccaccgccgccgcctcccgtgccgccggtcgccgccgtcgtcggccgcatgccgtcgccgctagacctggccggccggtcggctttgatgccgagccgagtcggcggccgcctttatcgccgcccattccctccccttcctagccgccgcttagcgcagccgccttcgcgtcgccttttgcgccgtcgctttcgccgccggttgccgtcgccggcaacgcgttcgcgcgcgcgccatcgccgtcgccgcggtcggtcggccggccttgagccaagccgagccgcgtgccgccgccctttctttccccccctgagccgctgaccggtggggcccgcatgtcggcgccgcttcccctgtgctgacgtcagccctggaaaatattgcgcaataaattatttaaggatttctgttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgaaatagtcgccgaggttcctccagcagcagagcaaggcaagtcatgcttgtcacttgaacatgttgatcctatattgcaaatgctctattgttttctttcaaatattgcattgttttataatgttactatgggttgtttacctattgtcatagccatgcgattgttgtaccttgtttctttgtcaacttggggttctaacatgattagagttaggactggggattgcttagccatgcttagttcagctagttcacattggggaaaatcctattaatgtttagactgttggttccaatggtgttgttggattagtgacaccgttttggtgttggttaattaaaataaaccacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagatgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggttagcgttggacagcggatgattaatattaattaattattacaaccgtttaaatctttcaatttctgcttataaatgctcgctttatgcaaatgaaccacttcagctctcctttgatgattccctgcatcatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttcaagtcaaggcttagctcctgttgtctttctttctttccgctgcattttttgtaagacttttatgatgtttgtaagacgtggatctgaatgtcaacattgtcgtttgtgtaccccggccggtcctggacggggaatttaatgcacattctgcttgaaattctattcgggaatttctgggcgtgacaggcccctgtctcataatcagtgacaagctctctgaagacgagactcaacgtcttctcaccgtgttagaaaagcatcgttctgttcttggctactcgcttcaggaccttagggggattaatcccgcgctttgcacccatcgtattcctattgaccccgagagtactccctccagggaacctcaacgatggctcaataatgcaatgcgagaggttgtaaagaaagaggtcttgaaactcctgcatgccgggattatttatcccgtaccatacagtgagtgggttagcccagtccaggttgtgccgaaaaaggagaaatgacggtcgttgcaaatgctcaaaatgaactaattccgcaacgaaccgtaaccggacaacctcaccggagagccaacaccggcgaatcaactcatcccggtggaaaattacacagtggaaggggtgaatgcactgtgggtgcagcccctcgcagcagtgccgggctcccctgaaaatctggagcccgtcgacgagctccctggttcgaccaaaccaggggttcggccaaacccttctcggccccgttcggccccctgttcggcagcgcgatccctctcccctcgccatgtcacaaggacaaaaattcggggggattcgcctgctcaacggctgacgatgggagagctcggtctcttaaaggcatgtcgcctttttcaagatgacgggaaggccgcgccgcctcccaccgagtgttatgtgggcaccctgttcaccaaggcagtggatgaggtgctcacaagtacaccacacccaccgctactccatccactccgaaggaggagcgattccgcattcagggagtgcgaactcccgcggtaggtatggtaagggtttactccggcctttgatggcatcagagaaggagggggcagcggaatcccgtagccatccacctatgaaggtgaagcgtcacttgacgccccctccaattgtgagggctcccggccaattccaagaaaatgaggtgaaatcaccggagccctcgatccataagctcgctgcgcaagtgaagaaactccgcaaggagaacatagagcttagggatcgcaacgcggagctaggggtagagcttgctgaaattaggaataatttcgatacccttagtcatggtttgtgcgctaaaatcaagcgtgcattcatagatatggggaagaaaaatatatattatgctaattagatgtttcctttcccatgaataaaatagtagtaggtgcttggttttatttttccaatcatgtaagcacttgctatgaataatgtggcacaatggtgttaaccccaatgtttgccaaagtttgttttgtttcatgcttaataaagttcagattttgaataagtgtgggggagatatcccagcttctgacgtgcacataatctgaaaattgctgaatatttgaacacctagaaggcaccaaactctgcagcaatttgcagaaggattgggcaccagagtggttcggccgaaccaagtctggccccaaaccctctcaactttcaatggtaaacaggtgagcacgtcttttatctgtatatctccaccatggtatagtactagagctgaaaattcagaaaacaactggttgaagcataagtgaaagataaaatttccaactaatgaaattcttcatatgattgatcgtgtatattcattattctcagctgaacttgtgcttgtgaacaaccatccatgattagggaaccttatacatctaagtgattgctttatgtgagatgattaagatgaaaggaatccttgcaactttgttatgactcttggggatttgttttcaaaaataaaattgtttttaaaggctcaatcctccaattgattttaccttatacataccaaggccatatgcaggtatatcattgataaaccttagtatgcatatgactgcttgacattatattgagctttgtcaaatttgtgtgacttgtgttagatatctttcatactctcatgatcaaggggtcaattccaccttcatgtccacatataaaattaagctaagcttctacactggaagttggctttccacaaaaaaaaatatccattcaaataaactcctacattgaactatgctttcttctcctagaaaagttctcggcaaaaagaaaatgagaaaaggagggaaaggcatggctgtgaaaaaaagagagaaggaaataaagtttgctctcaaaacattgagcaaagaaaatatagccaagccccttccataaccatgccaagagaaccaattggagagaaagtataggaaaaagggagaatcattttctttactccatcattccacaaaaatattttactttttcattttccaccataaataaagacccttgatctaggaatatgattgattatcttcttgagtctatctttttggatttgcaatatatatgatgcaggtacgtcacaatttatccctaccaagctccacatattagccttagaatagggataagttctggcacattttgccttggtgaggatccaaagaaaatatacatctttgagagacaagagagaaagtcataaaaatcccatgagtctggcagagaagcaagaaggactggaatcaagatcattccatttatcaattactcaagatggtaagatagccacttataaagttcacaggtacaggtatggttgtgaatgatttatatgcttgattcatatcttaaagaaattcattctacactaacctttactcagggacgagccaagggctaagtgtggggggttttgttggcggctgttaaatgccgattctataccgccaacatctgcataaagttcggataataaaacatccaacatagtgataggtgcttaatctcacatattccataagtgttggtatatatttgtatgcagacgacaaaccccgatgttgggaggaaaatcagactacagtgaggagattcacgtatccatataaggaagggttgtgaacttcatccaaacaccagtaaatcaacccaaaactccgagaaatggatagaggaggtccaggggagaagatgggccaagagccaggccagatgggcctagcccaggttcggccgaaccacaatctcagccatccaggctggggtttggcgtggacgctccagatcactccctaatggcggttgtggggcatttcggacattttcccttcgccaaccgtcatacctacctctatataaagacatcactccctcacttcacacacacatttccaagcttgagctgaattataagaggctctattgtactatattgtatactagaatagaaagagagtagagtggaagaagtcggaagaattctggagttgtcggtaatcttctcctatttcttttattctgtttattactctgaattcaatataatattcttcttgagtaatttagatttatcttgtgagaattatctcatggttagttcctaaatagcatacgggattattgttcactataattaactaaaacatagtgattgctttggtgagttataaacactaaagtagatattaattgcttagacgtggtgtttaggtaattgttatccaataattgttgcgtatcccacagtacgtttgaggtgggtgtagaggtggtgacagccctcgagatcacttaagtcctccctgtccgggtacatagtagagcgacatctgggaacagcgggttgccagtgcctgaagtattgcgttgggattgaagttaagctttccttagacactgtttctcactagtgaatcctctctatcctgtcctatcctttgcttggtgtccttggatgaaccggagaaagatttgaccacacacgttcccttggattcgatacccttggaatactccgtaggggaagtgccatatcggtatatccgtgcgcttgcggattttctctgtgaccgtattaaataccaacattcacctattatttatatcggatctttgcacttgagcttgcatacgagtatatgacacttgtgatgttaatgaatactcaacaaacatatccatatctttcatatgcaaccagttggtcatcaagtgaaggatgacaaccgatttgttgagactaatgttcaactttgagatgtgaaaaggaataggtcccactacgatgcggctaatgaatgacaccatgggttaatggtcaccaagccaaggacatcgtcatattggcaagaatgaagtcaagcttgtgatgagaataaagtcttgacaaagaatggtaaagacctcggcataaacatggttcaaccggatggtcacaagtgttgatcttggctcaagcattgaccccaagttggatggcgcaaggcaaaggtataatggagctaagaatcttttcttagtcttttcccggtcttggtgtttggtgtagaccggatttgctagatagacgccgtactatcaagaggggtctatgaagcgagcatatggatgatcttgcgccatattagttcatatgcatgtaggtgtatttggtgggcttgtctagccaagtgtggtgagttttctcaagtcctaaacaaagagagaagtgggcaaatcctataggtttgggtagcctcatgtggttatgtcgggtggagtattctttggagtgtgagccctttctccctgataaaagttgtgtttcttggatgaatttttcatgggttggatggctatttgaataagctttacatagagtccaagaacgtcaaattctgagatccgagtcaagagatatcgccgttttactaactgttggttgtgctgaaaagtgacctacggtctgaccgtgggccataggacggtctgaccaaggatgttagccggtctgaccggcgtggtaaggccggtctgaccgtccccactggtctgttgcactggtctggtttttagtggctatacagaaccaccagagccgcaaccggtcagaccgagccgacggcggtctgaccgagccatggacggtctgaccggccactacactacggtcagaccagccaggttgagtgggctcaatgattgccctgtaacggctagttttctagccgttacaaagtagtctggtctgaccggccactctatggcggtctgaccggcagagcacagagttggggatttcgactccaacggctagttttggtggttgggggtatatatatacccattccccagcagcaagggtaggtttttggcactccattgcattatcttgaacccaagagctctcacacccttgtgcacttagtttatctagtgaggtgttggagagtgagttaagccaatccaagtgcattgcttcattgttagagctactgtggcacttgatcatcctcggcaagcatcctagacttgttactcttggaggttgccacctcctagacggcttgcggaggtgttgcccggtgacctctccgaggagattgtggaggaggcccggcgccggttgtaagtggtttggagttcaccaccttcggagtgaaggaagaactaccctagtaatcgaggcttgagtagtcctctccgtgggccggcgtgcccaccccttgacgaagggggcgtgcggtggcttcgtggttgagcagtggagttgggctcgcgtcaacggggattaggaaaccggcgagtttccgaacctcggtgaaaaatcccttgtctcttgtctcatttatttgttgcatttacatttgagcaagtttacatactagagcttatttgtgctattatcaccctaggcttgcaaaccttaacatatgctagtttctttgtgcacttacttgagactagttgatttaggttttgaattgtgcaaaaccgttctgatttacgcttccgcatacaaaactcggttttagcaaaaagttttaaaaccgcctattcacccccctctagtcggcctccttgatcctacacccgtggtccacctccactggttgttggaacgctgagagacgccttcctcagcgcggcctcaccgctggtggagtttacaccgctgcattgacatgaagctcatctgtgtcgtcccttcggaccacagccttgctgctttcgtcgtcttcctcaccgcccgtgtatcgacaccctcatcgtccgcactggtcatcttcagccatcgggatcttcttcgactgcttcgagcatcatcgctgcatttttaagttgccaccgtcaccgctctaggccagtggtctagctacgtcttcatggctaccgacatcaccgtttcaagtcgttggtcccactacttcgcctttgtctttgtccaacttgcctcattgccaatgtcaccgtatctttctcgactacacttcgctcttctctggcaatcgtgtgttgctctgacaatccccccctccacgtcgttctcgcgccgcaaccgtcatggaggtcttctctactagtctcctccgacattggtgtatgattcatggtagtctcctatctcgcccgcgtggtattggcaacatcgtagcgtgcattcgtcccgagttgtccccgggtctagcaaacccggcatgacgtctcgtcctatacggttcgacaacatcaactcttcggcgtcatcttcctcaatgacttccacgaacgcatcaccgtcatcatcttcagtactgcgttctaggcttctcgcccatgaccacatactctacggcgccccatgcgcgccctgcggctaggcaacctcgacatcattggctccccgactttggctacattgaccatgactactctatgcatggcttcattgaccatggatccctcgcacccttcgcttcatctacatcgactatggcacaacgagctatcatccgtattaagcactcttgtcggtttcttctccagtcaaagtgtttgcattgctcacgcttggacggcgagggtatgttagagtatatggcagttagagtcatattaggatagaatttatttgtatggactccttccatttctgtaatcctttcttatctcctcgccatgtactccaatatataccgcccccctgaagctcaacgtgtccaataaaaacaatatcctttctccctatactattcaatacataggagttatatactggagacggggagactcccgagtgtcaaaaacacttgccaatgcatgaaaaacactccgtaacagagttacctagtcccacactcagtaatcttcgcccaggagtgatttctccttcccgtgcatagttggcgtgtgtcctaggtacatacactccgtaacagagtgagaatttccgggtgctctaggcactcggtaacattttcactccactgtccaacagaattccataggcaacggtgacggcacagttgcgtagtgcagagaaagttacagtgtgtttttcaatcggacacacacggtaaaccttctcttgttcccgggtgtcgacatagcatgacacacgttaactttccaagaaacacacagcaacagtgccgttgttaacgtgtgttcagtttaggacactgtaagttgacacacaggaactctacttgagggcaaaactaaaatgggtttgctgatacatttatattatttgcttacaccagaatagtaggagcttaataacacatcataggcgatcacacatacaatggaagaatggattccaatgcattgacatccacgttcaattaatcgatttgacaacaatctaatgtgaattacaatagcaatgccaatctcatagacatctacaactgagatgaaatttgaatattacttcttaaggttagataaccaaggaggtagggaaacgagaaaagagttgacgaatggcattgcaggcagtccgacaacacctcaaataatatgaagatgagccagttgacttgcaaatcctgagattgcacaaaagaggtaagattaattacgtaggcgagctttatttcaaaacaacattttatgtacatgtatctaaaacagtgatagcacatttatatgaaatagcattagcaacaagtttatttaaatgatctatgccaataagaaaaaaaaactacctgaacttattcatgctttcttcaagaattgtctaggtttgttacaaaattcaggtataacaacagtaattaatattggaaacatttattgatggcacatgccaagaagcgctatgcacccaagtaggggtggacgaaaattcgtagctcgttagctcgctcgacttgcgacaagctcggctcgactcgtttcattttcctaacgagccgagctagccttttagctcgttagagataacgagccagctcgagctggctcgcgagccgtaacgagatttgacaacccagcaggcaacagcaatcccagtccacaagcccacaaggccacgaggccacaaagcccacacaagaccacgaggcccatcagagcatgtaaagtactaatactataccacaaaccctacctgcctctcgagagtctcgatctctccttttcactctgcctatccgccgccagtctgccgctcatcgcccagcatgcacctcgcagccacgccgcgctgccccttccttcccggtctctagtgcttgcgccatcgccacctccctgtcgcgaccatctgccaatctgcgctgagggctgcagcaccgtcggtcgtcgcggcgttgccccagcttggccgtcgcgtgcgctgtcaccttggcaccgcagatttttgtgtcgtcggtcatcgcactcgaactcgccgctgcggtctgcctgtctgccttgccgtcgaccgtcgtgctcgtcctcgccgctgcaggccgctcgtcggctcacgttccgttgtcctagctcttctaatcttgatgtctgatatcttgccctctccagctcgcgagccgaaacgagctagctcgagctactgaccgagccgagccgagctgcgttttctgctcgtttagataatgagccgagccgagccagctcgttatctaaacgagctagagcaagtcgagccgagccgagccgagctggctcggcatccatccctacacccaagtgactggtcaagtgctcatttaagttctttttttatactagccaagtgctcatgtattgcactgaaatccaaataaatgattgcacatgttcaaaataggggaaaatgtaaaattgaaatcaaacttctcttatagaacttcatgattcctggtatataatgtaatttaggataaaaatgattatgatcctaactcaaacaattcttgctcatctatcaaaattttatcttactatcaacattttaatgggatttgtataaacatactcatcaatttgctagcaccaaaattgtaaatcatgtaatcagaaatccaatggtatgagaagaatcaattgagagaatatacaatagtaaattcaatattcagacatcatagtagacaagggaactttgcttgtagtacctgcttcggtgtcactcttcacctactagacagcaccaattgattgagaatctactgccttgtctatcccaatgcttgtcattgtcctgaaatgaatgcacagagtgaccttaggtgggtaaaattgctgtggcttattccatgataattaagttgggcctgttaatttatgatttaactaagaaaaaggaacgcatgccaacttgagagaaagaaatggctccctggctttgcagtgagtagaatgtctttgaggtgatgcctatgatggcttgaaatggagccgagctggattggttcagtactggaacagacattgcaattttggaatgacttcttggaacatggctccaatcttctgaaaaaaaaaagaataataaattcacacaagaaaattttaggcatctctaaatcaaactacagatatatgcacagttggttcatactccatatgattttagttgtgttgtactgggtggctcatggaagcaatcctcaaggaaaggaattgcatcatatagataaaacaagaattttatctccacttggttctgcaaggatagtacataagtgacaatctcatccaaaattgtttcttctcactaacaggggctctaataaagtggagaattcgataatctgattcctcttgtaaatagctacaatttatcattatgaaggatgaaaaaaatagtttcattgtcagagatcggtttaaaccctgaaaacaaatgaacactgaagaaaggtgctatcaaaaagtacatgacaagttgaatataagtacttcctccgtttcacaatgtaagtcattctagcatttcctacattcatattgatactacattcatattgatattaatgaatctaaatagatatatatatatctatattcattaacatcaatatgtatgtggaaaatgctagaatgacttacatcgtgaaacggatggagtatgtcttagtcactagctacactagaaatcaaatccgagctaccagttagaagctccaagttctccgcctgaaaccaaaaaagctccgtagttctatatttagagggaaaaaaatcatattccagcaaaaagccctttgcggctgtccaggtgaaaagtaaaatgcttctcttcacaaatcaaatccacaaggacccttctccatgcgtgcaggagggaagaaagagacagagaggtggggaagagagagatcataccatggagaggcagctagcatgtaagtcttgcccgggtccttcttcacccaacttcttcactaacctaaaaaaaaaatccccaattagaaaagtcttgaatgaaccacataacttggggaataatccagatattatagatctgggacaaaggagcttgtgggaaggaattgaccagtggagggatgaggagggcagcgcggcccctggccatcgtcgcaccggagcagctgccatgggtgaggtggcgctggatctggatgcccccggactcatcgctggcagtctggtggccccattgctccggcgagccaaaggtagaggatccatgtccaggatgttgtggagggagggctagagctggagcagcgggaggagggggcacgccgccatgccgccacggagagggaagagaaggggcgcgtgcgtcggtgctttgcctggctgtggagtgtagtgttgactgtggactgtgaacctggcctggctgggtggaagagataaggaggggaaattgtattcccgcacgcgccacagcaaattagaaatttggggcgggggattttcgttttacaagcacatcaagcaatttatcattattttgctctacatggttttttacataattgaagcaatggaatgtaagccaaagatagataaccacgcaacaaaatatacctgtggagtaagatatttatacttttctcgagtaaagaaaatttttattctaaaaataatttcactctaaagttaatgttagaatatactttccatacttttagaaagtaagtttagactgcatccttgttggaacatgctgcaaatgacatcaagtacagtcaagcaaagcgagaaagcatgattaattaagtattaattattttaaacttaaaaagtagatttatctgatattctaaagaaagatttttagagaatttttttcataaaatacatcgtttagcagtttgaaacatatgctaatagaaactgaggtaaaatctatatcttacttagaaaaaaaatcagaaaagactcgggtataagacttctctaattttagagccaaataaattgttaatggttgaaaagccagggttgaatgaccaagcaaacaagaaaaacataagtttatttaaattatgagtgaattacactttacatcgggtaaaatgcatatgtttcattttgcatcaggtttagcatagtgttgtgttttgaaataattaagattcactttacagtacgatacatcatcgaacctacaaaattttcatgattatgaaagaaatattgtaaaacatggtataaggcaacaagtttcgtttttattcaaattataagaaacgcaggatcgcgtatatggtgtggtgcaaaaaaacatgggaccgacgggcgacgcaaccccagcgtgggcgcgcggcaccgcgtcagtccctttagccagccaagctcatcgtgcggacccgcttgctggtcatgcaagaccggcgtgcttgcgtcgctacaactgttggtcggtcgcgcgtggctggctcacgccaccgcttggccggttcgcgatgttgcgcgtctggggcgtgggaccgacgtggtgccgcgtttcccagctacgggacaaacgcggtgccgcgtttccaagctgtgggaccgtatcggtctcacgcgttctagttggccactgcattgacatgctttcgaggcgcgggaccgtcgtggtgctgcacttccgacctatgggaacgtggcggttccgctcacccgtgctgcaagaatgatccggctggtggcgtacccacatcctcgttgcaggacgaatatatgtgtgctaatccttcccctacatatatataaacgtaaattattaaaacaaatgtatattcacaaactttttcggttgccattatcgtcacctagcaatacgttctagggaaaaccttgtttgccagtactatgcttttttcttatttatcactcaactatggctataactttcttttcttgtttctatttttttaatgtgtgcttttgttatttatatcttcatgttataagatatgattttatataggtactccctccgtctcagaatatagaaaactaagatcggatgtgacgtatcctaggactacgaatctggacataccccctgtctagattcgtagtactatggtacatcacatctggtcttaggttgctatattctgcgacggagggagtaggtagctacgaaaatatttgtttttatttaagcttggcgattattttgttcaaccgtgaataatttgatttttttatgaacgtggggaactttggattaaactagctcttggtgtgaacggtaataagactatattggttgttttttctttctttttttatgtaacattctgccccaggaacggtgggcttaatggagaattttctgctatttgattgacatgtggccccaaccattgactgctccgttagtttagttagaattaccgagttcctatcccacatagcactgtagcccaccgtgatttccgttcccgttcgcgccacgttgctgctaacgaaataccgttcgcgccaacgaaaagttctgggaagattggtgcgggccccacattgcctagtttaacctcaaaacacaccgtactctttacgataatgctattcgtcggtcgaccgacgggggagaaaaaaaaatcgggtgctccccccgtggccccgttcccgcgcacagtgatattgttggccccaccataatatctgtccctacctgcaacaaatcaactatatattttgaaaaccctatattaaaagaatttggtttatttttttgttccacaaaaaatattgcatatagtatactcacaatgtttcattatgtataaatctaatgttgcagtgagctaaaatattccattgcaaacaaaaaaaacccacatattttagaaacccctattaagggaaatcgttttattttttgttccaccgaaaaatgtttcacctagaatttgttccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattcaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaacccatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggagacattttcgcaatttttgttatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatattaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaagcccaaaattaaagtctcttggctcttttcatgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagatccaatgtcacattccgtaaaaatttatgatacatgtataggatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctctttaccgaagaagcctgtgctcaaaataatcgagcacgggcttttctggtcaaaacgtatcttgtctttatcactttatcatgagttcttttccttggttaacaatacttgttgttttgccgatatttgcgagttcattaattttctttttacctcataggggaaacaaaatcgttaggtggtatactatgtctatttgtttattagaattccttctaatgacttatgcattctgttatcatttccaattggaggatcccttaatccaattaaaagaggattctaaatggatagatgtcttcaatttccactggagattgggaatcgatggactttcattaggatctattttattgacaggatttatgactactttagctactttagcagcttggccagttacccggaattcccgattattctatttcctgatgctagcaatgtatagcggtcaaataggattattttcttcgcgagaccttttacttttttttatcatgtgggagttagaattaattcctgtttacttacttttatccatgtgggggggggggaagaggcgtctctattcagctacaaagtttattttgtatactgcaggtggttccatttttttcttaatcggagttctaggtatgggcttatacggttccaacgaaccaagattagatttggaaagattaattaatcaatcataccctgcaacattggaaatactcttttattttggcttctttattgcttatgctgtcaaattgccgattatacccctacatacgtggttaccagatacccatggggaagcgcattacagtacatgtatgcttttagcgggaatcctattaaagatgggagcatacggattgattcggatcaatatggaattgttacctcatgctcattatctattttccccttggttagtaataataggagcgatgcaaataatctatgcagcttcaacttctcttggccaacgcaatttcaaaaaaagaatagcctactcctccgtctctcacatgggtttcattattataggaattggttccataaccaacattggactcaatggagctattttacaaatattatcccatggatttattggggctacactttttttcttagcgggaacggcttgtgatagaatgcgccttgtttatctcgaagaactgggaggggtaactatcccaatgccaaaaatttttaccatgtttagtagcttttcaatggcttctcttgccttaccaggaatgagtggttttgttgcggaattagtagtattttttggactaattactagtccaaaatttctgttaatgccaaaaatgctaattacttttgtaatggcaattggaatgatattaactcctatttatttattatctatgttacgacagatgttctatggatacaagctatttcatgttccaaacgaaaattttgaggattccggcccgcgagaactctttcttttaatctgtatctttttaccagtaataggaatcggtatttatccagattttgttctctcgctatccgttgacagggtagaggctctgttatccaattattatcctaaataggatttttttttcttctactagtccgctctatattccatagtggaaatactaaaaaattcagaaaaaagtaaaagagtctaattagatctatctcgaatttttgagaaccctttgagaaggcgttcaaggggttctcaaatcaaacacaaaaatggaagttttttccatttcattaaggttttatgttatgtaatcatttagatgggtaatgtaaatgaaccataactatgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctataggatcccaattccagtaggatccccacgcctcattagcccatactgctccacaaagaatacctatggttaaaagggtaaaccctagactaatgacacgataactccaagaatccaaacactcaattaattgatatttgtaataatttggaaataaaggaaaaaaggtgctttttaaagcacttctttcactatgtttcattatgtatggatcaaatgttgcagtgaactgaaacaatctttcactatttgctaaaacattgtttttatataaggtgaaagaacactcgatttaaacgagtgaaacattttcaatctacttagtgaaacaattccgatatacctggtggaacatcgtgcaacatttaaaaataattcaataataagctaaaaataatttcgtcggaatatatccatgtgtggtcttgctttaaagatttaattgcaacgatttaatggtgcaatcggatcaagctttggataagtaatttaagagaaaaatcagtttaaaatagtttttacacgtaaatcgggcgctgacatcagggcccgattttaatcggctcccatcaggcgcccgacggggagtcacgtcctaatctttagttgttcccgggtgttcaataggtacgctccgtaacaacattagttacgtagtgttccacctaaacaccccgcaagttacctggtgctagataaacaccccgtaatttttcagctcacactcggtatagtctccaatcttggtagtcctacgttgctatattgctatattgtgggaatgatagagtaatttgtgctcagaattcaatcaattcatggccggctattaattggtcaacgtcctctattctttcttaggctgtgtttagtttcacaccgaaattgaaagtttaactgaaattgaaagtttaaagaaaaaagttgaaagttggtgtgagtaagaaagtttttgatgtgatgaaaaagttgaaggtttgaaggaaaagttggaaactaaggccttaattaactcttgtcgtgtcccctctgcaggcgctgttcatcgtcgtcatagcacgtcgctctccgaacgctgactatagcaggccaaacgggcggcccggcccagcacggcacggcatgccgacggcacggcccactagggcacagcccgttaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaaataaaaaatatgagaaatatatgggaaaaattagaaaatcgtaggaaaaataaatgggccggtgggccgtgccatgcctgggccgtgccgtgccggcatgctacagtaaacgtgccgtgccgtgccagcccacgggctgaggcatcggcccaaacacggcacgggataacgggccgtgccggcacggcccacaggctggcgtgccgtgccgggcatgggccggctacagtactgccgtgctcgggccggcccggcttggcacggcccatttggccaggtctaacgctgacgtataacgaattgatcgatctcctagaaaaattgatcaatcaaagaagtgtacaggacatcaacgcaaattaattgacttttttttaaaaaaaacgaaggaatgcggtgtgtgttatactctagttagtcatatgatccagattacggcataaacgttttcttggaagcaagctaatcctgccattgcattaaaaaaaatcctgagaatacaaatcaaagaaactcggggttgaccaaaagaaagaaggaacaacagtgaggagaaatggtatatgctcaatttattctatatactcagaatatataactttgacaattactattatatacatgctccttacaatcataaataaatatctggtgcttaggataggaaatttggtcaaacttgggaagttccaaccatcaataatcacaaatatttagttcttctgaaaaaaatagttatatgatttatctcgaaagtattatcataatatgtcataaagttgttgcaaataaaattgattgtcgaaattttttaattttgacttaatcttttcataagcgtcaaatatttataactagaaagtattacgctgttttttttctgaagtaaagcatcattattagtagtagtacggtagtactagtgtttatccttagctcgcaaataaactcacgtacaaccgcaacgatggccacggcagctacgacgacgacgggcggcgatgtccagataccgattggacagcaggccaccgtcgccgccaccgccactgccacgagcgatgggatccgggatagccccggcacgtcgagccccttccgtggcggcggcggcagcaccacccccaccccgcagcggccggtgaaggccgggtcctcctcctctccaccaccgccgccgacgacggccatggacaagacgctgtccagtgtagcgaacctcgcgaagctcctgccgacgggcacggtgctggcgttccagtcgctgtcaccgtcgttcaccaaccgcggcgcgtgcctcacgtccaaccggtacctcaccgcggcgctcctctacctgtgcgtcctctcctgcatcttcttctccttcaccgacagcttcgtcggtggagacgggaagctctactacggcgtggcgacggccaagggtttcctcgtgttcaactacgacgctggcagcagcagcgacggcgacgacgacgaccagcggcggcggagggaggtgttcaaggacctccgcaggctgaggatacggtgggtggactacgtgcacgcggtgttcacggcgttggtcttcatgaccgtggcgttcagcagcaccgccgtgcagagctgctacttccccgaggccggcgacaacgtgaagcagctgctcaccaaccttcccctcggcgccggcttcctgtccaccaccgtcttcctcgtcttcccgaccacgcgcaaagggatcggatatggcggccagtccaccaattaacgtacgtgcaatcgcctagctagctacaaggcttgctttacttgtgcagtgatgctaattaattatatattgttgttggccaagcctttcatttggtgtagcgtgcacgtgtgcaacttttccatgtgcactagtcatgtaaagcagtttagtttgtcacgatttgtgttatgcgcatatgattctttgcaattgcaccgaagatgcacgcacgattaattcggtttacggttttgctataaatgatagattgttaattttcgcttcaaatttgtcaatttttcagccgttagattaacctcatgattcgtgcatgctttcgtttctttgacgttcgcgggcgaagagcagcgggctcagcgcgcgcgatggcacggcagacacaggggtagacacggtctttaatttgcatgcacatctttttccttttcattgatgaaccctgtacggctgtaccctcgttaatgctaagagtgtgttaccgctgatgtaagacggttttctctaaaagttacatcttagttatatacaaatgtcgggtcccaaaattagctttcggtaactaacttgtctgcatgtctgtatcaagccctagatgaatagattaatacatgttcaataatatctggatcaccattccatacatttaaacaagggctccaaaagagattttattgcataaaatacaagagcatttacataattgtggctaactattgcagcagaagctatacaatgaaccgactctactattttgctataggctcaaaccttctaattagtctagacttgagggcttatatgattgaactcctggttttggcgagaacttcgaatcaactctggaagggttaaagcaagcactactggagaaccaatctttgctgggtcgaccgaaaaccacattaccctggttccaataagaactgggactaaaaaactccaatgggactatgtgaagatcatctttattcctggtccatcccctgacaaggcctgtcagggggcaggggatctttagtcccagtttgtaataccaactagaactaaagatacctattatttaggttggtaataccaaccaggactaaagattatttagatctttagggactaaagattgtcgcctttttatattccttcttgctccttgtcacatcccgaattcaccgtaaaaagcatcatttaaattattcctagaaaaagtaaaaatgggtgtcaaccctccaaccttaaaaatatacaacctaaaaatcaaaggaggcttggagaattttttatatatattttttctcgaggcctaaaatgtgtaatcaagttttagtggaattctcagagcacaaataataattgccgataggaacaagggataataatttcaacaaatggtcacctaattgggaaggtccttttcgtatccatcgatatgtgcctaagaatgcctatctgcttgaaggttttgatgcagagttttatggaaaagcacttaatggaaaatatctgaagaaatattatccaagtgtttggattaattaataatcggttgtttagctgatgtatgatgtggccgatgtttgatacatcgtctattgatggccgatatgaattatcgtccttagagcaattttgtaacataactcctcatattacaaaattgggggcatatatccagatatcagacagaaaatatgtgggtttaaaaaactttttcaatattgagaagcaaaaggatttttttggttagatggccgatacacagatatattacaaactgcaagtaaatattcagagtttaatggactttttcaagccagttacattcccaggaagttgtggatagcttcaatagcacgaagacgaaggttgttgatttattcaatagttctgcggtcttcggcatcggtccctgggatcggcttcattgctcttgtcaggcctgcaagatatttgatcgatgcctttatttttatctttgctcttcgatagcttttaaattcaatgatatttgattgttgctccgatgccatctcttgccgaatctgctccagttgtgctaggagttcggattccttttgtttgagcttgtcaagctttttttgagaagattctggaccaacgattaatttgtccagcttgcttttgtaatccaaaatctgctgtcggctggaggtgacggtcgcttccaaggattgcctttcctgcagatctatcaacctttgttgtgcccgttggagttttaagttatattgatcaagatgtgctgctggagagataacatcagctaggtctttagaaataagagcttggatagcattgaatttagaccaaactggctcacaatctacaactaatgcatcaagagatacattgagccgattgaccaaatctagcaaatttgcttttaaatcatctgaaatgagtaatttggctcggattgaagattttgtcccatcgtcttcatcctagacattggtaaaaggaaaaatgaggaatcggagatatttaaaggaggaataaggtaccatgacttttcaagctacccgccgatgacggggtgctacgtcaaccgatcaaggcaaaactgtaggattaacatcggttgtctcttcctcatccgatggcttgtcatcagctctggttttccttttctttgaaggggatacttaggtcactttctttgtgatttgtttagattttggaacaaccggcatagtttctatcactgcctggtatggaagtaaagaatcagccaatggagaatttaaaccaatagtttatggagccagaatcaactcattatccagaagggttttgacagctgcatatacaatcagctgaccgcttttgctgacatttggtggaggctgatcgatatcctggaaggtaaagataggttgaaattatataaccaatcatcagattcaatacttgagtagaagaagaggaagatgggtttcaggcttacctgaggaccgatggaagtattgatgattgtgagataaaaagcagttggctgatagaagatatgttttttccattctgcccacaagtattcataaatcaggctatattattgaagttgggacaattgaatcgattgggcctaaaggtggaccttcaatactcaagaccttgtccataagttccgccgatgatattgtgtctctagccggattttggttgagaaataaaggttcaaagggagttggcctagtcagaactgtcttgctgctaccattgggtggtaaaactcatatgagttttgagtggattggccttgtgatactccagtaggaaggatgcatggtgaaatagccgatatgaagatctttttgttctcaggataaaattcattgttcaagtcgtccaggataaaattcattgttcaagtcgtccattctcaagtcctttggtcattcaaagtcttcaaagtcctcatagatgtaccacattactgtgtcggttaagaaaccatcataaaaatgcttgaaccagaattcaaagaattcagccaataagttagagccagcaaaggtataagcggcttcaccaaaagatatgcaaggtctttcgtctttaccttctttgaattaaggaaatttaagctcttggagggtccgatggttgattaagttgacggcataaagatttaaccacaattggatgaaccaccaaggacctccatgtttcactggggaacccattagcaaacggactgttgcttgacccaaaatctgataagcggccttgagaaggaatttacctagagggattgacttctcctcatgaatagcttgagccagatgaagaaaattggctgtagggccacaagttgtgccacagaaaatgaatctctccaaccataagttaaggaaagagatatgttcctcatctgtaattggtccaatggctctacatcttttgatatatcctgaccaaccacctccagccttggttttaattttgtattcgctcttgtttttcaagctgatgggattagccaatgaggtgatgtctaagcccgttaacattttaatatccaaaagggtgggtgtcatcggcccatgtccgaagatgatggcattgatggtgttagaccagaaatatgtagtggccgataataaagattcgttcttcggcatattggctaggaagagctgaagacactgttctatccccatccttttccaagatgatcgtttggcagttgatatccttttaaactaatcttcccattcgtcaagctttgagggccaggacctaaaaacatttggccaatggtcgaactctggttttgattctttgaatgggattttgttcgtctcggcgctgataaatattgtgggatttggatcacccataggaccaacgagtttcggcatgaaggacaggaatcaagatctggcatctgaggtgctaaaaaaaaccaaaagggcaagaaaccctaagatccaagaaagagctttacacgaaagatattgatgacaaaaggaatttacctcggggatgtcggaagtggttgccattgttagaagtttgagctaatgaagcaaaggggtttgtcaccgggagtttgggtcaccggaggaatcgctgaagataatagagattgtgcaatagaggaagttgtgaaagacttaactagagaaagagggatttgaaacagtgggcctttgcttataagatcaacagtcaaaatataaaaccctagagtttcgcgggttcgaccagagcgaattccgccgcattatataatatagcggaattggggggcatgtgttaacaacagaatttggcatcacattcggaaaaggagggatatcgaaacggatttggtgttgaatcgaaccaaacttagagtcggactgcacatcggctggataccatatcggctgaaacagagtattaagtgggtcgatgcttgatgaagctgatggccgatgcagccgatggcctatgctgccgatataatatgacttaggcacgacatgggcctagattgggataaccgtcattgccaataagagatagagctcgattaaggcaattatatctattgattaggatattgagttggtttgttagagatttggcaagagaccgtcgtatatggtcttgtttgtatcttacgtttagaaaggtttgagtcgtgtccataatgaagtaagtttgtactcggggtataaatatgatccccatagcattgtaatacgggagcaactccaatacaacttcggtgcatcgccacccttttacttttctcgtttcttgctgattgcaggatcaaatcagctggcacgcccttgacacactcgaggctagccttggacctgcactagagttaagcagatctcccaggccgccgtgttttcacatcaacacccgctcatgtccactttacatgtataggctctggatcacctctcaatgatggttatgggttaaccaacctccataagcgtcattccaactgccatatgaatctataaaaggaggagaaactctcactttcaatttacacaacaaagtggggtacaactcactttcatattttaagcatcattttagtagtgtggagaaaataggtagagagtaaggggaaggtccagaggagtgccggagctatcagcactctccactttctcgtacgtcggctgatgcttctttcataaagtaagtattcgagatttcctttcagtatttaatttacttaattaagtgagatatattcccatcgttgtgggtttgtcgcttagtatttattatattgagcactttagtactaggactctggatgaagaaggaaattcctgtgtaaggctagagttgtaatcaataccttaggcatggtgtctaggttagcggttatcttcgtttgttgtgtgctccatgaaaagtgaggtaggcagcagtgatgatagttttgtccgtcctttgtatcccaccatgtttagatacatcatagagctacagaccaggtgagagccggtgcccaaagcaattgatagggttttatctttaactttagtctaattaattaaagcatacgaatcctctctagcctaagcatataattagttagttggtatccttgaatagaatcatgttcctagatgtacatataattcgatatccttggaataatctaagttgaagtactacaacggtatccatgcgcttgcggattaatcagtgattgtaacaattaccaacaaacatttctggcaccattgccggggaacggttgttgtatcatttccgaacctggttaatcatcgtatcttttcttttcttttcttttattcatttcccttcttatctatcatggtgcacctatctattcaaaacccttctgctccaaagggcgagttctgtgagccaccttattcttcaaaaccaatccgttcatctggctataaactatgtcctggttttatatatggacgtgactacacaactagtggtagctggtttgtctaaactagctaccacttcatctatgagagatcctatccacctatacttcaaataaaattttctcttaaactactcatccgatctatgatctgattacatcgttgtgtttgtaacaattaaatctttataacaagatctcacatgattatattatgatgaaaaattgtaaattaattttataagatatctaaattacttttagatttcactaagttacttcttgatacagatgttgtcccgatcttcacgacgtaggatcttgaacaagataactagctgaaaatcagacaagataactagctgcgagtagccggataactagtgcaacctgacgacacgcacaaggagccaaccaccgtctctatacggcagcctgaaccaaggattcgcccaatcacactctcaaagaaccatcctacgcagcctgcacacgaagtatcaggagcatggattgggtgccgatgaagcagccgcctatgtaatcccacgaggaaatcacaagagcaaaggggtagagatctcggtctctcggtgtttgttagcacacagctgaacaaaggggtttatatttcgattatcaaaaagctcccaaatgataaaacataagggatatttatactaggaacaacccccctagatgggaatgaaaagtcttgggagtttactggacataggttagctcaaaagtcacaataagtgaattcccgagatctatttggcttctgagcagtcttccatgttttacccattactccttattggaaagtccaaatgacatgcggtcaattgcattggaaaggtaacttgataagttttcacaccatgtgcataatgcactacgaaatattgtcgattgatacagttttgcatgggaagttgaacgtcttgcagactgttggccttcagagcagtgtccactaatctggccataactctttagtgggaaattcaaatgacgaacggtttgttgggtgtgaaactagactcaataagctttctataatatgctcattcaccttcataacttttgagaataaaaagttatgagtgtttatttcactggcccgttttgcactggactggtccgttctgagctgatcttgcttttgcactggtccgatcttgctgctccattttatcctccttggtgaacttatccatggtgtagtggtggcaatccgagtcaagtctctatctttaagcacaacgatatgctttaacctacaatcatacaagccaagtagcagccttgctcgatgaaaacaataagatttgtagttaagcatagcgttaaccttgcattgatgtgcaacaatcacattacatgtgaatggccttggccaggccgtatcacttcttagacatataaaagtaaatttaataaagcctaaaagtaatttatatatattatagaagtaacttataacaaaaagaaagtaactttaatgcatgcttttttttcataggacgtgactacacagctagtagtagcctctccatccggtgtctactttgaacttgaaaaaggcaacaatatgtatcttttcttaatctctttaataacttatatattttaaattacatattgtttttaagatctatttgcatcattgtactccactcaaaatatgtgacaaaatgagatccatattgaatatattcaaacattttattaatttaaaattatttattacatatttattacatgttagaaagtaacttccatgttatcaggaagtaactattacatcttatacatgattaattctcattagttattccatcaatgttatttataatccatcaaagggtttatcttcttttctcattctacatgaaaaacaaaaataaaaggaaaaaaaacaatcggcgattaaacagatttatagagagttacttccgaaccatgcaaaagttacttccaattaacattgaagttacttttaaaaattgttaaacttacatgtgctgatctgtactgattaaatttaatttctagatagagtcataattttatccttacaacgaatttacttctaatgccatgaccaagttacttccgttttatattaagttacttttataatatatgtaaattactttcaaagtaagtaaatttacttttatatgtctaagaagtaatttagtgaaatctaaaagtaatttagatatattataaaaagtaatttatatttttttcatcaaaatataatcatgtgagatcttgttataaagatttaattgttatgaatacaacggtataatcggatcatagatcgaacgagtagttgaagagaaaaatttatttgatgtataggtggttcctatttacttaatagactattattatatatattttcagtgtgatgggagcaaacctctgccacgtctgtctctctcattctctctctctttttctcggacgcgaatggatgaggatgatgactcgtggtgggttggctgggacgaggacgcgcggatggaggccacgtcaactcacgcgggatggacggttttcccggcgtcgcacgatagcgccagatcgagaggcctctcgaaatagtttttacgtttatatagctatggttcgggaacaatccttcttaaggcgtgaaagcgaaaactcctaccatcatctgcgtgagtttgagcaattgtgttcatgcttgacaatcgcggacatggcgcaagacaccttcaagtggaaatgttttccctttgcgaagcaatggtacacccatacgtcagaaaattgaatagtgaacgagagtaattaaaaagcaagttttgtcttgattttttcccgtaaacccgtgtagtctctctgcatatggatgttctcagctacagcttgggcttggttctccttgttaactcaagccagcctagacttacctttatccgatcatgtgttgttacaacactgcttagatttagacagggagtttgccatgtatctcgatagttccgtcggaggttcgttcgcacacaaaacgacatcggaaggaagagaactcttgaatcgtacccaggagaacacctctttcgttcattgcgaaactgtctaggaaattgagtatacacatgaggagcatcaaacgccaaatcagagcatatatcctctacatccaaagattcgaccattgaatgctcaccctaaccttgagaaccggaggaagaggaaattcaccctttaaaattccatttctaatttaagggtgatcgttctaaagattatgaaaatacctcatactattcctgccaaaagagaccaccggtccaatgcagttctcttgaaccgctcgaggaaaatttcctcaaagatgctcaaggaaaattttctcaaaatgacgatgcaggaattaactaccatcataagcatataatgagtagttaagggagattaaacttttctccaaagtaattcagattagctccctatgttgttcctgagggaggggtggcatggcatccagcctttgggcgttatgttgtgcagaccagacagtatgatccacacaaagtagtttccatcgaatataattactctgtagcaagatacaaagatattactccataacccacttgcgtctcgctccttttcaagttactttgtatttcagatgtttttctgtaacatgttacctaccataaggctcaatacaaagacacaaagtacacataaatttagtggtggaaccagagaagcacaaagtacacttttgaggagctgaggccggaagtgctaattagtataaaatttgctcagctacaatagtttcaatgaactcatgggggatgcaaagccccctgttcacccctccactcataaattgcaaaaattgatgttacacttcgctgatgaattagagcttccaaggttttctagtcggttagaaaccaactcatgtgctggctaaaactgatgacaatctcctgcataatgtacataaaaacatgagtttccgtgccaaaagatgagcatgagaacacacgtagaaagtacaatacatggaaagaggtacgatgttttgcttacgttgaactagaactccacaagtactgaacttgggtgaaaaataaactatttgacaagttaatcttactgataacttttgagctcaaggtgcattttttttaaaaaaaaatctgaactgctacctagagtaaaacagcagataaaaatataacatttctcacctaattgacagcaatgaccataataatcagttgcatatcatgtattctttggagacggcatctgatcaagaacctcacgcacaaagaggtcctgtaactccaagtatttactcctccattctacaccctgttgttttggtgcaccatacagagcactggccccagattcaaacaatctggacgaactgccaggctgctagatcaaagcagaatggacactaagagttcagatagaactgaaaggtaaaagaaatttgggcccctgtgtcaacagcaatacaaaatcagctgacctgaagtgcatccaggcagcgctccagaaagtcggaactgaagtttccaaaaatttggacatcattttcaggttggggcacaattacagcccgtgattcagatcctccatttgctgagcaaactttccgtagtgattgtagtggtggaagatttactcgtttaggcgttactaagagaacattcgtcactggacctagtagacaagttatgaaaagctcaaaagaatgtaacgtcaataggaaattacaaaaaaaaaagtacaaaaggctaactctatttttctttcagtgtagttaagatttcatatttccaaactatgacaattacaaaacaatttttaaccatgcagtgaacatctttaaagacaagtatcaacagagcatccacttcatcactccacctttaaaaacaagggtgcagatcagtgaagtagcacaagttgcattgtgaacaccatttgtgtccatccaataattggagaaacactgttcaatccaataatttaatggtggtattatgctttgctgctccagacaggtttcagactatgcatggaataaacccactgtatccctgctctctcattacttactattgtttttcttttggagatgggaggtgggtgggtgtggggtagcgagattgacaacatccactattggttacggtagccagctgctgcaccatactcacaagggcagacatgtcataatgacaaagagaagactcgtacccatcatgccactgtatgtattccatggtccatgggtttctatactttcactcatgagcctttgtgtgtaggaagggcatatatcaacaggtttgtcaacatgaacttaacaaatcatgaatagcatctgaataaaaactaacattttgatttggtcatccatttggtcttgtattaaactgtgggcttgagattttggtttgtcactactcactcggaccttgagccaaattaatttcataatacagagtacatatttcccgttatttattgataagcactgttttaagattcactcaggttctccttcagaaagaggaagggggactctgaagtgagttagaatatcaggaagcaaactacaactgaattataaacaaggtttcctaaagagttctatttatcctccattatgtgcaagagttcctaaagaaacaattgtttaaccttataagtatgacattgaatatcgtacttaacattggatgcacttcctccgtcccaatacaagtgcatcctagtacaaacgtgacatatcctaagactacgaatctggacagctgcatgtccagattcgtagtcctaggatatgttacatctgtactaggttgcgcataaattgggacaaagggagtactgaatatgtttcagtctagctaaaatattcaagaaaagcttaaattgggacgaagggagtactgaatatgtttcagtctagctaaaatattcaagaaaaccagtatgtgcaggaacaacatgcgcatacatatgcattaataactttcttcccatggtatgagcaatgaatagaattaaatctacagcgagtgcttgaaaaccagccaatgagattcctatcaatctattggaggtgacagcattcaatataagcttcttctgtttctcctagataaatgttcctgcttttgagaggtgacaactatcaagtaacctaagtaacaacagcgatgcagataaaggagtgttaaaactcttgcactactttaaagaagggtgtgtgtgaacaatctatgaaccttgggaatgtttgaattttcggattacttgctgagttcttgtatcccaaactcgaacattaccatcctcagatccagagatcaatataagtccatcagtactcgatgctaagctggttactgccttgctggatcaataaaatagaacacacattaaagaaggttagacaaaaataataccacagtagttgttaaaccaaaaatgatactacagaataaggtcagatacaaacaagaaggctgtgtttagatccaaactttggatccaaacttcagtccttttccatcacatcaacctgtcatacacacacaacttttcagtcacatcatctccaatttcaaccaaaatccaaactttgccaccaactaaacacagccgaagtgcaatcaaagatgaaatacaacccactggcagaagaatggttcaaacaggacacgctctccacgatcaggtgatcctaactgcttttctttacaagtttgagttcacacaccacgaattgtatcaccttttcttctctagttagtagttactgccatttctgtacccccagttgtttagtatgttagacaaacagtgcgccctccaagatgcatttgttttctaaagctattaactaaatagacaagaaaatttgcatcaacaaaaatcattttcaggcgtattaattaatcactttccacagcaatatgaaaaaaaaaatgttttcattaaaaacaaactggtcgagctaggatggatacaaccaaagttaaagcatgaacaggtaagataggtttataaccactctactactacaagatatcaaactctaacttgtatattgaagctgtttacatcacaggataaataagaggtgctaatgaaagcaaggagtaggcaaacctatggtcatccaaagccccattaatagttgaatcatcactactaggagaggtgacatcaattcccatagcagtaacatatatctttccatctcgaccaccagcgtagaaaatatgactccttgggtctaacgccactgaatcagtaatagaaggaaatgaaatgcttcttagcattctaccctcggatagactccaaatctaggaaagagggggaacaaaaagttaaatgctaataaaaatgactagaccatatagtcaagtacaattctacaaaatatacagctcaaagacaaagtacaagtagattgcatactttacaggtgtgatcctctgaagatgatacagcaattgctccatgacagcaagcaacatcggttacaggaagtgcgtgctgattaaagctgtatatgtgttgtgtctttgcctccaatcttgattgctcatcaagcatcctgcagtaaacaacacaaattaagtaaaccaaacaagcaatcagtgtggtcagtattaccataatcacatacgtgaggagatcccaaactttgatgctaccgtcttcagaccccgagataagcaaaaagtcatagagtgcaaggcacctaacagcacgataatgtgcatgccactggacaagcaactccccactagccacctacacacacaaccaccatagagaatggggtgtaagaaagaacgaattttattatcaaagacagagttactggatgaattaggaacatggagtggaaatgttaaatttctatgcaaaatgccaaaatcaaacaaataggaatataattcactaaaagaggaccagatagaatttagcacactttgtgtcctgtgaagacagataccaaatataaagaggcaacatttcaacacaagaaaacaacacagatgattgtacttgcacaccaggtgaaaaaagtgcaaaatttcaagaaaggtatgaaagcacaaatagattaggcaaaatctgaactctaagaagctgcctgacagaaaagttgaaacagaaacagaaggcatattttagggggaaaagtagcgaagcaaacataagatccataacatgtcataagcttataagtctaggtcaatttactagcaacaccaaaaattgccccgggcgtaaatgcactatatgggtgtgtttggttgcttgtatgcccttagcctgacccgtatgccccatcctggtggagtttagcctggctagccacatgcaagttgatgcaacagggtttgtttgattatcagttatgtctggatcgtgtgcgatgttgtttggttagttgaatattaatgcatgtatgctagggattttgtttggttggttgtatgaatttggcaaattatgctataggacactcaaagtttgtggcctttactgtgagacactcaaagaacgtatatcttcctatggacactgcaaaaatatggtaattagctactggacacccgaggcattattttattatttccagtgaaaacgtcgagagaaagaacgtagaaagtaccaaaatgcccctggacattgttcttcttcctgcttcagctctcttttctttcttctcctctcttctattctcttcttcaacgagcctgggaggccgccagcggcaaagggtggagtggcggtgggtgagcgcagcagaggaggtagacggtgggcgggggaaggggcggcgcccctgaagcagccacacaccctgttgccggagaaggaaaaggagcagggacaggagatctccgcttctagcgccgcctcccgctagtccaccttccggttctcgacatcaggctgctacacggcgtgggcgtccacggcagcgacagtgagggtgcgggcagagagcgcaacatggcagagcgagcagaggcatgcgcgtacgtgcccacccgcgcagcagagaagcatggcgtcgatggcgccgcactgtgcgcggcgtgcctcatcaggaggaagaggacaaaccgtcgcggccatggaacctccgcacccgccgctccgccaccgtggcgcccaatgcgtcgaagctgcgccggggggggggggggggggaaggcggctgcggcgggaggaggacagacgctgcacccgcatgcgttgtccccggtgatcgcgaggaacaggagcttctccgttgcgctcaccagggaggagatggtcgtggacttcatcgccatccgtggcatggcgccgcctcgccggcccaagaagcgctcgcgcgccgtggtggagaaagagcaggcaagggcaaacttgtcctttttaaatctctctccgcgtttttatcaaatataataaaataatgtctcgagtgttgaacagctaattaccacatttttgcagtctgtcgacaagaagatacacgttctttggatatctcacagcaaattgcacaaactttgagtgtcctgtagcaaattttgcctatgaattttgagtgcagttacccctttgcttgcatgttgaggctgctttctttaaaaagattaaaaacacaaagttgcaataaaatttgtatgccaaaaaaatcatcctatttttgcttgaaacaaattactactatatactgtagcatctttacttcattattttactgtatgtatacatatatgaatctatttatctgtatgagcctatgaaaacaacaaaacgaataaaggaataaacaaaaaaggaaagggaatgggaaagtggccacaacatcttggtggcctctagtggaaacgccggctgctcggtttgtatcgacagtcgctagctcgctgcctcagttggattcgacggctgctgtgtcactgccatcaaatcagcagcccaacaccggatctgacagacaagtgctagtggcctccggctccaggtagaaggggagaagatgagcttgttgagggtggagaaaagctcagcgacgatgagacgaacttggtgacagaggacagcagcagaggcatgttggaagttggaggtccatcgtcaccctcgtcattgagcccatgccttgctgctcgagccgccgcattggccagatctggcacctgagcagttggggctgccgtattcggcgtgtgcacggtcgtagacaccgaatccaaacgagaaaaggagcggatgggctagatgacgacgagaagaggagggcaacgatgatgcgacttgggaggtgaggcaagtcgatgcaaatgggagatggggtgagggatgcgccctgcttgcactgtctgcacccgcacgtgctcgcttgcatccgcggccacatgagccagacctggctgagaagcgaaaggtgaaaacctgcatctcttaggcctggctcttggggccgaattgcatctgctcatcctcgatcgcgagcacacctaaccaaacaagatattcactgcatctctcatgtgtccgggcaaccaaacacaccctgtatgaactacacgagtttcccaaatatgtatgttcttcagaaaatagcatagttgcatctcactgaatgccaaaattcaaatgcccaaacagaacaggcatctccaacataaccaccacagtacgacaagactgaattattgtacaataaaggttatttttttatgaaaactaaactgatgattaaataaaattactcaatatacctaaacaaccatgggtgtataggctgtggttagttcccttcaaacttccaacttttccgtcacatcaaatgtttgaacacatgcatagagcattaaatgtgtacgaaaaaaaccaattacacagtttgcaggtaaattacgagatgaatcttttgagcataattacgccatgatttgacaatgtggtgctacagtaaacatttgctaatgacagattaattagacttaatagattcatctcgcaatttacagggagaatatgtaatttgttttgttattagtctacgtttaatacttcaaatgtgtgtccgtatacgtcaaaaaaaattgccaaaacaactaaacacgaccataaccttccgaaacagtacacaaagtgcacaaaaagcagcaatgacaactgtttgttccccaaaactagcgagtgttttaccatagaagaagaaatcaatagcaaatgctctgacctcccaaaagaatatgtcgccagagatcccaccgccgatgaggtagctcccctccggatcagcgatgagcgcgcgtatcggctcaaccgggaagctcttgacggccacctggggctgcaggggaccaacaaaggacatgaagctccgcctccgagatagggttttgtgagtttaaaggaccgtgggttaaggtcgagtgatttaccttgtcccagtggtagtagtggatgggtgctgagttgccggcgggggcctgggaggcggcgaggaagcggccggcgacgacggtgagagcgcgggggcgggaggcgcaggtgcggtggcggatggcctcggcgcccgtgcggaggtcccacgcggcaacgccggcgtcggtggaagaggccgcgagcaccagctgctgcggcggcgccatggtgtgttggaggggacggaagacagggagcggcggacgtgatggcgcggccgcgtgggagaaggccctgcagggggagcgcctccaaggcgacctacttagggttagagtatagctgtcaaatgggccggaccaagacccggccggggcacggccgtactctaggactgggctggccggcacggctaccacaacccatgggccggcacgacacgacccaagcacgagacacggcccggctgacccatacattttattctaaccaaaaaaaaaaaagtccgtgcgttgcaacagatgaaagttattttaatcttattattgttatacattttagttaaggtgaaatctattgtaagaactcgtttggatatatatttttttaagaaaatcatgcgctgcaattaggactctgatcgtttcaaggtagcatgcaagttttttttaaagagatttcttatgcgattccttctatattttaaaaactaaacgaacttaaaaaccgactctatatttttctcagaaaatcatgatctgcaattaggagtccggtcatttcaagttagcatgcgagtttttttaaaagaggtttgttatacgattctttttatatttccaaaagcgaacgaacttaaaaaccgacttaaatacggaactgtatttccaaaaagaacaaacttgaaaaccaactcatgcacggatgacgtaccaaagtaccggcaaaaatatcttcaatttttatattttattcttactagaaaaaatgcccgtgcgttgcaacaggtgaagtctattttaatcttattattgttatatggtttagttaagatgaaattcactgtgggagttcgcttggatatatatatagaaaatcatgagctgcagttaagagtcagatcgtctcaagttagcatgtgagtttttttaaacagatttcttatatgattccttctgtattaccaaaagtgagcgatcttaaaaaccgactcaaatacggatatgtattttcaaaagcaaataaacttaaaaaccgactcatacacggatgacgtacaaaataccgacaaaaacatcttcaatttttataatagttgagatagagatagaaaagagatatagattaaaaccaaaacataaaattaaaaccaactcaaacatagatgacgaaccgcagaaatatctttaatttttataaccgactcaaacacggatgatggaccgcggaaacatcttcaatttttataatagtacagactaggaaaatgtccgtgcgttgcaacgggtaaaaacgtttttgatagctatacattatactcgtttggttttggaccgaaagctcattcattcattcctttccagcccgatcccggttcgctacctcactacgctcggcctttcactcttcgggccagcccaaacgtggagttgtaggtccaactcgcacaacccattgtcgtcttcaaccttcggaagatagtcccttcctcgtacgatgtcgagctgatcctccccattaaatctagtcgaatctttctcgatcttccaaaattggtttagggttttttatctacttgatttcctctttcctttttttttatcaaaatcggaccgcaaaactcggataaaaatggcgatggatagatggagattaaatccattcaattaaagccttggaaaggaagatcaagcggaaaatgatgaggtagcagcggggaatcgatttttcagtctgaatcggctgaagatgatcggatcaaggacagccgatacagccgatggggttgatacagccgattccagtggcgatggctttggggctgtttctagaatctatcaacatgcttcacaaggattgccacgatggagataaagctctcggaaaggcaattgtatctattaattaggatatttttataatttccttagagatatgtttgggcaaaagtctgccgcaaagagttatggtatcttagaatttgttagatataagagtcgtgtccggcaaggacatattttgtaatctcgggtataaataggacccgaacccatgtaatcaattaacacacgttcaataacaatttcggcgcatcgccaccctgtttactttcgttctatttcgacgagttcttactttcggattgagctgcatcgattcgatcttcaactagatgtaaacttatcatggcggcttgcgttctcaggattagtgcttccatctttatgacactctaatcatgtttatgtaattcgtcgagttatcatatacacgttacagtctttgttagttgcgttatataacttgttatcgggtagttcttattgtcaggaagtgaccgatagtgttatgtttggttattaagttagattatatcgtgtatccaccatcacttagaggttttcatcatcttgtttagatcccacgattatctttatgcttaatgctgcatcagttgagttcaatctgttgagttttacttataattgtgatatctggcttgttttatgattatcgagagagatagtatcggggtttcaaccgatcttacttgatttagctactttatatctcatatgcttaattaatatgctagatatgccctttatattaagatcttattgcattaagttatattaggcttcttgtttcaatattctgtttgtcttgatattttaatatagagtggtatcggagtattagccgatacatgctagatctatttgatcagctatgctataaacatctatataatcagtactttactttatatttcgacttaagtgatttatactatctcggcatggcgaccaatttatcccaatcatttagtttaaatatgtattgaagtaaggattatatgttgtcaatatctatagccgatcgagtagatttagtcttatcttatttactcatgactaccgatcgattcaaatatgacatcggcttgaagataaatgatatgtcatcggcgactagtcgatcggttatcgtttatggatttaaccgttgtttttcttgtctttctttcttgctgattgtaggatcaaatcaattggcacgttcacgaacctaaaggcaagattttggacctgcactgaagttaagtagatcttccaggccagtgtgtgtttttcacatcaacacgcttttggcacgcccagtgggaccgagttgcgacaactttttctcatggcagaaaaacaatcaccggcatcgacaggcaaggctccaaaccctccatggtccaagcctccaaatcctccggggaccaagcatccaaaacctccaaggactactcaaccatcatctgaagtcgagactgcgaacattgtcccatatagataagttatcaccagaacagaagaagcagtttgagcaagtgatgaagagcgctcaggagcaattcatgaactcattcaatgaaatccgccagggaacagtcattcagaagtataaggtgaaggtggttgctgccgatgaacctggaacaagctcatcccaaggtgataacaccaaggggacaaaaagtgctgcggatggctcaggtaataaaggtgagggacttcaagatggtacagtcgaggatgttgatgaagatgatgatgaggagcaagaggagcctttgaggtgcaacaatttccaagaccaggttgactatgctgttcaacatgccttgatcaaccaatcaggggtgcttgtcaatactttaacaaatatgattaaatctgtggttgatggcacgatagctgagcatcaaaacacttggccagtctttctaccaggtggcgtcttcccaccatacaggaatttggtgacaggcaaccagcaacatactaccaatgcaccatcggtttagccgatggcagcggtttcgtctccagcaccagttgcaccattctcagcacaaaggcaggtggttaatcctcaagtcttgaccgggaagcaaccacaacatgttggcagaacgccaatcggctaactcaggagcagattgctgcgatgttcgcgccaactcagccgactatcgagccagtacagtcgacaccgaccaagcagcaggttgtacagccgattaggcagcagacggtgcagcagataccaacaggacagagaacacctactgcttagcaaaatctacctgttggagcccagtttgcacctgaacagcatatgtatattgtgcaacagcctcctcagaattatcttggtggtaatttcaatctccagtatccacctcagtcacctcagatccaatatcaaatagggggatcacctcagccccagtttgttccccagctcaatcagtttgatccgatacagcagcagatgcaaggagtaccccagcagaagccttgggcagacatgattgcagatgtgatgagggagcagtttgggcttaagccaaaagacactggaaatttgtatcggcatccttatcctgagtggtttgaaaggattccactgcctaaccgatacaaggtcccagatttctcaaaattttcaggacaagacaatgtttcaacttataagcatgtcagccgatttttggctcaatgtagagaggcatcggctgatgatgctttaagggttagattgttccctttgtccttgtctggatcggcatttacgtggttttcttcgctaccttataattctgttaatagttgggccgatttggagaaacagtttcatagctacttttacagtggaattcatgagatgaagctttctgacttgacagcaattagacaaaggcatgatgaaactgtacaagattacattcaaagattcagagagatgaggaataggtgctacagtttggctttgaccgattctcagttagccgatctggcttttcagggtttgatagctccgatcaaggagaagttttcgtcccaagactttgagagcttgtcccatcttgcacaaaaggtgaccctgcatgagcaaaggttcgcggaggctaagaagaatttcaagaaggtcaatcatgtgtatccttatatgtatgactctgaagaagaagatgactccgaggtagcagcagccgagtaggcccgaagcaaaaggattatagcatgtccatgggtgaagagttctaggaaagaagaaagatatgattttgacatcactaaggctgacaagattttcgatttgctgcttcgggagaaacagatttaacttcctgtcggtcatgtgattccgtcggctgaggagttggggaaaagaaaatattgcaagtggcataattctagctctcatgctactaatgactgcaaggttttcatacagcagatccaattggctattgaggggggcaaaattaagtttgatgactccaagaagcagattaacatggtgcacacgtctggaagagcagccgatggaaacaattatcggaatccacagttcaagtcaactaaaatcattaacaaatatttgaagagacatgagaagcaggagcagaggtattatgaagataacgatggtttcgaccctcattgggattgtgagtttttcaggttctgctggaacgaggggatgagactgccatcaattgaagattgccccggatgcagtgataatgcggggagtacaagccgatcctacagtagaggcaatcagctgggtcaaaaagggtgcatgttcatcagaggttgggtccagtgcatcatgatcgtgatcaagatgaagacgaagatagaaaatcacaatggtgtccttctggtatttttaccaaaaatcagaagagaagggttcaacggatgaggaacagggaggttttcaggaggtgcaacaggagatcaaccattggctgaaaaagaccaagaaagaatggcgcgtcaaaagtaaagttacaacagccgatgaagttgaagtcgacaaggcgaagagattactcaagggcaaggctactgcatccacatcggtaaacatggtctttatgctgcctgcagaattcgaagccaaacaagcctatgtcgacgatgtagaagaggtctctgctaggttgatttggcgccggagcaagcaatctttgagaagccagaagggacagagaatcggcaccttaagccattatatgtcaatgggtttgtcaatgggaagccgatgtccaagatgatggtcgatggtggggctactgtgaatttgatgtcgtacgctacatttaggaaaccgggcaagaatacagatgatctcatcaagacaaacatgattctcaaggattttggtggtaatccatcggagaccaagggagttttaaatgtggagttgacaatcggcaacaaaactgttcctacaacttttttgtcatagataggaagggatcctacagcctattgcttggaagggattggattcgtacaaattgttgcattccttcaactatgcaacagtgcttgattcaatggcaaggtgacaagattgagatcgtgccagccgacaggtcagttaatgttgccaatgccgatttagctctttgggagatggatggtattgattgcctgtctggaaaagtttgggatggagattttctgaaagtgttcgattgtgatatacagcgaattgaagatgaagagcccaaattattactttgagggcgtcgtggagggttcaaatttctacaccaaggacacggtagatgatctcgatgacaagcaaggacaggtcggccgatgatttggaagaagttgatattggtccaggggataggccaaggccaacatttatcagtaagaatttatctgcagaattcagaaccaagttgatagagctattaaaagaatatagagattgctttgcttgggaatattatgagatgtcaggactcagccgatcgattgttgaacatcggctgcctattaagccaggatttaaaccacatcagcaacctccaaggaggtgtaaagccaatatgtatgacgctatcaaggctgaggttactcgcttatatgatgctagtttcattagaccgtgccgatatgctgagtggatttctaatatagccccggtcatcaagaagaacggcaagcttagggtgtgcattgatttttgagatttaaataaggctacccctaaggatgggtacccaatgccgattgccgatcaattggttgatgctgcttcaggacataagattattagttttatggatggcaatgcaggttacaatcaaatttttatggcagaagaagatattcataagactactttcaggtgtcctggtgcaatcggtttatttgaatgggttgtgatgacttttggcttgaagagtgctggggctacatatcagagggccatgaattatatattccatgatttgatcggcttgttggttgaagtttacattgatgatgtggttgttaagtcaaaagaggtagaggaccacatatccgatttgaggaaagtttttgagagaacaaggaaatatggcctgaagatgaatcccacaaagtgcgcttttggtgtatcggctggtctgtttttgggttttcttgtttatgagagggggattgaagtaactcagaggagtattgatgccatcaagaaaattcaacctccagaggacaagaaacagttacagaagttgatccgcaaggtaaattttattagaaggtttatttctaacttatctgggagattggaactttttacacctttgctaagtttgaaagccgatcaagaatttacttggggggcagagcagcagaaagctttggacaatattaaggcatatttaagttcccctctggtgttaattccaccacaaaagggagtacctttcagattgaatttgtcagctggcgagaagtcaatcggctcagttttgatccaggaactcgaaggcaaggagagatctattttctatttaagccgtcggctcttggatgcagagacaaggtattctcccatggaaaagttatgcttgtgtttgtatttctcttgcaccaagttaaggcattatttgttataccgtggtatgcaaagccaatgtgatcaaatatatgttgatggctccggttctcaaagaaagagttggaaagtgacagaatttgaccttagatatgaatcacccaaggcaatcaaggggcaggctatagccgattttattgtggaacatcgtgatgattcaatcggctcggttgacattgttccttggactttgttcttcaatggatcagtttgtactcatggctgtagtattagcttggttaaaatttcccctcggtgggcaagttttgagtttgtctatactatcaaaccttatacaactaacaatcaggctaagtacgaagcagttctcaaggggttgcagttgcttaaggaggttgaagccgatgctgtggagatcatggggaattctttgttagtgatcagtcaattggtaggggaatacgaatgcaagaatgatgtattgatgatctacaatgagaagtgccgggaattgatgaatagttttcggctggtaactttgaagcatgtccctcgggagtagaacgttgaagctaatgacctggctctgggggcatcaggatacaagccgatgatgaaggatattaagatagaggcggctgcaatcatggccaatgattggaggtatgatgtttttcaatatttacagaatccatctcaatcggcttcacgaaagttgcgttataaggccttgaagtatacattgttggatgatgagttttattattggacgattgatggggtattgtttaagtgtttgagtgccgatcaagctaaggttgtgatgggtgaagtacatgaaggtatatgtggtactcatcaatcggcacacaagatgaagtggttgcttcggcgcacgagatatttttggccgacaatgttagaggattgcttcagatattacaaaggatgtcaggattgtcagaaatttggagcaattcagagagcaccagcatcgactatgaatcctattatcaaaccatagccattcagaggatggggaattgatatgatcggtcagatcaatccaccttcaagcaagggacataagtttatattggtggcaaccgattattttaccaaatgggtggaagcagttcctttgaagaaagttgattctgggatgcaattcagtttgtaaaggagcatatcatctaccaatttgggatttctcagactattacaaccgatcagggatcaatctttgtatctgatgaatttgttcagtttgccgatagcatgggtatcaaattattgaattcttcaccctattatgcacaagctaatggccaagccgacgcatctaataagagcttgattaagttgatcaaaagaaagatatctgattttcctcggcaatggcacacacgattggctaaagcattatggtcctatcagaaactacaatcggctcaaggagaatagatctacaggatgatttaccagcttataagcttgtttatggacatgaggcagttttaccatgggaaactacaatcggctcaaggagaatagatctacaggatgatttaccagccgatgagtattataatcttatggtagatgagacagaagctctagtccaatccagactgagagcccttacaaaggtgactaaagataaagaacgagttgctcggcattataacaaaaaagtggtgcccaagtctttttctgaaggggagctagtttggaagctgattttgccgataggaactcgcaataataaattcggcaagtggtcaccgaattgggaaggaacgtttcaaatatacaaagttgtgtccaaaggggcttatatgttacaaggacttgatggtgaagtttatggacgagcatttaatggaaaatacttgaagaaatattatccaagtgtttggatcaattcatgatcggctaagtgttgacatcgccatgagatggccgatataaggtatatcacccttaatggtttttttcttatcataatcggttgtgttctgccgatatatgatggtcgatatagattatatcgcctttagtgcttttttttcttatcataatcggttgtgttttgccaatgaatgatggccgatatttgatatatcgcccttagtccaaattataattttatcaatgccttcaacattgcaaaattagggggggggcaagtatatatgagaagtctggatttccaaagcaaaattcaagagcaagcttcacaagagaaaagttattacatcccaaaagttaagtttcagaattaaattacaagacttagctcatccagacacgtatctttggatggccgatattgccctttgcctaatttgatctacttcatctattgtcttggcatcggctgcatcagtgctagagatcggcttcaaagacttggtcagttcagttagatgctttacagatgctttcagcttggatttctgatcttcgatggcttttggcaaatcggcaagcttttcttgttcaagagcaagttgtgcattgcgttgttccggttcggctaggagttctatcttccggttattcagccgatcaatgttagcttgagttgcacttggaccagcctccaattcatccagcttagctttttcttcgttgatggatgctctattggcttggatggttgcttcaagatctcttctctcacgccgatcggcaatcctcttttgagctttttcaagcttaagccgatgttgctcaaggtatgctgttggagtgatggcattagctagttcatccgggatcttgtcatgaatttcgttgagtctgtcaaggatggatccgcagcttgtcaccaaggtttccagagagccttcatgcctttttgagatatccaataaagttgacttggtatcatcggctaagggcaccagagcttggcttgttgtttcttcctcttcatccaagaatggcctaatgtcaaaagagaacatatcggctaaaacctgaaatagaatatatttaatattatgggttagaaattgtaagaagacagacctaaagtatatacttacagggatagcatgcaggagctggtgatgctacttcttcttcttctacatggtgacttcccacagccgatggagtgttttcacttgattcagagacaagagttggaggtcgaggaggctgaaaacataagtacaagtcagcatcggttacttagagaataaaaaagaaagttgacatgattaaggaagttaaccggtggagatgtcccctgaggtttcttggaagccaccttcttcttctgcaaagtacaaagtcagaaaccagctttaaagtatgagggcgatggataagaggagatgcatacccttggctggtaagtgggacgtattggaggtgatggtgttctctaaggactaggtgaatcagttggaggagtatgctcccttgtttcactaatgtgttcagctgcttcgtccacctcttctgccattgcttcatcttccaggaattcagctacatctggatcaatggctggtagatcgtcggcagcagtcttttgtttcctggccttcttctttgcagccgatggtgcagcagccgattttgctcttttctttccagcagcaggagcaatcggcacacgaggcaggccatgcagcaatgtggaggtcttagggggcattgtagccgataactagaggtgttagtccaccaccgttggcaggagtcctggagcatattggatgtctacaccgctgttgctgtgatgaggaggagaagattctgttgtctgcaaaagaagaatttacataaggttaaaactgatacatcggtttgcagttaacaaaattgacaaaagaaatgattcttacttgagggacagctttagggaaaagatttgtcaagtacatggaagccggttgatggaataaatgtttcttccactctatccatcatcggtcaaaagctgcacctctcagcatcctaaaattgatattgttgatgctgcccaaaggtggtcttggtagatttagcagccgatccatcatgagcaatgatgtgatttctcctctactttggattttgtcagcaaagaataggctgattggcagttgacccatgccgaattgccttgcagcacttgtcggatgataaaattcgtaggtcatttggatgtttttgccctggtgaataccgacaggaatgatgcaagggctgatagctgctgagaatacttctctggatttgtcatattttttagagttgatttcatcaaaccgaaaatcgcctagtagctcaaaaatgccatgtccttcatatgcaaaccaaattctactattcttggggaacccatcataaaagttgttgaaccactctccgaagggcttagccgatagcctggatgtaatgctgaccgatgctgcttctccaaaagacatacatcggcgcgtggtgctcgtttctccatcatcatcgatgatcggctcaaatcttggagatcttgcatcgactaatggtggccgattgacaaccatcctggtgtgcaaatttagccagatccgcagtaaccaccatggaccccctgtaccgaataattctccagaggctatcttgttaattgcggtattgagagtctgatatagatagcctagcaagtattttccaagggggaagtgcttcttttctaccaagttctcggctacacgctgccagtttgcggtaggaccacagcttggaccgcagaacaagaatttttcgagccacatcataaggaaagctgcatgttcccttggagagactggcccagttcccatgttcttcgcaacataacttgtccaaccgcctatgcttctagtcttgaactcgtgggtgagttgggtatccaaactagacaagttagccgatgaagtgacatctagcccggtgatcatgatggaatctaacagggttggggtcatcggcccttgggagaaaaggaaggtattcatggctctggaccagaagtaagaagtggctgccatcataggctcatctcttgccatatccgctgcagttaaggccaaggcttgggatatgccgatttcttcccagtgggttgatttggtagccgatatcctcttataccaagcaggccaagcttttttcggccaacggccaggatttgaaggtgttcttccagcagctcagatctaggttagcaaatctaaagggaatttggttggtttctccattgataaattctgtggggtctagattgccgattaggccaaggaaaaactggaattcatcagttatacaaggaaacgcaacttggtgggtgagatgctacagaagaagagaaatcgaggattgagcggaagaagaaccaatcttgtgcagtaaagaaagggatttagccaatggtacttgtcacgcccgaaatttctatccaaaattccaaacgcttacatgtgtgttaaatcctcgtccaggaatcagccgaggcacacaataacaaattgataatagagtattattaaacagctaattaatactcgcaaaataataagttattacaaaggtggatagttcctctcaaaagaataaaattctacgcagcggaacaataaacaaaagactaaatagctatggcggctccactccacaagcaacttgacccgaacaaagcctaatcctcctgatcatcaccttcagtgaagtactcctcctctgatgaatgaatattgcaagaatgagcatatgacatactcaacaagccacacagcaaatatggaagtgcacaggataacaaaggatgacatagtatagcttatttgcataaacaacatttaatgaacatttgagagaatagtaaaacagttgagtaattaagcaatattaaataaacaccatacaacacacccgtgttgcataggcccaacctcatctgaacaaccaaccccggttgtacaaatcaaacctccatactaggaatataccattccaaaccaggagtcaatttaaatatcacaggttatcaccattaatgagtagtgtgaaactaatcacgaaaaacattgttagactcgcccataaccgcgcacacggctatttgaatagttttactctggccagatatgtaccactgtacccacaagacacagctccacgacatgtcaccatgcgcctcaatacaaccacggtacctcggaaaggaactgtgacagtacccttcgcacaacacacaacacaactcaccacagtgcaccatacctggatcataatcacctcctctacaactagaggcatggacatcccagcgacccccacggacctctcgccgcttctcagtctggcaccccgtaatgaaccatgctattcaaaaggtaaagctgtgacgtgcacacgtctatggatcacgtgtgacgagaagttgtggcccgatcttctcaaaggatccacgaacttgataactatcgccgagagtctgcacacgcgacgaactatcgagacaatcacccttccacgtaccgacgaagccagcccacgcaatcacaccataaagatgtgaaggcacaaactaggtgaaccgtagttcggcgttctacaattccctcgggaattgaaagaacaaatttgcaagcctctcgagactcacatggaaagaagaactcaaatagtttgtatttctaaattggcagccaaaaagtccccttgtcatctattacatggctatatatagcactagtggagtctttaaaaacataaatgaaaacatgcagtaggaagtcacaataatccttgcattcatggcctagtggagctctcttgatgtttggacttcatttgcatgcagctccacatgcgaaacaacaatttgaaggttttatttactatgtatagcagctgaatggttcctctttgctatgcacgtccaggctccttagtccatatatttggagggtagaaaccatcatcatcccatgtccgttcgtgcactccatcattcctaagaacattaaaacaagtactcaaaagcataggctcatccaaagtaatttgattagttaacacaaggttagcgttcacctgagagtgaatttccttctctaattgtttggctctgctccttgtaattggacccactatatcagatgcacgtttattaggaggtggggaagagtggctgctagggatgtcctcatcaagctgttgcccacactggcttgtggttggcacggttaatgtttcacaacagtagctcgcgaactggtccttaattgtcatgagcacgaccatcaaaaccatgtgctcataacccacctttaatcgggttttaattatcaattaattatcataacacgattaaccatcgtgagctaccattatatataaccataaataataatgtagtgtgattcatcccattaatgagctaatgtttctaggcatggctaaacaattatatatatagcatttagctgaaccaaaccaatatataaggttcaagccaatcaatttataacccataggaaaataaagtcatctttggccataattaattggaaaaggctccccacctgatgacattcgaaaataatgcataagttgaaataaaatattagctttaaacgggttcatcatgctcaaagggttgtttgggatctgtgtgacttgccttgagcttcttcaaatgcttctgaaccttcctcaacgtaaacgctctcctacggaacatcggaaactaaagcaaataaacaaaatcaacaaaacagttaaaaaaacaagcataaacagtatatgtggatatttttaacatgtagatctcgattttagatgaatttagcaacttgaaccacttgaatctgagttacgatgatttagttatgatattccgaagtttaatcagtttttcacctaatacagaaaattattaagatttaaataaaatatttatgatgtcaggatgacatccctgccgggtatggttctggaccacacaaccgccggcgaacgaaggcacaacggcgcaaacagagagcaccatcacaacgagcacgacgagaggaacccaccggtggtgacggcgacgacaatcgatgagagaaaatgaccggcgacgaactccgacggcgacatggctcggcttgacgacggcggcgactctccagcggtcttcggcggctgcgaaggggcggacgggatgctcctccacctggcgaatctgacagtggtgacggaaggcggcggtgacgatcatagcggcggctgaagcggctacggtggcgtcggcgctagggtttccgcggcggcggcttggacttgaggcaaacggaagaggacgactaggggatgctttatataggcatgggtgagggagatcggactccaaacgagaggatttgagccggaaaatccgacggttagtttggagagataaactcgaaaacgaatccaaattcgcatcgaactcaaagggataaaatcggatttttggggaaagggatagaagaggataaaggaaacaaatctcctcaactaattttagaaatgcacgtgaggaaaggccggaattggaggggaaaaaccgagccaattcggtctcgggtcggctgacagaggttgaagaagaacagtgcatagggaggcatagtagactttcggtcttgggccggctgaaaataaaacaaagaaagaaagagaagggggaagctcggctgggccgacttgggccacacagcactcgcgcgagggaagagagttgggctgaaaacagcccaacggcttaggggaagatttaaaaactttttcaattaaaataatttgtgaaatgatgtttcatttattaaaaatactttccttactcaaataattcccagaaaaaatctaaaaaatagataaacaagtaaagtatttaatgaaattttatccaacttagttttatgttgcgatttttcctagattattagagtttaacttgtaagcttttaaaataatttctaaaaatgcattagagaatgaattattaaattaggcgattttcagggcgtgacagtacttacctcgacatattcggtggccgatgcgcttggtggactggtagaggtcgacattgctagtgatgaagattggagttgcggagaatcgcctttgggtcgccggaaacttcgaagttgtcgtcggagagctcaaggaggagatcggggaaagttttcactagagtggttaaaacggaagctgacgccgtgaaaagtgcaaagcggtggttactatttaaaagggagcgcggtaacggccaaaacagagtcggtaatggaaacctagttttaatcggaaggggaaattgagcaaatctgccacattacaaatatagcggacttggggggcatgttttaacgaccaaatttggtaagacatgaaccaggttcggcattgggatcgaagcggattcggcaaagagttagattcaaataacagcgtgcgcatcggctgtcaagacatcggctagagtctgaatcggttgaagatgatcggatgaaggatagcagatatagctgatggggttgatacaaccgattccagtggcgatggctttggggctgtttcttctagaatctatcaacgtgtttcacaaggattgccacgatggagataaagctctcggaaaggcaattgtatctattaattaggatatttttataatttccttagagatatgtttgggcaaaagtctgccacaaagaattatggtatcttagagtttgttagagataagagtcgtgtccggcaaggacatattttgtaatcttgggtataaatatgacccgaacccatgtagtaatcaattaacacacattcaataacaatttcggtgcatcgccaccctatttactttcgttctatttcgacgagtttttgctttcgggttgagctgcatcgattcgatcttcaactcgaggtaaacttgtcatggcggcttgcgttctccggattagtgcttccatctttatgacactctaatcatgtttacgtaatttatcgagttatcatatacacattacaatctttgttagttgcgttatataacttgttatcggctagttcttattgtcaggaagtgaccgatagcgttatgtttcgttattaagttagattatatcgtgtatccaccatctcttagaggttttcatcatcttgtttagatcccacaattatctttatgcttaatgctgcatcggttgagtttgatctgttgagttttacttataattgtgatatctggcttgttttatgattatcgagagagatagtattggggtttcagccgatcttacctgatttagctactttatatctcatatgcttatttaatatgctagatttgccctttatattgagatcttattgcattaagttatattaggcttcttgtttaatatattctgtttgtcttgatatcttaatatagagtggtatcggagtattagccgatacatgctatatctatttgatcagctatgctataaacatctatataatcagtactttactatatatttcgacttaagtgatttatactgtctcggcatggcgaccgatctatcccaatcacttagtttaaatatgtattgaagtaaggattatatgttgtcaatatctacagccgatcgagtatatttagtcttatcttatttactcatgactaccgatcgattcaaatatgacatcggcttgaagataaatgatatgtcatcgacgaccagccgatcggctatcgattatggatttaaccgtggttttttttcttgtctttctttctcgttgattgcaggatcaaatcaactggcacgctcacgaacctaaaggcaagattttggacctgcactgaagttaagcggatcttctaggccagtgtgtatttttcacatcaacagacacgcatgaggagatatatcgacgtggcggtggcgtggccggcgatgtaaaaaacaagacatatagaaaaactggatccttaccgcgtgacctaaaaaatagcaacaaaaagcgaatggaaaaaaaggaaaaacaactaaaaaacaaaacggacaaaaaaatagcgatgtaaaaaaagatgaaaaaaaggcaatcgtaaaagaccgcgaggaaagaaataataataaaacagatgaaaaaaagcggaaaaaaaacaaaaaaaggcaaaaataagaatacgaatgaaaatatatcaaacgttacttattttgaggtaaaaaataattaaaaaagatgaaaaatactggaaaaaataaaaaaaaaggcgagaaaaagaaaatagacgaaaatatacggggaagcagtacttatttttttattagttatatatatagatatagattttttttctaatattccctacatattcctcatttttttttcttattgcccctattatttttccttttttttcttgtatatttcctcattttatttcctacttttccgaaattttccccgtattttttttctattttttcattcattatttcttttttcatttttaagctttttgtttttatctatatttcaccaacaatagtcttacatcctacatacttcatacaaggtcaggattatcgtcgtatttggatctaacgcttccgattactccgacatgcaacctttattctctgtctagtagcggtgtaccccctcccatattctttcccacgccacccacatccggtgctactccgcgcctccatgtcgaggaccgtcgaagccaacgacctcgctgatctcctccgcgcggccgctgcccaagcatcacgaatataggcaactgccgaccagagctgccccctaccatcgccacgcgcatcgctgatctactccgcgtctctacctcgggggcagttccgcgtctctacctcggaggccacaccgtcgtctccatggtgctactccgcgcctccatgtcgaggaccgccgaagccaacgaccttgccgatctcctccgcgcgaccgctgcccaagcatcaccgatataggcaactgccgaccagagctgcccactaccatcgccatgcgcatcgctgatctactccatgtctctacctcgggggtggttctgcgtctctacctctggggccacaccgccgtctccacgccacaacagacaggcgcctccaaaacccaccgtcgatttgtccgcaccaccaccgaccttcaaggacagaaaaagttcataatagagtaaaataatactccctccatctacttttgatagtcatatttcatcttggcacacagaccaatgataagtaattctgtttatcatctatttaaacatgctactagtcattcctcgtaaaaaagcgattcattaatatttatatttctcgatgcccatgtagccaatcatatgtggaagaatggagagtcacgcattaaatccgagaaagtcattagatgataagttgttggattgaaaaatatgcctatcaaaaataaatttttcagattcggaaatatgactataaaaagtagatggagagagtattttaagaaatagtctataacagacctccctccccaccgtcgatttgtccgcaccaccaccaactgtcgaggacaaaaaagttcataatagagtaaaataatattttaagaaatagtctataacagacatccctccagaaccgcgtagccagcccatccgacaggcgggcccacttacacatatcacacttacactttcgtcctcgcttcatgtaaaagggttaacctgggagtgatatggtaggagggaagatgtcttataagttagttccactcatgctaaactagtaaggtggtactaaacatgcacacactactcacatggggcacactgacttcatcctaattaggctaggatgtcacatagtcatcggcacaagtattcataataaacaatcaagcaacattaaataaggagctaccctcctagttttaatagtatgtttatttttttaaaaaaatattgctatatttttctataaatttggtcaaagttatagatatttaacttggaaaaaagttatggcgttttataattattaaatggagggagtagcaatcccgattaaatattcatgctaagcttttgttgattacgctttcaacttgtcacatgaatcactttttgcttaaccaaacagagtgaaatgacaaataagttgtgataggtccaggttagtaaaatcccgagttaatgaaatcacacaaatacattaaacagctcaaaggcagagaactatagagcatccgaagaatattactactaggataaggttcatcaaccctgtgttgaccggcttgaatcatagtacaagatcatattaaaacacatggacgatgataacgaaacgtaagacctccatcctttgaaggtctgattattgctcgagagttacctccacttcagcgccgtcttgtacctcgtcatttgtaatttcagccctgctttcggtttccctcggtagagtgctttggataccaacagaatcttttaggagtatgttcctagattgataatctgtactgtaatacccatcattttcttcggagaagcttagttgccctgcctcttggttggaccgaacagtgatgctgccaatctcagaagcatctttgctcactgcattccattctaacctccttaagaaacattcttcaatatcattgggcgacacatcatcgtcgctgccgtagctaatgtaaggcaaccggaaatcaattgacgtgtgcctcctggatgcaccaatcggctgttcattgacaacattttgttgaaggaccttggcaacatctttttggctttgagaaccatcatctccaaaattgtcagtgtcactaccactgtcaccaccttgttcaacatgatgatgcatctcatcaagttcatcagatgaagatgactgagatgaaattgctgagtattcgctttcatcatgctcacgttctctaagcgtcttgagaatcaatgtcttgagaagattcatcacttgaacagcatgcatcagagcagtaagaggatctgacatctgaatgcaagtgaactatctcatcttagcgcacttgcatcagcatacaattgatcacgtaaaaaaattcttatggtaagaaaaattacctgcgtcatattgggtgcaaagaccatagcgacatttcgggcattcatcttgtttgactcctcttcctcgacaacatcagccatgaattctacaacccagttaagaagtgcagcctgtgtcggaggaagaagccgtacgagctcaacacattcctcctctgtgttgcagtgaagaacttgctcaggtgagaggctatccagtacaccctcagggagttctctgaaccaggcctgaacaaaattgtgcagcatacgtacttaaaacatcaaactaaataatactaaatgttaatccttagtgtgtgtgttttagatcagtcccattacttagttgaaaatgcttagggtactgaacattagtaatctcatcatttccatggtgccagcgtttctgatcaggaaggctgtttaaagattatgtagactgcatcccaatcagaagttctttgtaatttattcctacggagataacaatttcttattgaaattcgaacgcgcatagagggaaaaaaattaaatgactacagtttcagttaaataaatcttcggacttacatcttagttcgactttaaataattctttaataacatttaactaaggatcattctttaatagcatcttactttgcaaatattattattacttaggaagttatttaccggaccaatctccattaatatccaggtatttaaccttgtcgagaaaagaaaactgccctatgtgggtacattctttttcctaataattaatgggcactgaagaactaaaatgacactaggatttattaccttaatcaaacttgccaagcaatgcacatcgatgtcgtcgggcacaaggcccctgttaagctgctccctgacattctcctcctggctgttctcaggggtgatacggaagatcccttctgcctagataacgaacaaaattaaatttactaacttagctcacatcgagacgcctagctccgaactgaaatttctccaaagaaaaatggattaatggagaattccagtgagagagactctgatttgttgttcatacaaccttgaggccatcctgcgcgtacagcctctcctgcatgagtaacagaatcttgggcaccgagttcccgttgtcgtcgaagcagcactgcatcgactcaggtgacacgccgaaaacgctcgcactgcacggaatcaagaagaacattaaccggtaaatccaacgccgagagacattaaccggaggaatcattgcaggcttagatttcgccagcgcgcgcgccaggccaggcatacaacgtatactagtactgacctggcgctggggacgtggcccgggatctcgagctcgaactcgccgggaagcccgaggaagccgttgaggcggtcgaaggtgacgtgagcgacgtgccggacgtcggtgggccacccgatctccatcccccacgcgactgctgccgggtcgtcagcgtcggccatctggcacgggagcaccaccgacctgcgtagcgcggcgagtagcagggcgagcacctgcccatgttgcccctccgccttcccctcgccgggtcctcctcctcccgctcccttgactcggactccaactcttcctccgcctccgctgcacccatgattggacaccagcaccgcctcgcccatggcgaccgctcttctcgtctcctcacttcactggctgtcgagctgagctaagcaacgggacagcatgtgctcctccaagtggggaaagagctgctcttttaaaaggcagcagcgcgcggtgggaggatgcttttttaagcttttgcgtcgtcttcgtgttcgcgaatcgcgatccgctattttgaaatgggggagaccgcgtggggccgagcgcccagacaaggaggggtcgaagggctccaacggctgtctaattcaaacttcgggcatgtttgcattttagtacctcaactgttcaaataccaaataactgaaggaccacatccaaacagacgttcaaaactgttcggccgtttccaagggaacaaaattagcaaaatctgctataacacaaaaagtttgtggtctttatcatatgacaccttagaaacgtgataacgctattggacattccaaaaaaatagtaattagctaccggacatcgcgatcattgtttaattatttttgatcctaatgaaggtaaaaaccatgtggaaaaggcaatccccccgaccccgcgggggaggggggtgcttgtaccctaattgggtcttgtttgaaccatacccaagccgctctccatccccctgatcacttctccaaaacaatagaatttgcgtagcggtgccgacgtccacggtgcctacaaacatctgcccatttccatcttcgtttggagagaaaataataaaacaatggtcacggtatcccataattaattatcagtttttcgggtgcccaacaaccacaagttttctaagtatcctacatgaaaggccacaaaatctggattttctgtagcaaattttgtcaataaaatttagtgcagcctggctgcaaaagggcttccgatgctgccctggtttatgtattcaacagcaactcttgccatagtcattttgtggtgaagcttattgcttgctgtttgtggagcacctgtatgtgctttttaatgtgcatggtgttggcaactctttttttttggcaagaagacaatcacgatcaggacacctaaacgccttgcggtgatatggagtcgccaaccaccccgatctagccaacgaccaaatcaagatggattttgcaaactagaccggctagcgaagccgatctaggtgcaacaaaggataaccacccgtctcgtgggcaaacggaagatttacgggacaaacctacaaaggggtattacactctcagcgacggcggacggtttatggcgcaaaccgacaaagatagactaaactaggataaagtagaaaacatgactaaaaaataaaggtaaaagaacgattcgattatagagattgttgggattggggattggtattaatcgaaccggccttggcccttatataggtgttggtcttgcctcctacaattatctatttcttgtcaggctgaaaggagaaggaaacttggggaaacaaatttcttgttgttaaaccaagcgcaccatgttacgttttcttgtcaatgcgtattcgtatttaatttcctaatcagcagttgatccagatttattcatttagatcatctactgccagtttaaaaaaacatagtgatcacttgaattgctctgtatgttatgataatattaataactattcttccaattgttagaaaagatggatctgttacagaattaaacgaaatcccacacttcagtgtaagtgtggtattttgtttaaattctttaacagatccagtttttctagctttttgtgaggctggacagtatggtcttggttacaagcctcctagcatgtatgaatggaggaaaccagtgctacataggcaagttaagaagacaaagagatgctagagactcacagagagtggtggaaaaaaatgggatgcacaattatgacaaatggatggacagataagagaggtaggagcctaatgaatttgtgtgtcaatagtgagatgggcactattttccttcgagctattgatggctcagcagatactcatactgcagaacatgttttgagagtggaatcaaagatgttggtgaagaaaatgtgtttcatgttgttactgataatgcttcagcaaaccttgcagcaggtcgggtttttacagagaaatatccttgtatttaatggacctcatgtgctgcattttttttcgcgaacgcgtaaaaggattgcacatcaatatattagaagaaaaagagtttagttacacgatgcaatcagccagaccggcttatgccaggggaagggagaaaaagcaaatgaaaaaaatctgaagcttagagaaactacggcggcttaaaacatactccacgcaacagaagggaccaagccatgctacactcccaacaaatccccaaaagcggcgacgccagctaaagaccacagatggccctccgaatggatggactccagaaccactgagaccgaagagagagcggagtcgaaaaccct

SEQ ID NO: 69005 - DNA, 1038 bp, Oryza sativa
cccacgacatgtcaccatgcgcctcaataccaccacggtacctcggaaaggagctgtgacagtacccctcgcacaacacaatccaccacagtgcaccgttcctggatcataatcacccccttataaacaaggcatggactccccagcgacccccgtgggcttatctctgccacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgaccatcaaaaccatgtgctcataacccacctttatcaagttttagttgacatattaattaattaaccaatcacgattaaccatcgtgagcttccattaaatatccataagtgatagtgaagcatgatttatcccattagtgagctattgtttctaagcacggctaagcatctattataagcatctagctgaaccaaaccaatatataaggttctagctaatcaaattataacccataggtaaataaagtcatcttcggccataattaaatgggaaaggctcaccacccggtgacattcgaaaataaatgcacaattaaaataaatagagaatttaaatgtaggatcaacatgctcaaaggaattatgtttgggatctgtgacttgccttgcaataaagggtcttcaattaatcttcttgaatacttccgacgcactcacgaaccttcgaaacgacggaaacgacaagctaacatgcaaaacgaggaaaaagactaagaaactccaaataaacagtacatataaagtaaacaaacatgtagatcatgatttagatgaatttagagacttgaacgacctcattccgatttcatatgaattaattaccaattttacaagatttaattcccatttaacctaattaaagaaaagataattccaaattaattaaccaatttacaaatccctataatgagagaaaagattaaagcaacctccggaaaagggctgcagga

SEQ ID NO: 69006 - DNA, 801 bp, Oryza sativa
taatttaacaatgtggtgttacagtaaacatttgctaatgatggattaattagtcttaataaattcatctcgcaatttatagacagaatttgtaatttgttttgttattagactacgtttaataatttaaatgtgtatgtgtccatatatatgatgtgatatgccaaaacttttcatctctggatgtaaaattgtaaacacagccatatacaatgtgtcgttgcctgcatgcacgcagatcctggatggtcgcggcaaggaggagaagaagaagcgcgtgggattcatcctcctcctgtccgacggagtggatcagttccaatactcgaggatcaattgggagaaggtggcgaagagcaccgacgtcgaccactccgaagttggcgccatgctccgcaagtacgcggtgcacacgttcggcttcagcgcgtcccacgaccccgtgccactgagacagatctccgcgctctcctacggcctctactccttcgtctgcaagaacctcgacaacatcacagaggccttcccccgctgcctaggaggcctccgcacggtcgtcgccgccgaaatccgcgtcgatctcaagcccaaaagcagtgataagcagcagcagcagcagccggtgctcatcaagagcatcgattctgggggctatgagagtcaagtcatcggcggcggaacctccggcaagatcctcatcccggtactctacgtcgacgaggtgaagaagttcatcgtccacctgaaggggcccaaggtgtcggccaccaccgtcaataaccagcaggagattctcacagc

SEQ ID NO: 69007 - DNA, 1435 bp, Oryza sativa
  unsure (1)..(1435): unsure at all n locations
ggggaaaaagagagaggggatggcggtggagcttatataggggagggggaactcggacatggccagtaggggcatgattcccggccgacgtgggggaggtggaggtggagagagaggcgggattcggaattcgaatcccggccatcttgggcgcggcactancgggaatagggggatgggtttgggaaatccgggcataccccgacgttgccgacttggccccgaagaaggcggaccttggctcccgcggccgttttgcgcgtggtgggcaacttggggacggggggccggaggaaggggacaaaccccaaggggggggccccactttcgctttcccgggaaaaaagggaaggccgtttgggccggccccaaagaagaaggcccccccgcngctgtcgattgacttgccccaccgccccagtagaaggaaaaggggggaaaagaaaaagataagggggaaaagattttccctaggatttaaaattgcttgtgctcaattttaattggttaaaattttttcgagggctttgaaaattccactaaaaatcattgttagggtatttcgacaggtagaactcaagaaaaattccacatgctaattccgattattatttttattaatttataaaggtttactcttgcttaacactggtattttttgagcccattaacactccaatttaggcttggaaaagaacttcggggtgtgacaatcaataagggtggtttgcttttaaggatgcaacaaaacctcaactggcaattcccaaatttaatctttcaaattccttgcataactccaacggcaactgtggtccttctgtagcattacaatagcctttcctgctgagagcatctgctacaacattagcctttcccgggtgataattgtcggctcccaaaactaatgattcggaaaccgacatgtttaactgtttcaagccctggatcagtagattgatacaggttcaacaatctagatcttcatcgcatacatttggtaaagactccaaaggagatatctttatataaaataataggacatttacaagtttgtggctaactattacagcagaagctatatgatgactcaactctgtcgttttactatagaattaaaccatctaactatactactagacttgaagactaggtttaaagggaactaacttatgtgattgaactcccagcttcggcaaaaactccaattaaactctgaaaaagaggggttgaagcaagggtgagtacaacgtactcagcaagctattatattattcaccaatgaatgcatgagaggtaatatctgtgtagagctagatttacttgcagaaggctgagaataaagaggtagaacttcctgaaatgtatgatatgcaacagtatttaagaaaatcttgaattatatttctaaccaaagtaccatatgagtccccga

SEQ ID NO: 69008 - DNA, 1046 bp, Oryza sativa
cgctctccgccgccggtcggtccggtcggccgccgtcttgcgccgctgccgcatgtgcgccgcgccgtcgcgcgccatggtcgccgggccggtttgcgccgtgcccgcgcgcaccggccgcgagctcccgccgccgtccgatctacccttgggtagatcggggccatcggttcggccgccgcgtggcgcgccgctcctccccggtccgtggacccgatccgccgtggaccgccctccccgagccgctgaccggtggggcccgcttgtcggcgcccttcctccctccccgagccgctgaccggtggggcccgcatgtcggcgccgcgccccccttgatgacgtcagccctgggacttattgcgcaataaatgatttaaggactttttttatagtaataaacacagtgaatcttctaaaaatcataactaattcatccgtgctccgtttaagcccattcaagtctcagtaaatcaagaaaaatgtgtagaatccattaaaaatggttttgttctctgtttcagtagtcttatagcctgtttgcattgtttgccttgtatgtcgttaattccggttcttctacgctccggtgtattccagatagtcgccaaggttcctccaccagcagagcaaggcaagtcatgtttgtcacttgaacatgttgatcctatattgcaaatgctctattgtttttcttcaaatactgcattgttttataatgttactatgggatgttcacctattgttacaaccatgctattttggtaccatgctccttgttagcttgggttataacatgaatagactttggactaggaattgcttagccatgtttagttcaactagcacacaatgagggagatcctattactgtttagactgtaggttctaatggtaatgttgaattagtaccaccgctttggtgttgattaattaaaatgaatcacatggtgggctgtgggtgcatggttttgctagtcgcacccatggcaattaaggaccggttcatgggatgccctggaagaacttatcgtacttaccacaagcca

SEQ ID NO: 69009 - DNA, 1720 bp, Oryza sativa
actacatatatgcatgtactgattaaccggccagcatgccatttggcctaattagaatactcaggagcatttgatatatttcccgtgttctctctttccgtccaacaccaaaactaatactccctccgtttctaaatattggcaccgttaacttttaagaactgtgttgacctttcgtattattcaaaaacttttgtaaaatatgtaaaactatatgtctacataaaaatatatttaacaatgaatcaaatgaaatgaaaaaaattaataattacttaaattgtttgaataagacaaatggtcaaacatatttaaaaaagtcaacggcgtcaaatatttagaaatggagggagtaaaatagtgggatgatgtcagtagcaaggagccacattataacagtgtgtttctctaaataaatatttacttttacgctacaactaaaccacgaagtcgcaaaatccaataacagattttaccatatttggtgtttcagaaaagattaagtacacaaggataaaagataaatgtggcataaacaatatacataggaaatagaaaattgttagcatttcatgttcacattgtaaactatttaaatttatctcaagttaaacttctatagctttggctgacttcataaaaagaatataaaactaccacacccaactaattgagttagaattattatgaaatatgtctccatagtgcatttatttatattatagatattgctatacttttctattacttattagattaacttagaaaaaggattaatgaaaaggaccattattgaacctatgctattataaatgttcggataaacactacacctactatttggtaacaccaaaaattagaaattaaaaatattattaattacatatatttttgtttatagacgtatatgggcgaaaaaatagggcgccaacaggcgcaccgattttctagtttatatgtctatttttagtctctatactttgtgtgccgggcctggccttccggcccgaccgtgccgggccagcccagcatgccggttgggaggcccaggcacggcccggcggtcaggccgggccggcatggacccgaccccagtcgagccatgccgtgcttgggccgagccaaaatgccgtgccgtgggccggtccttcgggcctcgggttttatgtccatctatacttgtcagggaaaatcaatccttttaattttatttttcatccttcctctcgtcttctttcttctctggttcgttcttcccaggtagagcaaagggagaagagaaggggggcgccggtgctccggtggctgggtggttgcgacgccggcggccaaacgtgttcctgagggtggggcacccaggaagggtggtggccggcagagagagtgtgggatgtggccggaacagtcggtagaggagctcagctctggcgacaaaaagaggtggtggtggtggcttgtttcggaggggggaaaggaggggaaaatggtgaaatgggctctcctcggcgaggcgaggctggtggtgagagggaattggaagagttgctatggaggaggagatcggccggtgactttgtggtagccggccatggtggagagagaagagagagctcgaggagcttagttgtggagagggatggcgagcttgctggccatttataggcggagagaggcggtggagtaagtcggctgcggaggagaacggcgaggagtacacggc

SEQ ID NO: 69010 - DNA, 1210 bp, Oryza sativa
tatctgatcggctacgctataaatatatatagtcctgttattgatatatatttcgatctaagtgatttatactgtctcagcatggtgtccgatctatgccaatcactcgatttaagtttccatcgatttagggagtttttttcgtaattttctttacccaatcgagagaattaagggttaattacctattcatggacggcgaacgaaacacaaatgacattgggttcaagaataatgatatgtcatcggcattctaccgatcggctatcatttataaatttaaccgcggtttctttgcttctatttcttgttgattacaggatcaaatcaactggcacgctaacacatccgaaggcgagctttggacctgcactggagttaagcagatctcccagccacgtgttttctatcaacaaatacccaagttatcatcaatggcataaggtaaacaagatatggctgagtggtaggacccatcccacatgatattgtaaaacaatgcaacatttaatagaaatgcgggacacttgtaaattgggtacaatatgatcaatctaatgcatgacttgccttgctctcgcactgatgagaccacagcaacgtcttcgagaaaccgcggatcgacggaacgaccgaaatctacgcaacaaacaaagcacacaagcaaaacatgctataagtctactgaaacagaaacaaaaccatttttaatggattctatgcatttttatgaatttactaagacttgaatggatttaaacggagctcggatgaattagatatgatttttagaagattatttgtgtttttactattaaagaaaagccttattgatttattgtgcaataaagcatcctagggctgacatcatccaaggggtggggcggcgccgacaggcgggacccaagggtcggaggcacaagggagagggagggggtactagcaggcgggccccaccggccgcggctccaaaaagggggaggggcgacgtctgccgggctcggctcggctccaagccggccggccggctacagcgagcggcggcggtgcacggtcgccggcgatggcaaccggcggcggcgaacggcgcggaaggcgtcggcgtccgccgaaggcaatggcgcgcacgcggtggatggcagtggacacgggagggagagaaagagggaggacagggagttctcaccatggggttggccggcgcgggaag

SEQ ID NO: 69011 - DNA, 19428 bp, Oryza sativa
aaagattcgtctcgcgatttatatacaaactgtgtaaatagtttttctttttatctatatttaatgctccatacatatgtctaaagattcgatgtgatgtttttgcaaaaagtttttgggaactaaacagggccttagtccaatacacgaaggtaatgggaactggagtggagtaggagtaaatctggttcatctcaaaagcttttatatgtcgtgtttgaatttactgttgacacaatttgtaatttttggcgcccatgcttgtttggtgtaatagttgtaattttcggcgtccatgcttgtttgaagttacctaaagagcattaaatgcttatttgatagaatctacgtgattttagaaacattattttagtagatcatattattggcagaagttgggggtttgtcccatctcacctttttaaagctcttttctgttcacttctggactttttggctatgtgcctacgggtagaggccggagatgtaacccatttccattatctaaaaaaaaatgcttgcttggcattttcaccacttatgctcatttaatgcactgtgaatattctatccatctctcttgcctcaatcataatttgcatgttttattaggggtattttagtcattcatattctctcttggtatgtgagatgtgtactataactgcatttaaaataggatggaggaagtaagtaacataagttttatagctgatttacttacttatatatgtaccatcacgtacactgccaccaatccagggccaccaacgtggtcttgctgccgaggagcgtggccgcaaaatcccaccaatggttgatcacatgcctagctatgaccatgtgtgttagctactccctccgtcccacaatatctcaaaccctagaatcccaagggaattttaggacaggtggcaaaagactaaaataccctcagtgaaagtacatgcaatcattggagacaaataaaatagtagtactactcagccaccaagttggataagcatatttctgatgctgccattaagtgctcaatatacaaataatacacagcaaccagtgcgccaaatattttgaaactcagcattgcttcattggcgtcaagcattacaaatttcagcacacaccactacaacaaccctatataagtttgaaatgaacctcaatagcaggtttccctcccactgaatcactgcatgagtcttcaaaatcacctgcatggctcttgatctaaacaagccaatagatgaggcagatgaacaggctttgcctgacgtcaatgacgaaattgctgaagttgaaatccatcttggtcaggaggaggatcaacttggaggtgatgtccagggaggtgacaaccatgtgcttccttttgatctcaatattgatgcacctggccctcaagtgcttccttttgatctcaatattgatgcacctggccatcaaggagaaatgaatctaggtaactttgcaagcattaatatgaaatgattaacatttgtagcactgactagcataaataactcagaatctttgctagttctctgaaaagatgatcagtaacatgtgccttgatgcaatcgctatggttttggaacaaaatcaatctttgataagtatgaggaaattgttaggacttgattctatcaatgagttggccctaatgaagttaattccccttccataatatcacaggttatacatttagctagctgaactaatgcaatacttatctcctgttataatgcttatctaatgtctagaatcaatcctgatatgctacatactaaacaggacaaatcagaaatcaagaccggtgtttaaaatctgtgcactagactccctctactgaaaaacatggttgagggtagaataataaaattgctacacagaaaaactaaatttcatatgggtatatagttggtaccttgattgtggttatttgatctcataatctcctgtgttgatgttgtacagcataaaggaacatatattaatcattggttccattagttatgtaacataatagattagttagtaataaaagtattttggatatattggaaaaaaagtataaacattattcttttagtcacacacatccagtaaggcaaatatgccatggcatgtcaaatatcaagtatcaccagcagcgaacagggcacataatcatgttttctacaacatggcagcctttgtattacttactatatctatttgcacgcatagaatggatgaactaaatcattcagttatatatagagaaacagagatgatcactaagtggacatttcataggtctatctggaatagatgatactttgcaaattgaacacataccacttcagtattgaatcatgggtaaaaaggattgtgcttgcaaaaaatattgctatttgacatggtactaactactgaccgtggtaattgttattgtagacaatggcgatgcaatggatcaagttctgcaactttatggaggtcacatccataatgcctttccttttgatatcaactctgatgccttcgaggaacacctacaaatgcaagcaggtactattattacatcatgccaactacctagaataattcagcaatgccattggctgcattagttgcatcaatagttaaggattataaattggatatttcagcacatagtaaatcacaacgaatgatgggattaaggattataaatatgctaatatgttgtatttacatagatttttcatgttaattggctcacagccatagcaatctcaaagaaagcacatacagtaaattgtgccaatgtttctctgccttctaaatgatatgtatggttaaatcatattataaagtaaaccacatggtgagcctaacaagttgtgcaagaactttattatcaacatgagcacttaatatggagatcacatttccagttttgcctactacgattgttcagtacacatcaaattatataatgcatggtcatgtataaaaagtatatgcatgttgtatcagccataattttgcaagcatgttcatccatgacgataaaaaatccaccatctaaattagtgcagacaactcacctggaaattattgttgtagacatgcaggagtacggtttgtatgccggtgatgtggacattgtttttaaacacgaggagttggatgattcagatcaggaagatgaacagccatacaaaaatctgaccaatatacaaaggcaacatatatatatatatagcattggttgggaaaactaccaacagaatcctaaggaaaaaggctaccactgaagttgcagaaatgtttaatgtgaaaagagctagagtgcaagatatttggagaagagcgaagcaatgtcgtgcccaaggaataccaatcgatgtaagctctagaaagaaaaaaaattctggtcgcaaaaagaatgaaatcaacctatcagatattgctaatgttcccttgcaactaaggggcactttacggtcatttgcatcagccgcaggtgtaccaaagagcacgctgcataggatgttgaaagaagggatactaagacgtcactcgaacacattaaagccattgttgaaggaagagaacaaacgatcaaggctgcgatggtgtctttccatgttagattggcatactttgccaaatgaacccaagtttgttgatatgcgcaatattgtgcacatcgatgaaaattggttcaataccactaagaagacaagaaatttttacatggtccattgggaggatgatccatacagacctgtgcaaaacaagaattctattgataaagtgatgttcttggcagcagtggctaggcctagatacaatgaagaaggtatttgcacttttgacggcaagataggcttgtggcctttcaccaaaaaggtatcataacatcttcatatatgcatttttaattactgacggcaagataggtttgtgatgcaaaacttaattgttaatctaacttacataatttactatttaggaaccagcacaaagggcaagccaaaataggccaagagggactcttgtcaccaagacaatcaaggttgattgagatactgtcagatcatttctaattgctaaagtcctaccagctattatatcaagttggcctcgagaagagcgacacaacactatatggattcagcaagataatgctccctctcatgtgccggtggatgatcctcaatttgcctatgcagtatctcaaacagggtttgacatccaccttatgtatcagcctcctaattccccagatatgaatgcactagatcttgggttctttgcatctctgcaatcattaacatatagaaggatatcgagcaggaatttcaggcttatgatgacaacaagctgaatagggttttcctaactctacaatcttgcttgttagaggttatggaagttgatggtggaaatggatacaggattcctcatatgggtaaagagaggctagagcttctagacattctccctaatacccttagttgtggtcgtcagctatatgacaaggtcagaacagcattatccaaccaagtgcagtaaatcatgcaacatgagaagctctatcatggtttcagcttttggttaaatgtcaggttgtatatatggtaaagtaagatcagtattacgcaagtaaatgcaacaaatcatgtaatataggaagttttatggtggtttcagcttttggaatatgtaatataaagttttatgatggtttgaacttttggactatgtaatataggaagttttatgatggtttcagcttttggcttaattttagattgtacataagacattgtaatatcagcattagagtaaatcatggtgcaaacgtctccttaatttcagtcaccaccataaaccatcataatttgaaatatttcgatacattaccatcataaccacctaatatcatctactaccataattacacatgctttcatacaataccaaaagtgtgcctactttgacagactgtcaaggcttctattcataaccacctaatcttatctaataccatatttacacataatttcatacaataccaaaagggtacttatcgagttgctttgtgaggccaccattcataaccaccaaaccagcacacaaacatcacataattgaagcattcatctaaattttgcactcttaaaacactccagaaatttctttaccgatttttccaatgcatcttggtcttgcaggaggtcttctaggccactatcatcatatggatcttgcgtatatcccccaatgaccatgtcttcatcatcgtcgcttgacttcacctcctcgctgttcccctcctcgctgctcacatccttagcttttcccctcatctcctcgatgccgatttgcttgacgcttgccttcttctcaaacagtgccgtgtggtcgctatcgtcaaccaacattgtcctgaaaaggataaaacaatagcatttgtaaacaagtcacaacaaaataaccactttttttaacaatataattactgaagatatgcgagaagatgaaattgaaatttctcttgaaaaatatcacatttctgccatatatttatatttatatcgatgtaattgttgaaacaaaataatcattgttctcaaataagaaaaccttgattaatcattactgtttaaagaaattaattaggttgacaacttggtaagtgggttaggaatcaatcagatatgctgcatctatctatattcaacttatttaggcaaagcgcaaacaaacaatatcgatacgtgacataagtcctcatctattgctgtcacttgctgtcaattagaatgagctggctactgtggttgagaggaagaatatgcatgcaggttgaagacaaaaagaatatgcatgcagctttcgcccaagaagaaaatatgccattggacccaatcgagtacttaacgaaaaaaaacactgtctgtctcaaaacataaaaaacacactgtatatccttttcttttgtgccataaagcagcaaccagtctattaacacacaccgccgaatggtaatcattcatccatgagtttagttaagtgcttcaagattttgtaggctctgtaatttgaaggatcacatttcaatcacctagaaatcactttgggcttttaattagctgattaattgggtaagtcttgtgttgctagctacggagtagatttcttttgttagtttagttttgtgctaatgacttggagatgcagtacactgcgtagctatcttacgcacagaggaatatgagatctgcttagtatatcttaggatgtaatagcctgagaggcattggagccagggagatcgagtgggagatgtacctttgagtcaatcgacgcataccgccgccaaagaccctagttgttgatgccggaattagaataagaggctggtcagcctcgtcctccactgccccctcctttatcagatccgcgggcgccgccacctccttgagcattacatcagctgccttgcaaacctccgacgccgccgctgcatcccaacagcctccacccaccgccgccgccttcttgcaaacctccgccgccgccgccgcatcccaactgcctccacccaccaccgccgccgccgccgcatcccaactgcctccacccaccgccgccgccgccttcttgcaaacctcctccgccgccgccgcatcccaactgcctccacccaccgcagtcgccgccgccaccgccttttggatcacaaccgcaagccgacatgcctcctccgccttggctcgtgtctcttgaatcaaaaccctaaaattttccgccgcttccatgaacggcgctatcgagccaaacacttccaccgcagccatctccggcatccgatctaactactcgtaaccctcccccgccgcatctgagtggaagcaactagttggacggggaacttggcagggagatgtgggagcctggcggagcagcgtggagcaaggagggacgtgcggggaggagcgggagtaaggtagggagggagttggaagcttgctagggtcggtcatctggacgccgccgcgtcgatgccttcgatccagaggggtgaggggcgatggggaggaacgggagggagaaaaacgcgagagggggagagagaagcatacgagtagtatgcggctgggaggagataaggttccgggaggagagaggagtattttggggaagtcgccactcaccacccacctgtccccacacatgatacggatagagaggtcacgcggttttctgtgcaggaatcgatttttttcgggacaaagccctccctccaggaatcgagatattgtgggacggagggagtagttattagtcatgtagcccacgttttatcccagttatcagctctttcgaatttgagcccaccaatggttttatcccacgtttcaaacttaacaaaaccaaggctgtgtttaggccctgtttagattccaatttttttcttcaaactttcaacttttcgatcacattgaacttttctacaaacacaaatttccaacttttccatcatatcgttttcatttcttcaaacttctaattttagtgtggaactaaacacaaccttagttccatgcaaaaattgaaagtttgaaaaaattagaacgatgtgacggaaaagttgaaagtttgtgtgtaggaaagttcgatgtgacggaaaagttggaagtttgaaggaaaaaaagttggaatctaaacatgtctcaaatctcgttcaactggaggtagaagcttcgagatcttcagtttgtaatctaatctaatgccgttgtacgtaacgcacggacaccttcctagcaaaatctaaaatttgatgagggagaggagaaggcgtgtcaatgctgtcgtcccagggtgcccagctagcagctaccattggctcggtgtgcccaagtgatggggaagtggtaggggtcagcccaaccaacattccgacggtgtcaaccccttttgacctgcaggtgggaccaccgcaaacattccgagtattgtacgttttgtactcgaaaactccactctgttctccaaatggaaagcataactagtatcaaatttcaatgtacattttgaatcgaataagtaaaaactctagacaaaaacgctctctcaggcggtcgtgctagtccgccaaccagcactgcctgcgccgcccacgcgtcgaacacctcctccctgtccctgaaccgtatcctccggagccggttggttgttccgtctgccgggtggcgacggcgccagcgtgagcagcatcccagccacccactcggcctgcagctgcgccggcgccgccgcgacgcgccagcgcgtggttcccaccttcacgagcaatcaagatcttggtgaagtccctggtgacgtcgatggaagcacacatgcatctgcctctgctttgctctgctctgctcgtgggctcgctaggttgggggaaaaagacgaggtggattgaaatccagttccaatgcggataagaaaattcagttaaaagttcaaacgaggtggtttgatattctgcttcagcacgcactgaacgcaggctgagtgtaagtggataagaaaatttttgttatgccatattgccatggcgaaaattcacaatatgtattagaagaataatacattgaagatctaaaagataataaaacaaacataatacatcaaatttagaaagttttgctactacctcaaagaaaacaaacttcaggaaaaaaaaaagttttgccataatgtcttgggcgatgacttaatgtcaagtttttactcacaaacatcacaaaagatttcgggcgaggacttaaagtcaggaaggtttttattcaggtgggtgcaaatgcaacaatatattcagtgctgtggatgatcccaaatgaaatatcggagttcagatacatcagacagccaaaaccaacacaagcaagtagctaggaatacacttgtttggagttccatcttcagaatttcagatatttgcactagaattgcagaaccaacaaccatcaaacacacaagattcgtttgagttgctatgtaatttccctggttttcttataattcgaagaggggattttgatcaatcttctctatttacaagagaacattactgtacatattcttagcatttacaccgcacaaattcgtgcaaaccatgttgatcacaacctgggattagtagattacatgactgaaacctgcagctaagctagcagctatcccggcggcgatctcgctgcctcatggctggccgcgtcccagcggctacgactctgagaaacgacaccccgccgacgattcctcccacgtaagtggagaacggaacatggacggccccacctaggaagaatcctcaagcgcccgaattatgttctctacacaagagattagagtcgacaaggatgccacccagaaaccgagatcttggtgtcctgtacataagacatccaagcatactctcgaagattgcctggtgatactccatgtgaaggctgaactctacgcctgctgggaacgtggaattcagcatacttcaccaacgggtgctatttactgtctgatttacaagtccagatctcacgatcttacaagctgcaagatcttcctcaggaccttcaaactgccgcatcattgtgtccaataaccacgagttcaagctccgtgtgttgccaaggaatgagatgtagtgccgacttcagatcggttcgtgggatacgttggcactaacccaaacgagccatctgtgctaaacgtgttggaagactacgaatcctcttcggagccaccacgagatgtgaacgtggtcgacaccactgagatgggctgatatgtgggcccaatagtttttattttttccggatcagattgctacgtcagcgccacatcaacgttatgtaaatgccacataggacgaatacctagtcaaaggagccacataggcgccccatcagctaaaactggggaccatactgccgagagagctaatttgcaatgattttgtaagttggggatgcgtatctagttttatggtttgaggatgattttgtaattcggtaacaagatgagggacctctggtgtactttttccatgctatatactcccaactcccaagtagcattagcattaccgagaatggcccagacaggtttttacggtgctttaacaaaggtagttgctattgaacataaatgcaacaaaagctagggttttttcgtgaccgacatggttttgggctggcccatatcacatcttgggcccaaatttctgtcacgagacaaccatagtttaatttgtgtccacaagacaaatatggtgctaaccaaccacgaaaatcatgcatatttgtagcactcaaatatcgaccagtacagttgttgatccactggctgcggtttaatttttgtttgaccgttgatatacgatgcacaaccagatgtcggaggaggttttcggacacgaataaaaaaactaattttataactcgtctggaaaccacgagatgaatcttctaagcctaattaaaccattattagcacatgcaggttactgtagcacttatggctaatcatggactaattaggcgcaaaagattcgtctcgcgatttctatgcaaactgtgcaattagtttttgtttttatctatatttaatgctccatgtatatgttaaagatttgatgtgatgtttttagaaaaaaaaaattgggaagtaaaccaggccgaagtgagtgcagatgcacgcatgcaaccatggcagctagcagaggcacctgcagcagctaagctaggtttccctagatagcccgcctgcatgagcaaagctgcgtacgtatgcaatggcattttcttgcaagctttggccaggttgggtacgtctccatctgcaagtattttcgttcatgttatatttgggtcctttttgcttttcttttatttttttattttaagaaatattcacctagcataaaataaatttttttaattaattagactagggttcaagaatacataaattaattagactagttaagttattactccctccattttttttgtttgatgttagttagctcaaaattgaactaactaacgtcatacatttgtgcaaagaggtagtaatttgttagagtgaactagctagttattacacgattgacacgggggccttggcccccagtcccactcggtgtaaaattgttaaaattgttgtttagtgactcatattaaaagaacatcttggttttaatttaaaacattataatgatctttatagagagagaaaaaaaatattgcaagatgttcaaaaaacattaacagtgtttcaagaaacaagtcatattagggttgagataatttttctacataaacatggccagttgtaatcctttaccattagcattctatgaaacaacatatgaatacattatttcccttactccattgtctgttaaaaaatatttgatttatgacaaagaagtatttgcatttatatttgtgtatcgttattgtttccagacatttgaaaaaacaagtcttatattgtatttgtatactaattttttatgattttggcaatgcacccgaaccactacgtacaagtatgaataaacatgtcctttctgtgcccccactcagttataatcatcatttttacatccactaacaatcctcaatggcaaaatttagaaataagatggaaatatttcatgataagacaaaatagtgaatttattctcacaaaaacttagaaaaagtttatcacactttggagatgcatgatttttgttgcatgatgggaaataagtactcatgctttataccttattcagaaccgagagaaatcaagactgaatgccactgtccagactcggtttgttaccaaatctagaagaacaactttgattaaagaccaggttggcgtaatcttaggtgaactgaccatggagggctgaaagcagagggctaaaagcagttatcaatagtataaacacattttctgcaatggtaaagcaaacattaagacttgaaaggcactatctccaactggttatgttcctgatacttttcagcatgttgttcccctaaattctgaagaagtacattattctcatgctgaatatttggtatctccatatgcaaatcctcaatttgctaccacaaaaggagtgaatcctcatccataggaagaacatcaatgaactccccattaagcacaaaatgtgtagagtccttgactctccattacctcccatattagcaggatttaccataacaattctttgagccacttcactagggtctgtataaagatattttgtcagaactctgccaagaacactttctctgtgatgccaacgtattaacttcccaaaagtgtttgcaaccctataaatgtgagtctcatttctgtaatccgaaggaatccctaaaatcattatccaaccttcccgattgaaggggatatcaggtctcataaagtgttcttggaaagccccattatttagcatcaaatattggccggctatcaaagtatccctatgcaactcggaaggaacttggatcaggcataaaaagggaaacctgagggcgtgaatgacatgcatgttgaactgactgtttacggatcaattgcaacattttatatatgtaacaagatccacctcaacagtaattctgaatagacttaatgtttgttatacaatgtataatttcagactaagcaatttaaataccattattgtgagtaactaaacaacaattttacaccaagtgggactgagggccagtcaattttataccgagcaggataggggcttagcccccagttacatcgagcggttacaagatcaaaggatatttaggtcgctactgatgtagtctacatcctattaaagaaagttatactctctaatagatttttttgtgtttcttaactttggtcttgagagtagtataatatgtcgataggttagagggacaactaaaaaagtatagctgttagtgagaattgcaccatgtagttgattttctcccacctatcgacccactcaaacttggtacataggctagatcttgaaaacgaatataaaaaaatggttcaacttagctgagcattgggcctgatcataattatagctatattttgttagcttctcttcttatgtggcaaatcttctagataactttgttactttctttgaaacataagtagcgataagtgacacgtcttgtttagtaaccagttataaatgtcataaaactagttcacaagtatagctaatatgttcatttcatgtagtatactaaattgaatattttcactggcaattgcaattctaagactacaaaagttgtaaataaaaaaatttaaatacttcccagatgactggaaacaatattagacaataacaatataagactggatacaaatataatataagacatgttttctcgactggatacactaacaatacataaatacaaatacaaatgcaaatgcaaatacttcttcatcataaataaaatatttttcaacatgcagtggagtgaggaaaataatgtattcatttgttgtttcatagaatattaatggtaaaggattacaactggccatgtttatgtagaaaaaatatctcaacacaaatatgacttgtttcttggaatattgttaacaattttttctagcattttgcaatatattttttctcaatgaagatcattcttatgttttagattaaattgaagatgttcatctagctaggagaaacaagtgttttacttcttgcttctggatatcacacaagtactacttagaatccaaaataagctaaatacagtcagtgtagcatctgttctttgagagataatggtgctagtatattctaacagcatgtggcaatcaaataacaaaagataccagatctgcaaatagagaatcctattgtcaagtgaccgagtgttatttatgcaaatcctatatatgatagatatgtacttaatcctggatttataggtgtttctactatgaaggtattattgttgttaaaactgaattataagcttgaatgccaatatatttaaaatgctagactttgctgttaaaattctcattaccagcccattggtaaatatgcttgcaatgtgaccacagcaatgcctcggtagtggcagctgtcgtagtttaggtttgttggttgtgagtatgttcagttgtggttttagtttagtttttttattaactatgtatggtaaggttttgtctcatttctctttaaaatgaggtatataaaatacaatggtaatggcttggtctgtttagggaaaaaatgtattactaattaccatatgtctaccctaaacaagctaaaaagtttagattacagtaccactatctccctctcaaaataattataattctaggtcgtttagcatatattaaggtttgaaaagaaagactatgatgcccctcattaaatgatgtataggtaagagttgaatagtggttgagggtagaatagggagaaatttgaataagaagtaattgatgggacaattagtactttattatgataactattttgggacaaatttgaattgtagaaatacaattattatgggacggaggtagtacaatttatttttgaaaacaaatataagtgcaaatttggaaacaaaaattttgaggtaccatatttggaaaagtataaggtgtcatactgtgcattcaaacaaccatgcccttgatatatactccctctgttctttgatgggtatattaatggatggaggtagtattatattttgaatttattggtttcatatacagggagaaaaagtatgtttctagatgagaggggtgattatgataatttcttatgctcccatgagctcaaattaacttgacagattttctatctcagatttatatgaattcttctcaagccagaattgagcgaaaggaagtatctttttttacggtagcgctaatccacgcgctgcgcgcggaatattagttcgagcgccgtacaatgctccctccttccgatctttccgtttttttaccaccccacctttactccgtatcccatctttcctcagtttttttttgttttgtaccaccccaccttctatgtttcttttttctcttttccatcttatccgtgcttcatcaaaggacctttttgttttctgttccttctctctaggttttctgttttcgccttttagtaaaatatttaccgtttagtttttctttcggagttttttgtttttccagtgtctccccacgtttcaaaagtaataaatttagtctgtggagttttccatttactcctaacctcccatatctgctaattcaaaactaacaaatttactcgcatgaatgcccctttcaaaagtaacaaatttacttgcacaaatgcccccacagtgtacgtgcaccattcctagattgtcgtaaaagaattactaccagcatacaatgctagtaattctttcaccagtgttataaatattgtttagatttcgtggtctgcgactaaaacaattaccaccttcctatcgatatagcccatgatctcgtagccaccgtgtagtaatatgtttcttgatgtgtttaatacacagtataagagtaaaaactgggacttcgtggtctgcgagtaaaataattaccaccttcctctcgatatagcccatgatctcatatccacagtgtagtaatatgtttactgatgtgttcaatacacagtataaaagtaaaaactgatactaagagtattgttaatctgtataaaaaatgaccttacgaataaaaaaaattacatgctcaatcacacacaagtgatagaattactcacaagtgaatcaaactagaaaagaaaaaaaatgattcagcgaaaagtccatcgtgaaactgggatcctagtgactttgctggatcttgctataaaaatggagaggatggtttgtgtattgttaatgttaatggagagggcaaccgggtggcgagcggtacgtgatgatggaatcaagggagggtgtagtagcgtggtatagagatgggctcgacattgcacagtagcagccatccatcatctagcaagcacgaaaaaaatgcaaaaacattattgttcatgtcatagagacgacgagcaaaagaaaaatagcaaacaacctccatcaccagcggactccaccctatcatgtggctagacacatggagcacgatgtgcaggacctgtgcaagccatcaatttagatcagataatattggagattacatgttaatttgatttgcaaaaagaaattggggcttcatgcgtgaacgtgaaggtgaaggagagtatgcagatgcaaatcggagtgccatttccttacttgcttgttctatcaatattgccgacgtggagcagccgccggctgttgctcttgacctaggtgaacacctccttgctggttaaggtgttgctcggcgtccgatagcgaggcccggagcagcgccttcgcctcaaccgccgccggccgccgctgtcaaccaccacgatgttgtcgtcctcctccacggtgcgtcaccgatctatgggctgggatggtggatcgattcagatctgaaaaaaaaggaaataatgaagtgggggcgagagtggttggttgggtacgagaaaaatagaatatataccggaagcagggaagttgtttttatcgccgtaaatcatttactccgataatagtgggagcaggatgacgggacatagggttgtatcggaagtagggaagttgtttctattatcgaagtaaatcgtttacttcgataatggtgggagcgggatgatgggacatggggtgaggtgggcctagactaatacatgtttggcgctcggaatattaggaacgcgctgcgctcctaatagtagtaatattaggaacgcgctgcgctcctaatattaggaacgcgctgcgcttcagttattcctctgatcttgtatctactgacaccggcaagatgtgtaacaggaacaatctgaaggacaccctgctctctgtctacgggaacaatctgaaagacgccgtggacgacgaactagtcgaggtaatcaaaccaacgaccccaaatgaaatgtaattattgatggttctaatctctggcatcaaatttgtaaacactgaactatccccaaaactaatccatgaaactcttcctcgagacaagtctctccagttcttcactgctgccttttgtcgtcggaattttttctgttcgagctttgcacggccgcgtcctgtcgtcgttgtgttgatctgctgccaggcctagcgcctttcccctcgtagctcgatgcccacagacgcacgaacacatgtcccgatcaccacatctctcactgaatccacactcgcagatcgtcctatgctctctctctctctctctctctctctctctctctctctctgcaatcgaccaatcgtggactggctgattcggttggactgcaatcccgctgttccctccgagctgattttattgtaattattgcgtccgatttagagtctgttaggaaccacaacctctaatctcaattccactcaaatatgcaagcatccagtacaatagcaaccagtaaatagaggtagaagtgaggatgaactaagcgaatacaagtggtggaagatgccagaaacttctagaaggtagaggaagaaggaaggtaggtagggaggaaggaaatcgacaaggtgccaactggccaccaggtcgccgccgcggttcgccgttcgccaattgatctgttcgatgcctcgagcagggctgctgctgccttttgtatcctttcttcagcctccatgggctgggcttgtagtatggctaacatagcccatgtacagcccaattgagttcctaacagagtcaaaaaaatatagaatcccctccttgacttgccgagttctccgaagttcggcgagcctattttgtgcctctctgaaacccgtccgtcgtcggagctgttttccccaatccaggcaccgcccgcttcaccattgttgcgccctggcttctcatcgctcatcgccattgggggtaatggctttctttttccctccctctcttcctttcaccctgtcgcgttcgaaccagcactccatcccaaagccaaatcttctccccttcgctgggaatttggtcgctgctagcgaatcgatgtagcttggcaacggacctactctgccactcaccgccggtcatctccagtgatccagtgcctaactgatccgtctatcctcgtcgtccttctccactcgttccaatcctatgctccacctccactttaccctctcgtgcctccgttcgctggagcactgccggtcatcgatcccgcctgggttatagatggccatgtgggtcgtccggcacggcacggcctaggcccggccgtgcctaggccgaggcttgtcgggccggcatggcccgactgacgcatcgggccgtgccgtgccgtgccagcccacgtaacgcactcacggcccaggcacgacccaacacgcctcgggccgtgccgggccggcccgaaggcacgatgggctatcgtgcttttcttcagaataagcctaattttcgtccctcttattgggctgtgacatatatatagctaaaaaaaagtctattttacctccctctttttttggctgtggtagataaatagctaaaataagtctatttaaggtccttattctttggacaatgacatttatatgtctatttttagtccctatactttgtgtgccgggcctggcctgtcgtcccatcatgccgggccggcccgatcgtgccgtgctgtgcttgggccgggccaaaaagctgttccgtgggccaggccttcgtgcctcaggccttttggccatctatacctggggtcaactccctccggttaacagatgatatggctgccacgttgggctcaacgggcccgcgttgcgccagcgtccagcgagatgcggcggccacaagctaggccgacggccttggtagcttgcaaagcctcaaggcctagtaagccttgcccaccacaacatctcctcctccctcatggtccagaatccgaaatccaccaaccccctcctttccatgtggaataagttcaccggccgtccctcaaccacaaaaccagaaatatgtacctgaactatgtaaaaccgtgcataaaatgtcccaaggcagtatagaggcctagtcagcaaaaataattaaaattaatatgttgggcccacatataagtgagaaaatggtgtgggtccaacatttcaatttttttttcttttctcttctcttctctccgggttctctcgagcaggcgtagcgacagagggggagagaggtggccggcggtggcaggagagggagagagaggcggcgggcgtgacggcggtggcggga

SEQ ID NO: 69012 - DNA, 1552 bp, Oryza sativa
gggtgtgggtagggggagtacactggtaagtacggcgcacgctagctgggggagcgcggcccactgggagtgctggcaaacccgcgggagctgtgggaggacaggtggctggcgtggcagaggctgcctgagtcccaagagacagtgtcaactgaggtgacaccctcctcggccagacgggcctccagagcggcgtaacggctgtcaagggagcggtaagcctcaaggagtaggtcgtgctgagtggactgagcctccgaaagctcaaccatgcgagtcagcactggctgagactcgctgtacggacaagggtacctggcgtctgcgtggccagaaggaaggcgtggaagctgccggaaggctgagcccccgagacggtggctgtagtcgtgggccaagcgacgaagcgcagtccaggagaggtcctggtacgcgatctggagagtgggcctggccacagtgaagtggtgtgggcgaaggccaactccgtgtatacctccacgagggtaaaggtacacagagagctcacagtgagggggaacacggtccacggagtaccccgtgtactcggggcacgagaagccaaggaagcgggcgaggtcacgaagctgagcgacgtggtgaccctcaccaaaaccgtgggaactgaagcaaactattgaaagagggagccatctacaattttgaaagagggagaaaagatcagtaaccattttagaaacaaactattgaaaataaggaaaccaaaagaagccttagcttttcgcaagtagttttgaacttagtatccttagggtcgtcctaaatgtcgggtttcgccctagggccaagcctgtgctcttataccatctcttgtcacgccccgaactagtaccgaccggaactagcccgtgacgctctaaattaacctgttaatcgataccagtcccaggaaacggtgctggtatcacaggaagacggattatcacagcaacagaggtctctttattatagagtagaggtacagtcatgttgggctgtggacagatcccgagctcacaactgcattacaaaagggaagcggaagccaagacatggaccaaacaacacaggcgcgacttgggaactaggccgaaaccctaaaactcatcgtagccggcttgctcctcgaagaactcctcatcagcaggatccgcttcatcttcttcagcaactggggggggggggattatttatatagagcaagggtgagtacgggagtactcagcaagccatgggaaataagtgtttaatgcaggcttcaaggaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacagcttttcaacggccacccgggccaacaacttttcaaacggccacccgggcctagctgatcccatcagctacagatttttcaaacatcgaaccccttttcagcaa

SEQ ID NO: 69013 - DNA, 14305 bp, Oryza sativa
atttcatcgaaccctcacatataaagtggcatattgtagtggcatattgtccgtttttttcactattgtagtagttgatctagtattctgtctgaactacatattttttagttaaaaagaataaatgaagttcatataggcattcccagagcaaccacgatttagtttttttaaagaaaaatgtgggttttttagtagttgatctagtttcgtatagtattatccaacaattagccggtgtgggggctatggaacatccacaaagaagtaaccattggcccaaacaagaggtttacaatagaagctgagttgttgggcctttttatgcagatgccgacccgagctgagaattcaaatatgaatgttcaaacaccctaattttgttcattctgatttaagctctgaactttatcttttgacgttcaagagtgcacatagttgtctagcacatttggaggaatgaaacaatgcagctgagaaacataacagtatattgcaattgtggcctctctatgaattacttcatgaacagaagaaactaaacagaaaaaaggtgaatcaatcaaacctgcattttgcagaaccgattagtagtgaagattcttcacaaatcacaaaaccagatcaacatatgattaacttacagattgcttttcttgatttcacagatacattgtgttggatagtatataagaagaggtataccgcgtaatataggacacgttgtattgagcctcaggagggcggtatatataggagtacatggggaggagataaggaaggattacagatatgaaaggagttcacacaaatcaatcctatctaatatgactctaactaccatatactctaacatcccccgcagtccaagcgtgagcagcgcggacacttggactggagaagaaaccgacaagagtgctcaacacggatgatagccctttatgccattgtcgacgtagcctgaaggagccgagagagccgtggtcgatgaagccgtgcgtagagtagccgtggtcgatgtagccgaagtcgggaagctgatgtcgagtttgccgagccgcgggccacgcatggggcgccgtagagtggtcgtggacgcacgggagggcgtcgtggaccaaggtgcgcaaggatgcgctggagacgaagacggtgacataatcgcgacagtcgttgaggaagatgatgccgaagagccgatgtagtcgaaccgcgaaggacgagacgtcacacagggcttgccagaccccgggacaactcgggacgaacgcgcgcgccggtgttgccaataccgcgcgggcgagacaggggaccaccatgaatcatacgccaatgtcggaggagactagcagagaagacctccaagacggtcgcggcgcgagaacggcgtagagggagaattgccagagtagcacgcggttgtcggagaaaggcgaagtgtagtcgagaaagatacgacgacgctggcgatgaatcatgttggacgaagacgaaggagaagtagtgggaccaacggcctggatggcgacgtcggtagccatgtagaggtagctgcaccaccggtctagagtggcgacagtggcagcttggagatgcggcggcgatgctcaaagtagaggaagaagaccctgagtggctgacgatgaccagtacggacgacgaggttgtcaatgcgcgaacggcgatgaagacgacaaaagcggcgaagctgcggtccgagaggacaacatagctgcagctccatgtcgatgcaatggcgagaagtccaccgatgatgtagccatgctgaggacggtgtctctcagcactgcaataaccagtggaggtgtggaccacgggcagcggcactgcggcccaaggggacgacgcagcggcaacccgaagcttgatggcgtagatgcgtagtcgaagacgattggcagcaaggtgtcatcgaagctgggcgcttgaacgggtgatcaagccaatgatgcgcgggcaagatgacgaagtggaagcagagtcgatgccgatgtcgaagacgcacagatgtcgacgaggcggtgggcgacgcaaacccgatcactgatcgggaaaaaaaatggatacatagcagcagtagcaagcaccatgtgtcgggaggctagagctctccatgcaggccttgaccaggtcaaccagcctgtgcacccatcttgtcgctcccatgttgtctctctcctcacttgctaaccacggcaagatcacagcaaaggagacagtcaaaagaacaataggcaaggtagcaagagatcgacttgacgtagacgagcggatgggaacggtgttggcatcgtggaggaagacggccggccgcgggcgtcctggaggaagtcggccggcggcggaagcggagatccaaggcgccgacccacgcggtcgcggcggtcgtgccggcctggtgggcacaggcggcggtccaggcggaagaggagacgatggggacggccggacgggtccccccgtaccctgctgcgtccaacgacggcgacgccagccatgcatgcggggatccgtcggccacgccggcggcgcgccgtggcggagcgcggaggacgaggtgctggccgcgacccaagaccggcggctactgtagtgctgtgctgcttgacgacgacaatgacgaacggccttggccgaagagattgatctctcttacgacaagcacgatgtcgatagagaaaaaaaaatcggtgcccgccccgggagcgagatcgtctcccgggggagacggcagcggaagcggtgagcggcggctctaggtcgtccgctctgataccatgttagatagtatataagaagaggtataccgcgtaatataggacacgttgtattgagccttaagggggcggtatatataggagtacatggggaggagataaggaaggattacatacacacaaatcaatactatcctaatatgactctaactaccatatactctaacacattgatggtgattcagtctataattcaattgaagcctgaactagatcaacatattactgcagcttgggcaaacaatggaactacaggacttggacttcttatttttcaaccctgaagcgtcagacccaactgaaaaactgcaagtctgaaatcagacagatggcaactgaagttagtactttagttctacagactgttaacatactcattattgagattgcagcctgaaactcttgcttgctgactgactgctcattttgcagggacacacaacttgcaggcttgcaggatagtaaggatcttgtgcaggaactgaacaaaggataccttcagattttcagaacaggtccatgcatttcactgaagtactatataaaagccctcatgtgattacctagtctagatatgcacaacatcaaactttataactgtagaatatatgtttattctgcaaacccttgtgtttaagcctttacagtcataagtttctgacaagaaaatcagtgggtactaatgttcaaagagatgtggtgaagtaatgttctaggtgcctgatggaaatcatagattcacaatgtaagattgtaagatcaatgtgcattgcattaaaaccaaaccgatttaggaactagggtagatggaagcagcagcttaattataccatctgtgtatgattactcagggagactgggacactgaattgtgtcatcgagtttcagagtttcagaagtgaagcttcacgcttgttgcactgtacacgaagaaagtgatgctctgttctgttccctggatgacttattagtgatctttacttatttattttttttgacgcagattttacttatttattttgatagaactagaagaaaataatttatatagtggcttggttgcagacttgcagtactcttccgtcgtcaagtttacttgtgtttatatgttgtttgaattttgaagccattagtcttcaattctcaagttcacttgcctgtttaactttaagctgaaaatcattatacaaaggcacaaaattggattacaaaagcatgtggacagtgggaacaacactactcataatcagacacattagcagaatgaaccgctgttgcagaatgaaaaacagaatttctattaagaatgaattttattaccatacgaataaatgaaacataatgcagatttacagagaactagataactaaaatctttcctctccataaaattcataatgccattataaaattcagtggcatatatgatatatcatatatctactactaatagtacttagctactgctattatgatctatccactgaagggacggaatttcatgaagtcgccgacgaagttggcgacggcgcccgtggtggcggcggccgacacgacgaagccggcgacggcgagcgccctgagcccgatccacagtgcgctgccgcgccgcacgccgcgctgcgcgatgtacatctccgtggggaggtagacggtgagcggccagaaggagatggcaccgaggaggccgacgatgacgccgaagaagggcagcgccatggcgaccacggtggtgaagcagacgaacaccgagcgccacgccagccggaacgcgctgatggcgaagggccacacccggagctcgctgttgacgaagccgctgtcgggccaccggcgcgacgccttgcgctcgacgaaggcgaagaccggctggcagtacacctggtaggcgccgatgaggtgcacggcgatggcgacgttggcggcgtcgacgagccagaacggctcgaagaagccgaatccggtgaggaggttgtccggcgccgcgttgccgaacgccgcgtagcccatccacccgcacagcgcgtagaacaccgacgtcgccacgatgctcagcagcgacgcctgcttcatcaccttcgcctccgacggcggcggcgccttgatcgtgtcctggatctcggtgtacacgttggagaaggcgaacgcgaaggcgatgttgcccagcgcctgcagcgaccgccacgccttctgcgtggcggtgacgttggtgacgccggcgatcgtgccgcggaacccgccgtcggcgacggtctgggcgatgccgaggccgaggccgacgccggagtaggtgaaggacatgacggcggcgacgatggacagccaccagatctcgtggaagtcggggatctgcgagaagacgatctcgaaggcgccgaagatgagcatgtacggggtgctcgagatgtggcacgggacgttgtggccattggcgtggaagcagcccgccctcttgatggcctgcatgctgatggaggcggcgatggtgtagccgacggcggtgccgacgaggttggcgtactggatgatgccgcagagcttggcgttggcgccgccgaggatggcgcggacggcgccgatgtaggtgtagttgcgggcgccggtctcctcgtcgccggtgcggtagcactcggcctggagcgtggcggtgaagtaggtgacgccgccgaacaccaccatcacggcgggcccgccgacccacccgagctgcgccgtcgcccacggcagcgacagcaccccggacccgatcacggcggtgatgatgtgcgcgctcgccgtccagaacgtgccggtgcggcgcggccgcccgtcgtcgtcgagcaacgccgagtccgcctggttgccggcctccagtgacacctcgagcggctcgatctgaaccatggcggcgaacaggagcgcgttcccggtgttcttggcacggaagatgcgatctctctgctctcgatgtggcaatggcgtgatcaagattgagatgcgtgtggagaagggaggccgccgggagcgcggtataaatggcgggagcggggagtcgacttgccgcgttcatatccgaggcgggaacggagtttgaatcggagacgggagcctaaacttcatccaatctgggggagataaaatttggcatattttagctcggacaggacgacctatccgattgggagtgggactcgttaaaatgcactctgttctccgactcgacaaacacgacaatactcaaatttcaatcaacggttcagtttttcaggtcgaccgaatgatttgcggatcaaatttcattaggttgagagtttaaaatcgaattaaaactctcgaaacactgcttatctattatccttatccttatctttatccttactttattatcctcaaaaacaaaatctctgctttcaaattttttcgttcggactccacccacgcgtcactccgagcatcccagcggacacgtcacgcgcggccacacgtgttggcaggaatatactccctccgtggcgtggctgttgtagttgtaaagaccaataaaaccgtttaaatatcagttacgctgattaattctctccgttcgaagagcgacgtttaggtagttgcgtggtagatacgctagcattaaccaccatgcagcgtgcgctcgacctgtactttccgcgcgaatagccagcatgcatgcagatgcatttttgctagcgcgctttgctcgcctggcataacgccatgtatggattgttttgattcaaaaatttggaaagccccatgcatgcatgcttgatcaaaaatttggatggcgccatcagcaataaaaaatgaatcgaaaattttcacttgacgccactatttgccagcaaaattttcttctataaatatggacaatgcaccacacatttcttccatctctcttcttccctcccatggttcaacgtacgtaatggccagttttgatctaaatctacccatcatcaattgggacgaagttgaggatttcgatggagatatatctgatttgaactatgacttcgtttgggattatgacaatgaaggtgttcataggagtttcttctcttgctttgtcttcttttttttcttgtgcatgtgtgactttataattttgtttcaacgcacagatggtgaagatggcaatggccgcggcagtggcaacgacggtggctgcgacggcagcgacgacgatggcggcggcagtggcggcggtggcgacgacggcggcggcgatcaaaccaccgatggagcagtcgatgcaggtaatactcgttcattttctttttgttgctgtgtctttttgctgcacgagttgaaggcctttgcatgtacacatgcacagtgccatgcttaagcaaactagccgatgcatgccaaccatagtatagcctgcatgttctcagccatcatccaccatgcatgtgtaggtatcaatattaagaggaggagacactaccctcctgatatgaaatgagccatatatgcattgtgtttggagagatcggatcctggtatgatgaaggagggagtgacaaagtcagttgctactgatatgggggttccatggagagttgttcagcgtgtatggcgacatggacaaattggaggtggaattgaagctttcgaatcgaagaagaagaagaactgtggccgcaagaaactttcttttaaccctgatgccatcaaagatgtaccgcttaggcaacgccgaacactccgtgacctagctaaagctttgcatatgtcaaaaaccacattgtttaggcgtttgaaggaaggaagatttaggcgccatacaaatgccataaagttcaccttgaccgaagataacatgaaggcccgtgtgaaattttgtatacaaatgcttgatagccaaagcataccggacgagccaactttcaaatctttgtacaacattgtgtatatagatgagaaatggttttataggacaaagccggacgaaaattattacttgtcacttgatgaaccgaaccctcgaagaaatgtgaagagcaaaaatttcattgataaggttatgtttctagcagcgaaagcccgtccaaggtttgatgagtatggcgaatgtacatttgatggaaaaattgggattttttccttcacttactgggaggcagccaagaggagtagtcgcactagggagaggggtaagttgtttaattatgtttagttactccacatatgacaactctactaattttgtttaatcgcatgatttaatacaggaaccaaggccatgacatctgtcacgagggacattatccagaactatctcattgaaaaggttttgccggccatcaaacataaatggcctaatgaggaacgaggacttccaatattcattcaacaagacaatgcgaagacccatattgcagttgatgatcctgcatttttaagtgttgcacaagaagatgggtgggatatacgacttacatgtcaaccaccaaactgtccagatcttaatgttttggatttaggtttttatgcagcattgtagtcattgtttcagaagtcatctccatcaaacatcgaagaaattgagacaaatgtgatcaaagcatatgaagaatatccggcggatagatcgaatcatgtgtttcttactctacaaggatgcatgagagagattatgcttgcaaaaggagggcagcactatgcaatcccgcatatgaagaaaagatcattagagagaaatggtcaacttccaataaggttgcaatgtgataagcaaatttatctagatgcggtagatttcatcaatacatagttaggatatttctcttgtaactttgcatcgttcaacaattagcaagaaaaagaggagtattcatgtttgtttttctctgatcttcacgaaaaagacattgcattaaattgaatagaacaatcaagtgcatacacattagctaaaccatctagcaatgacaacaagcagcaacattggcaccgattatacctctagtgaatcagttgtttttttccttggcgtcagtctcctctagtgaatctgcaacaaatgtgttgttggccagtgagtcaacaacgtacccaatgttgtcggagtcagtgaaacgatcggcgccggccagtgagtcaaccacgctgccctctcggattccggcgtcccctgccttctctccgttgtcacccttgccgtcgtcggtgttgcaacagcgaacgagctctgcttgcgctcgcagccgcatgcgaagggcatgcacacggagcgtacgagcatgagtgatatccatctgcgcctcctgccacatgcggacggcggcgtcgcggagcgctcggacacggccgagctccacttgagcacggcgtcacatgagcacggcgtggagacgaagtgatcgcgcgcggccgaactccacctgcgcctgttgccgcatgagtcgtgcagatgcaatcttctcctttgtcgtcgccatcgttggcatatgaagtgtgagcagtgtcacagaggggcggtgtgtgcagtgagagagagagaggaagcagtgagagcgagagagagaggggccaggagctgagctttttaaaagccaaaccgagtcatcagttaattctctgcatgcaccagtacaggagccgaggagtactcatcaattcctgcatgcaccaaggagttgccgccctgtattatagaatccagttgaaaagaagttacgccctattttaaggaacggagggagtaacagtttagtgtgctttgaccgggcccacacgcgatcatgttttggattaaatctaaactgaattgtcaaatatagtttgtttcataaagataaaataaagcttagactccctccttacctaaatgtttgacaccgttaacttttttaaatatgtttgaccgttcgtcttattcaaaaacttttgtaaaatatgtaaaactatatatatactaaaagtatatttaacaataaatcaaatgataggaaaagaattaataattacttaaattttttgaataagacgaacgatcaaacatttttaaaaaagtcaacggtgtcaaatattttgggatggagggagtatttaataaatttacatcattatgtccagaggtggaccaaaacttttttttaagatccactataatcaacggcatatatttttcctttagttaatacgttcatttctaataatccacaaatgcgaataaatatttctctatatgcggttacaaaatcatatgtggaaaaaacaaaaaacatatgtacagtgcttcttcatggaaagaaaacatatgttacacaaggtcaccctttgcgattccaatctaggccgagtttagttccaaactttctcttcaaactttcaactttttcatcacatcaaaacttttctacacggataaactttcaacttttccgtcacatcgttctaatttcaaccaaactttaaattttggtgtgaactaaacacacccctagagcacacccctagatcagtttgtagcagaaatcacggcatccgacgagatctaaccaaaatcgcatcagaataaagccatttagctcgctcctctccagtttccgtcaatattgatcatttcaaccaattatctgatccatcactacactcctccatcgtcttcaccaaaccacaatcaccgccagggaccgggagtggtgaatgtgtttcctctcactttctctctccctcccaccctagcaagctgccatagtctaacttgcacttaacattatgttcttattatttcaatttatttttatgcttttccgatttcaggatagatgttcttcggtggtatgagaaacattctgattgcattatttttacgataaaattatggcattatttttacgataaaattatgatttgcatgactacacctaagattgcccaatgcatataaaataaaactttaatcttatgatgttcatcataaatttaatttttctcgtagcaacgcacatgtattttttttccggtctactttaaaaacgaaatctggttccagcagaactttcgtttgtccatcgttgcttgcatcatcgtggcatcctcccatgctgcgcactagcgtgcgctcgtccatcattgggagtcagagtcaggtacccgcacaacaacgatcccaacaagcgatcgatcgcggtagcaacctcaattccgccggtctatccgttgtccgcctttcgcgcgtgtcagggtcctgcatgagaatctttgatgggacttttgtctatggcattcgcgtttcacgtctaccacagagtcttcaagcaagcggggttcgagcgagctgggccaaaattttatataggccgagtttagtttcaaatttttttttcaaactttcaatttttccatcacatcaacacacacataaacaaatgctagctcagctgctggtcactcgcccttcttctcgatccggtgtgctcgagctctctccttctctttctctgaaggactcgtcgcctccgctgccggccaaccggatctgtaggtgagagagctgtatatccaacgtcagccagttgattctccatctaacactttcctctgtcattattgccgccggcgtggtacggtgcagatcgatcaacttaattattgcctccgatcaggcgcaaagatccgcgcgctgcaggccggccgactgcgagtgagcgaggggattgaggagagctgcgtcgatcaacttctactattggcctggtaattaaccacgttctgccaggggcggaggcagaaagtagcatgagtgggggccaatgatctaccgcttaggtagactaacaagtaaaaagtgtagggggcatttgcccccattcactgcaaaattgagtgggggctatttgatttgcaggtttcataaattcatgatttccactgttctactcaagtgattggttcatacatccatgcatcttggcaaaaatcaggtgtatacaactcaaagcttcaaaatcaatattaattatgacttgtttatatatttcttgcattagtattatatcttttttccgtatgtgtctttaatatcttccgtaacactgaattatttacttaattagtagtgcaatagtaatagcaatactcgatttatggtttaaagactttgtattatttttctcctcaagctgatcacgtctaattttaagttgaataggtatttggtggcttttcctctttttcctggcttgtacttttgttaccatttcgcctattctttaatgtactgatgcataagccttttgtctattcaagaaaatgagttttttcccgcctcaaacttatatgtaagtttggccttgtgccactactatacgtatacgtactaggaaaacggctttaatttttgcatttgtatacttactttttataatttggcaatttccatcctcaccactgcaagtatgagataaactatgctcgttctatgcccccaaatggttaagcatcatccgtacccctttaatgattcacaactataaaatctaaaaataaaatgaaacatttcatgataagataaacatttccaaatttagagagagtttattgcatttgtaaagaaaaatatatgccattattttaattttaactaactttgtttaacttcttatttcagtctatagggaatgatggtgaatgcattaagcatcattggatttgcactattagtagggtttaccataggattatctacagatctttggtattttcagtgtgaaggcaagaattttgcatccaaaatcatatacagaagaaacttagatttcttagacactgccacgtaactcgcgggtcatggctaagtcaaggaaagagaaaatttatgctattacacagtgtcgaggagacactaatactaatacctgcaagagatgtgtttctgaggcagtacgggatgtgcaggtggtatgtgattcaagggttgaggctagcgtttattataacttttgcagccttagagtttctagtgaaaatgttcaattcaatattttacatgacatgaacatgttagctatacttggcaaccaatctcatgtcactcataaccgagtttctagtgaaaatgtttaatttaatattttacatgacatggacatgttagctatacttcatggttataaaaaaatttaaaaaaattaaaaagatgtattaacatgtgatatatcactttacaaatatacaagttcaaattcaacttctacgcctcgcaacaaaaaaaaattgactgtgaatatcgttaactagttgtagtttaatttgaaattgactgtgaatatcgttaactagttgtagtttaatttgtttttttcgttgcgagatgtagaagttgaatttgaacttgcatgtttgtaaagtgatatatcacatactaatatatcttctcaattgttttccattttttttcataactatttgggtgacatacaaacaacgaggggatatcccctcgagggatgaaaatccactcccaacttgcacttaacattatgttcttattatttcaatttgtttttatgcttttccgatttcaggatatgatgttattcggtggtgtgagaaacattatgattgtattatttttatgataaaattatgacctgcatgactacacctaagattactcaatgcatataaaataaaactttaatcttatgatgttcatcataaatttaatttttcctgtagcaatgcacttgtatttttttccaagtctactttaaaaacgaaatctgattccagcggaactttcgtttgtccatcgttgcttgcatcatcgtggcatcctcccatgctgcgcactagcgtgcgctcgtccatcattgggagtcggagtcaggtacccgcacaacaacgatcccaacaagcgatcgatcgcggtagcaacctcaattccgccggtctatccgttgtccgcctttcgcgcgtgtcagggtcctgcatgagaatctttgatgggacttttgtctacggcattcgcgtttcgcgtctaccacagagtcattaagcaagtggggttcgagcgagctgggccaaaattttatataggccgagtttagttctaaattttttcttcaaactttcaacttttctattacatcaaaacttttctacacacataaacttccaatttttccgtcacatcgttccaatttcaatcaaacttttagttttgacgtgaactaacacacccatagataggattccaagcagacgatcagctaacactaatcagactatgcatacatagtcacatgcgaatgcacatgtacagattggtttctgcccaatccagtgcatgcaacattgcaacacgaggattgataagtaagagcacacaagattcaagtatccaaccaggagactgcaggcttcatcttaggaactgtttagttggtgaaatgaaaatttttgggtgtcacatcggacgtttgactggatgtcggaaagggttttcggacacgaatgaaaaaactaatttcataactcgcttggaaaccgcgaga

SEQ ID NO: 69014 - DNA, 19609 bp, Oryza sativa
gtttttgctatctctctttttttaaaaaaaagataatattgtagttctggttagctggaagtctgtttttagattttcatttagtgcaaatgtatatgtatattttttaaaaagttgttttataacactacaattataacaacttttatgttggtggagttgtaatttatgttgtgattgtcttaaaacgccattgcaatattggccataaactttatattatgtatagtaggatgttttcttcatgcgtgcttgtaatatactccatccgtttcacaatgtaaggctttctagcattgcccatatacatataggtgttaatgaatctagacacatacatgtgtctaaatgaatgtgagcaatgctagaaagtcttacattgtgaaatggaggaagtagtaaggctctcctattatttttgctccttttatcgttagattggcttatggcttcttccttgcttgttaattttccataacctcaagtagactgggttatttatttatatctaccactaagaggaggaggcagggcgaggagaaagatgtgttggccgtaaggaagagggagtaaaaggtgaagtagtctatcgtccttggaggcagtgccgtggacagcgtgatgacgataagatgaggcggtttgcagcttttttgttttcacaacaggggcgtgggagagtaggagcccaggcctatttgtgaaagaaggtttgcaacatctccataaaaatggaatggctcatgcatatttgtttcatgacgtgacacgataattttgcaagaaactttagtgattcagtgttctagataagatagctaaaactaagccaactattgttttatagcgtccgtgtaaaacaatcttctcacctctaaaatcagatatccaacacccctaagctattcaaactattcaatttaccccatgtttaaagtagctgtgtttgcctatatatcattgacgtggtgaaaaagtctaccacatcggctaacatcaatgtttggcgatgccacaaacaaagttatgagatagtaagaagtaaagaatgtcatatttgaaaacaaaaatgaaagaatatgctatatggaccgcaccataaaaacacagttctgagtttgtactcttcatatatcttttactaaaggacacaagctgacttttataacagaatttttactaggatgaatgagccaaagtggacacaagatcttgcctgccatccacatgaaaaacaaaactattcctcttcttcttcttggattaaaagatgatggatgggcccaggaaagaaacctggcctagaaagggccggccgggaccggagcatccgatctcctgtcaaaaccgacgcccatcatgatccatgaacaatgctaccctaatcaatcaacatgcatatgcaagcatggctaatggtcccacggagagatcgatcaccaacccgaccggctgaccccacatccatgcatgcaatgatgcaaatcagcatatacatgaatacatccgtccatgcggttgagctaacaaaatgatgaaacgagatgatcgccagattaatccattgtttacatgcagccaaagtacaatgacagttgacaaccttcaatctgcaggcaataatttacacttttcttttaaataaaccttttttttcctcttagaaattaaaccgaagctgtgagcaagagcacatcatggtcagttcttggaagtcttttgtttgacacacacttgaattgctcccattttttcccaaccaatttgccacctaccatgcctatctgcacgcacccgtcgcgcggtttattagcctcttttctcctgcgaatcacggcgagctgatcagcgattaggcgaagcaaacgtaccaaattataatgggtgacgcccagcggcggcagcttctcctcgtcgccctcatgctcgccgccgccgcagaccactcgctggccggcttcttcggcggcgcgccgccggcgtctggtcccgccgccgccccgccgacaacgacgaggtacgttagagagacatagtatcgttaattactggaaaggttaaagccggcgatttcgttggtcgatcgttctggctaattctgatgttcttttcttgtttcttttggctgatcgatgatgcagaagtgcagccggacgtgcgagtcggagcactgcctgggcacgtatgcacgtacgtacgtatatatataccactctccctggccgatcgataattataatttgtcagtttctcttgctgtaatttgtgttgtgagcaagtgttaattgttgtgaaatttgcgtgttgcgtgtgcagaggcgccgttgatgcggtacggcaagtactgcggcgtgtcgtacaccgggtgccccggcgaggccccctgagacgccctcgacgcctgctgcatgctccacgacgcatgtgtccaggccaccgacagtacgtatccacaccaggtttaaactaccaggtaaatgtttggtgtgctcgtttgtatcggggtgggcgaaatactgaaattttgaaaattttggttcgaaattatatgaatttttgaataaaatttgacaaattttgaacataatattatcaaattcaaaaataaaaataaaaatttcggccgaaataatatcgtatcaggggttccgatagaaccgaaattttgaaccctgaattccacaccaatctttttcacttatcattttgatcattttgaacatctacacattgggacaaattcaaatccaatataagattagagagagggagcttgtctcctcctttctccctcagcttcctattgtttctccctccctcttttcttctatcaacggtgatccaatagaatagagccggaaaactcgatcgagttctcctgcactcatgttggatccgcacctatcgacatacggtgtaggggtgaaaacggtcacggaaattcccgatcgaccgggcgccgtttccgtttaaggggtaccgtttctaaccgtatcgtttttgactattttttaattttgttttttctaatttcttttcgcatcgtattaatatcgatactaagtagtttaaatgataaatatggtcaattaccggctgatcgagcatcgtttcagaagagatgctaccgattccgaccgtttccgatcgttttcacaccctaatacggtgtacactgataacgggatgtgtctgtcgaaattaatgcatgtgtgcagatgactacctcaacatgctgtgcaaccagagcctgctggactgcgtggcggcggtgaggtcgccggcggcgaggatcaggacgttcgaggggaaccagtgcaacgtgacggacgtcgccgacgagatcacgtcgctcgtcgaggccgccgtcttcgccaagaggatcctgcataggccgtagctttaattagctagcttgtagccgccacatgtaattaattgttgtttttgctaattaagctgctactgtgcatgttgtctggcatcatagatcgatgcacattgattaattaattccagtcgtccccggatgctacaaaaatcgaagctagagagtacacgtaagtgtagttggagttggtgatctccctacacgtgtctagtttgcgtaagcaaggcttttttgttttctcttctttttttttttgtcatatcctcgatcgtcaacttgttcatgcacatcaatctcagatgtgctcgcagttagcacgtgcgtccgaatcatgattctgctcggaattcatttttgtgaaggcccatgagaacggtatttacaagctagtatattttcaaataaaccttttgtctttcgtgtttacaccaagctagcttgcgtgtaaacaagcgtagcatagcaccatgcgtacgtttgattcgaaaaagaagccaaaagtaaaaatggttaattaaatccatataattatagatttgctcgttttgaaaaaataatattactagtcatctatttgaaataatgccatatattacaatcttatatatattcaagatatatcccctcttgcgaagtgagtatacctcaactgattaggttattgtggtgaaaccagcccactcaagtttaaatcagtcgcacctaacggtgcttgtgctagatccgtcaagcccagggcaagttggtcatgctcaacagtaacaccgttgctgctagatcctcaagaacatgcctcgttggttggattattgcgtggtcgtggaatcgttgtcgattgccagcagtgggagatagagaggagagaggggcatggaagaaataagaataaggtaatttcattaaaaaaatttttgataaacacatcaaaaggataataagtagtgacatataactaataggtgtgaaatcatgacgaaatggctccaaatagataaagaataataatatattttttttaaatgtaggaaacttataatgacacttctccaatgaatgtaggaaattttatgttctccatccttggaacaatgtaatagtcaaatgtaatcaacccatgtctgaatcacaaccaagcaaacaaaaaccatctcaaatctgacatatataaatcgatggatatagtgatatggttcaacatctatgctgattaatattatagggataaagtaacatttggtagattattatgtaagttacaatctgcacatcaaactctttaaaccaaaactacatcgaatcaagcattaaattaccataattgtatattaatttattccatccactcctaaggaatactacttcctccatcccttaaaaaaccaacctaggataagatggaatgtttcccatctgaagttagcttttttttttttgacgaagtattgactagtagaaaattataacccattggactatgcaagtcaaaatcaaatcagaatccattggatttctataaatcaaagatcaaatcatacatggttacaagtattaactactgcaataacattcatatcaaaacttcactttgtagcatcaatgcgaaggcattcaaatccaagtcaaaaattaataggggtgtataaccccctgaaaacagtggtagaggtaggaggacgaccagtagcctcgtctcctccaacagttcctttttttatataatcctctaattaattagataattaacctaagcaatgatatattaagctttatctaagacttttaacaaagtattatccatcaaatccttctcaatcctagctccgcctccgcctaaaacgagaactatagcaacatctaaaaacactgtagcaagtactcgtactatagcatccttaataactgacaacgaaccctctgcaacttgcacgtctcagctctcaaccggacaacccccgatccatcaagtacaccgacgaatgcctacgtgcgcagcacggggaaacagtccggttgaacgtgcatgagtgcatcacctcgccccataggtagggcccgtttagttcctgaaaagaaaagtttttttttttgtcacatcggacgtttgaccggatgtcggaaggggttttcggacacgaataaaaaaactaatttcataactcgtatgaaaaccgtgagacgaatcttttaagcctaattaatccgtcattagcaaatgtgggttattgtagcacttatggctaatcatagactaattagactcaaaagattcgtctcacgatttcccctctaactgtgcaattagttttttaatttatctatatttaatactccatacatacgtccaaagattcgatgtgatatttttggcaaaaagtttttgggaaataaatagggccgtagtaggccgggtgaaaacagtcgtgaaaatttccgatcgaccgagagccgtttttaataggaggtaccgttctcaaccatatcatttttagctattgataaattttatgttttttaattttctttttcatcgtattaatattgatgtagattagtttaaatgatatatataatcaattaccaaccgatcaaacatcgttttcgaagagattgtaccgattccgaaccgttttcacccagccgcatcactgcatccgcagttcaccggccaaacccaaccggctgtgttcgttcagtggagttggtaacacattctctccacacgaaaaacagagcgacgtattttcttatgattaattaagtattattattttttaaaaaagataaattaatatgatttttaaagcaactaggaaggtagcccgcgcatatgcgcgggcatgtgcgtgaaatttactgtgaatgttcatgtgtgggtggtttctataaaaaatattcttttgctttatcataaactaaaaatgaacttatttaacatgctttgagcactggtagtttttaaattgtgaactaaaattactttaaaccgtgtagtttttaatttatgagtgggacatcgaaaaaattagtaattagctgttcaatatctgtgatattattttataatatcaaaaggaattggacagaaaaacaatcacaaaagtatgatttttcccctccctaccaagtctgcctcacattcacctccaacgctgccaccgcacccgcagccggtgaggtggctctctgggggcggggtatcgaggagggcccgtgcgcctaggcccatgggtccgtattgttcccaaactcgtcgccgctgcagcgcgaaggccatgccggcgccgatgctccgccacacaccgcagttaaggggagcacaacgtgggccaccgcctggttcatgttgagcagggcgccgcagagcacatgctattgcagtcggtctcgcagtggcgtgctgtgctaccgtaccctccgctgccgatgtcgtggcgtcgacggcgtcagagctatatgcgagccgcacatggcagaaaggggcaaaatcatactttcgcaattgtttctatctccttttcctttggataacaaaataatatcgtgggtatacaggcagcttattaccattttttgcagtgtcttgtggcagatatacattcttgtagtgtctcccagctaatcacacgtttttttaatgtcccgtagaaatttttgcctttattaagtggaggcctcaatatgcatgtgggtccataatgtaattttttgttagcaattaaatatagtcaatatgggtattaagttattgatttgacttaaaaaaaaaagttggctagacctaataggtggagatttgtttgtggtcttttctttgcccataaaaataattttaattttaattatcatagagataggaaaaacaaagaaaagtaaggaaaaatagagagggtttggatgttttctttattaaaaaaagagtgatctgatgacctaaaataatgtgttaatgtttaagtaaaaaaaaccgatggttggaatttttttttaatttaagtgagacaagtaacagcttagcaaaacgttcatgtactttaatgcccatagggatgagaggaagggaatatggtttgggatgatttttttttaaaaaaagatcgaataacgatgtaaaataatgtgtctattgatttaagtgaaaaccaatggatgaatgtttctctaatttaagagtgtcacacaatagtttagaaatgtttataagatgtttaaaggactttaatgcctatttgtgatttttttccataaagacaattttaattttaattgtgatagggatataaaaagagaaaggaacagaaggagcgtacaaattgatcagtatgtgcgtggtgcacgatatgcggacgtgggaggtttttgtttttaagatatatctaacgatctagatccaccgatttaaataaaaatcgaatgtaagatttttttttattttattagggttccatgtggcgacttgggattacttgtattttggggggtgtttttacgagcaatacttacgagaatgggagattaaaagaagggagttttttaaatagatataatctaccagttgaaaataacgggtatgtgaaaatcaagactacatgttttgcttttatcttagaatttataggaatttcttttatttattatagtgccacatgacggcttaatagtatttgtagaaagtttaattaacttttagtatataatagataatatatagattttatatacaagatatagtttaactgcatatatttatagagtactatattttatttttaaatagtagaaaatcctattttaaagcccatcgattttttttcaatgacactacgatgtatgctttttgtttctttactttatcgcttttatcgtataagtccgtacataggtttttcttgaacgtattattcatcgtttttcctttagatgtatgtagaacagttttttttcctaattccggcccacaggaggtgacggagcgtggggctcctcaccgggagaccgcccaggccccctttgccggttcggccgggggcgctaagtgaggttcttcaccctcgatctgtggaatgttcgcgagagagcaaatgcacaagacacgggcgatgtagacaggttcgggccgctgagaagcgtaataccctactcctgtattctggtggatctgtgtgtgaaggagttacagagagccggagagcaagagagttcaggctctagaacccctcttcctctttctctcctctatgagctcaggtattctccgagtcgtcccccctttctcttctccgtcctttacttcggtgggcaaggtcctccttttatatctcaaggggataccacatgcaccacttctacctactcttcttttgggtggggactcaccctatcttgacccaaacttggctcgcgccttcgcctggaagctaaatcacagctagtccttgagtaaggcccagtgccgtcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgcctatgacgtgaccggcgtcagaccagtcacagaccggtcactcttgtccaccgcgcgtcagtttagcatgccgcacgtctgcccttcttcatacaatgacttccttgctatggttgcgatgaagcctggaacgaatctggccgggactgacataccaactccaggagttagcacgccggctccggctagggacgagtgcctggaggctctcatcaatccgacgggacggggcgaggcgtgtgacaggccgcctgttgccacctaacccgcgatctgaccggtctgtgaccggtcacacactgcgaccggtcacggaccggataagcgtgcgctgcgctgcattaaatgcggcgtggcgcgctcgtccaacccgcaataaatgcggttaggtgggccccgctgtgcttacctaacccatacacgtggcgccaaaaccacagggggtcggggcgccccagccctcggggccgaaacgggagctgcccgacccctcggggagacagagggaggggaggccacgtcaccctcgggcccgacccccccgagggggtcaggccacgtgggtgaccgcggctacccaagcctctagtcacgataccctcggccccatgtcaccgacagtagcccccggcgttacgccagggcgattgccccttcgtgggaagcgctcgggcgtgacgccactccttaggcccagtgacaggtggggccggtccctacaggcgggtaggaacccagcggtcgcaagtcgcgcgcatcggcaagggaaaaccgaccgacaataatgagcggcctctttaagaccgctacatcactcaagcagcgcgcgaatcgggacgagccggttcgtttcgcctggagacgtgatgatggcgcttttcacgtttggcgtgcgtgtttaatgcgcgcacgatctgtcccatctcaactgctacggccgcacatctgcctcgtgcgccgcaaacgggcgagttgggttagtggaggcgtgggcgcgagaaacgagggggcgaggtagtgggcgcgggaaacgaggagccgggaatagcgttggcaagggtataaagacgccgaggaagagatttgtttccttcctctcgccattcttccccttgccttcgccacttgagctctaactcttcgtttcctgtgccctacccttgccgcactcactcgctctcaagctcctcctccgccggcatcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggacgcccgacgccacactacctggggcggtccgtcttcttcctctctttcgcaatggcagggctggtcccgccattctcttcttttttcatggatattctggagttttatgatctccagatggcgcacctcacccccaacgcggtaatgacgttggccatcttcgcgcacctgtgcgagatgttcatcggggtgcgcccatctctctggctgttccggtggttcttcaccgtacagccggtgtcgccgccgtcggtagttggtggctgctacttccagccgcgggggcaggtgctgcaccgctacattccctgcgtcctccgcaaaaagtgggacgactggaagagcgattggttctacacccccctcgccgacgaagcgcgcctccgacttccgagccagcccccggcgcaggcctccagctggcgggcgacggtagatctgggaaacggctacgacgccgttcttgaccgcctggcgggtctgcgatcccaggggcttacgggggccatggtgttcggcgactaccttcgtcgccggatcgcgccgctccaacggcgcgcccggggcgcctgggagtacaccgggcccgaggactccatgaggacccatcaggggcgcaagtgggactgggtccctgaagacttcaagatggtggtccaacgggtgctgaatctcagctccgtggaggcatccctcatcccccaaggtgtcctccccctctgctgcgattcagagcgcgccaacatcctgaccacatgcaggcggtcggggcgtcgggggagcgggctcctcgaggccacgatggcgcgggcgggagccgtaggggggaacaatctaccccgggagggggtcgtgcttctgggccccgcgacgggggcccggggggcagccgccttgccgacgcccgggggaagaggaagcaggagggtaccccttccccatctcctccccgagggggcggggcggtgcgtgccggcagcaggcgcccggagggtgccgtgctgtcacgtcctgataaattcatcccaaaataaaaattattttctaaaaggaataatagaattaattaaaattcgaaaagaaattggcaaacactaaaatgcgtacaagaaaaattcgaatgtggcccggggaatttttgttaaattctccttggtctaaaaggagccctcaaattttacttgaattttcagagcaccggaaataattattaagcaacaaaaacaattattagagtttattaaaaagaaaaacctaaaaataatctctctccccccctttaggccaagtctggcccaaagtcctcattctctcccctcggaccacggcagaagtctccctctcctccctctccttctctccctcctcctcttgggcccctcttccccttccggcccactccctcctcctccctctttctcccaggccgcctccccctcctctcctcctgggccggccgcccggcccaagccgcgcccaagccaggccgagccgagccggccgtgcacacgcgcaccgagcgtgcgctgaccgcgcgtccggccgcgtggggcccgcgcgtcaggcgggtcatcgtcctcctcccggccggctgtcctctctccctctcccgtaacccagcgccattcctccctcaaatccgcgcgattcaagcatgggattcccaaattgattagggggaattaaacccctttccctcctctctctttcccccttaattcccccttgaatggcgcccccaatcgccgggaacggacgcgccaagtccggccgccttcctttgccgccgaccgccattcccgtcgccgttccgccctctcccgtgctcggctcgcttccctccgctataaaatgcaaccccctcgctccgttctatcgttttagccccctcccgtgatctcccgtggtccctagccctctccccgccatcctcctctctctcccgtgccgccggccgcctccagccgcctctccctcctcaccggagcgtcgtccggtcgcgccgtcgcctcctccagcatcgcagctgcctccccttccccggcttgccctccgtttcccgcggagacccccggagctgcgttcccgccgtcgcccttccctttcctccgcgtcggccgccttcagccgcctctatctccctgcctgagcgccggtcgacgtcgccaccacctccctcggctccgcgacgccgccctcatccccggcatcacctcctcctcgcccgaatttcgccggaacaccgtcgcccgcgccggcttctccttcctcctcggcggcatctcctccggctgcccctttcgccatgcccgtgcgtcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcgcccgtgcaccggtcggtcacacctacaccacctacggcatcgcagcggcaaggtcgtcctcggcatcgtttcccctccatccaaacccctccggggtccatcagcgtcgtctccgatcgttctcgtcgtcgacgtcccatcggtcgcccggctcgtcgtctcgcggcgccgcctccgtcgtcggcatcgcagcggcgtggtccgcgccatcctcgactacgtgcagccgctgacggcagccctcatcgcctactcgccggccccggacgatgtcgacgtagacgtcctctcgtcgcttccggtcgacgtggcgttcagccctccgacaggccgctctcgtacgtctagtgcgcgtccgacaagtgtgccgctgcagccccgtcatcgtcttcgtcctcggctccgcgtcgtcaagcctcgtgccggccgagtctcgccttcgtccaaggatggctgccgaagccgtcccctcgccgttcgtcttcgttgtgcccgtctgtctccgccgcgcccgttcgtcgttgtcgttcccacgcctcgtcgcgtggtggtaaggttccctctccctcgctgccccgtcctcgtcctttcggtgtcccccgtacccgttgtgcggttgtcgaccccggtacccgtgtaccggtgtcggtagtcgttcgcttgtacgtgtggtgaccgtgttagtgtgcccgctcggtagccgcgtggtttccacgtgtgcagcccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacctgttttatagttgcaaaacctaattacaataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttttaggcttgtagctttgcttgtgtgcttcgcgtagtcttcgtcgttccggaggttcccgaagcgtggttcgcggccgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttaagaccttattattgctattgttattattaccttgttcaccctaggaaaacaaaaccccaactagtgggtactctattcatggttccactagtatgaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggtcgtaggtggggttgggtcggtactcttgtttatggctaggatgggttgggaactatgtcacgtcttccgtccgtataccgtggtggtatgtggcacgtggttacacgtgaggaaaatgtgtcttgtgggtaaagatgtacacctctgatcagagtaaaacctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtctttacaaaatagctttgggcaactaagtgacttttaaatgctgttttctgcaaaacttaacccctatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatagagccgtaggcccgttagtccgctgctgtttattttttattgtcaggccttaagtgcctttgtaataatgtaaatattatcgatataataaagatgtgccttttgtaccatatttgtgtggtgtaccccggcttttcctgggacggggattaatacactagcgttcgggaaaatgtatttttctcggtcgcgacaagctggtatcagagccatctcgactgtaggataagccaagtggataaaacctaaggacatattttataaatgaaactatttgcgaaagcccctttttcctcctttcccctgtgctatttgcaaaatatttactccttccttcttcaaatttcaactagtactagatggttagttttgcgaagaagaagatgtcgccaattgtttgccgaagctccggaagactgcaggatctgctagcgaagtggaggaagcagtgaagatcttggagaacccgtcgcagaacctaagccaccctctagggtagaatcgttagttgtgtgtttccttgcttgtgtgtgtagcgcgtggtttgcatcagtgggttgtgatgtaaccgcgctaggttgtttgcttaatcaacttgcagaataagcaaaacaaacaacacatcaacaaaaagagttagttcctttaaggtcttgcccctagttctggtctattctttccttatatgctccccctctcaacctctaccttgtgacagatggataacactggtaacaaaggctatgggaatgatggatccgatgactcaagaacccaagccaatgggaatgagaaaagcatcaacgaaacctcatcagtgctaatccaaattgtggttaaccaaaccaacatgttggcaacagcctttcaactattacagaattggaacaacccagcaggggcaaccaacgttcaagtacctacagtccagcaacaatgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctgggacgagttttcatctgtattcaagagatcacatgttcccgtaggaatgatcacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaactcgaaagtgagcataatcggatgacgaactgcaagagaaggattgccaacgtcccagtatttccatgtggtaaccaaagacagcgcactgagccacttcagatcaccggagcttctgttgcgcatcaagagttcctaccccaagaagatggacacattgcagacaacaacattagcaatactaatgctgatgataccaccaacaaccatggttcttgccccattcatgaccacttagatcaagcgtgcaatgtcaacagcattcaccaagatatcgacgatagtatcaatgaaggcacccagaatgacaaccctagcaattttgacactgagaaagactccaatggtgatagcaactatggtaccactgatgccaatattagcaaggatttccaaccaccaattccaactccaagtcagaatgatcgttcctagatggacaactcagtaaagaagacattgatttgttacaactgcaaagaactaggtcatttctccagagattgtccacagccgaagcgtaacctgcgtcatcactctggccattatgcaagaagaagacaagtcactcgccttgtggtcactggagcaaacgccatacctttgaggcctcgtgtcaatcataacccatagtagaaacaatgtaccgatgttaagcatcttccctttttgtttaaggtagtgccttgtattcatgtaataagggagaaatgtgtaatacagacaagtcctattaggattcttttggaagatgtggatatgggattatgtgtgtaattgtttactgacaaaggagaaatagggtctcatttcagaggaactatattctaaccttgagttaataaccaacctgatgatggaaaagaaaatcaagcgattaaccaaagagacatttgtttggactaggagtttcagatgtgtcttattcggatcaaaggcaacgacagtcagcacagcttttgacgaactacttcaaggtttcaccgaaaggcagtaggccaaaggacctcatcgccaccagaagtgtccgctacccaccttaaagagtaccacctgttagagatagcccgaaagatgattgatcaaagagattggcaaagatgttctctagcaggaaaagaagtaggccgaaaggtgattgataaaggataaatagaaacatgctttgcatcgctcgaggaagacctctgatcaccctgcaacagtcaccttgacattgaggaaaaaaaaaatttatgagtaagcaagatgacctaggtaaaagtgtttctatgaaagcaaggagtgaaatcttcaactcggtatcagatgctacacggagtgaaaagtgcaggcaccggttaccaggcaatgccatgtcttggaagatgatccaatgggaaggaactcatcaaggtcgaaggtgtaaaggaagacgttgaatgctaaaagatgacaacatgaagagaatagtggaaagtaaactgaacataaagaaagtgaatccgagttgtttgttcgtgagagctattcccagttatgaaccaagtgatatgttcgaagataatctacagatgttagattaaaatcacatctaacaacgaagcttcagatttggcaggatcacgatcagaccataactagtccaacagtaaagccatttgggaagacgtcaaagcacgtcaagtgggataagttggttctgttgagaaacataattcaaaggcaaagttatcgacccttgcatcaaatagcagaagtagctagcacccggagaccaggaaagctaatatgaggcagttggtggcaagttagaagtaaatgacaaacatggtatcctagtaatgacaagctagtgttgacgcatgacatgaattggtaacttgtatgaggttgactccaaagatatgagttataagaagttctggaactgaagccccatccttcaatgccgcagcccagtcgaagtcagctagaggtgcaaccagggaaaagtcaggtgaagagaagattccatctgcaacaggagatcgagccaagcggtccagagtggagaagttgtgctaggcaagtttgttatagaagacggagcggaagaagtcaggcaagaagagaagaccacccaacctatcttcttgctagcctcctcgaatctcggggacgagattcttgtaagggggtggatttgtcacgtcctgataaattcatcccgaaataaaaatcattttctaaaaggaataatagaattaattaaaattcgaaaagaatttggcaaacattaaaatacgtacaagaaaaattcaaatgtggcccggagaatttttgttaaattctccttggtctaaaaggagccctcaaattttagtggaattttcagagcacatataataattgttaagaaataaacaaagttaaaatgattttataaaaagaaaaactctaaaaagtcccctttccctccctctccctcttgggccggctcggcccatctccctccccctctctcctctcccccgcggcccatccggcctctccccgcgcgcgcgccgctgacgggcgggcccgcccgccaccctcgctgacgggtggggcccacccgtcatccccttcctcccgccgctcccgccgcctcgcccgcgccctagcgccgccgccgccgagaatcccgccggcttcccgccgtccccgcgcgcaataaagtggggggaattattccccgggatcccctccccctttccccccatttttccctctctctctccctcggattcgtttggaaacccctcccctaaccttgccggcgccattaatggcggccgggtctcccgcgcccactttcccctc

SEQ ID NO: 69015 - DNA, 8695 bp, Oryza sativa
aatcccttatattatgggacggagggagtagcttataaggttctgataaggctctctaagctagactaagcaagtctacgctgattaaattattgaatggtttccatgtcagttatgcactaatcctagaattgattcttcttattggggtgcgtttgcttaattgtcatgtcagtttttctttttaatttagatatattcgtttgcttatatttgcctaatgagcattcacaatatcatacgtgatatgatgtctagtagctattcctataacgccagcattcacatttagcccttaaaatgatttcactatctctacttatctagattaacacataactgccgccacaaactaataaaagataattaaggatgtctaaaaccaattacatgatgtagtaatttctgattattctatttgtgttctcttggcagagatagtgccatactgagtggatcgcacataggtcgtgtcatagacttagacttccttttttccttcccttgtaggatgatttgtgtaaaattaatgagtcttctgtgtaatataaacaatcgtgtcttgtcggccagatttaaaatttccagttccctttaatttgtatataaaggaaaaccagattccccagtcaggtctccagagagttagtgatggaagaatatccctgtgtatgttgatgatataagctgttgatactccatgatatatatgatgcagatcatatctatgatgatctgtgcttgttgcttaattatgtatcaaaagttaagtttgttgggatcttaattagaaataagctaactttgagattatttttcccctgaaaatagattaaattttactgtatattatataaaaagtatacaataatttgtttaatgaatatattaacataagaaaatatccgtaaaaaataatatgctagcaatatccacatacattttttttactgctatatccactttttcaaaggatttcggttggttaacgagtcagcaaggagcatgcagtcatgcatgattctcaggtccacaaatgagcccacatagcgtgtaaatagtgggactcaaactaattagagataaatcatattaatgaacttcatatatggtgctatcccatttatttggaggaacatggttgaaactaatgaattgatgtacaagttataagacaaactaaagtaccaaaatcaataaaaaatgtgttcaaaacaaagataaaatttaatttgttggagatatttgaaaattagaatcctcaacttattaattaagtgtgtgttcatattcataaccatacatggccgtacacacttctcaagtaatgtgcactggagtgtgaatcggatcaatttttacatacagaacacacctagtgaaaagtatcatcagtactccctccgtcccaaaataagtacagttttaacattgttcatgctcaacgtttgaccgttcgtcttatttgaaaaacaattatgattagtatttttattgttattagatgataatacatgaatagtactttatgtgtgattaatatttttaatttttttcataaaatttttaaataagacggacggtcaaaacgctggatacgaatatctatggctgcacttattttgggatggaggtagtaaaaaaaagccttgttaaagatataagcatatcccacaaaaagacacttccaaattaaatcaattgttagtgctcttggaacccataggcttgctataaaattaaacttcaacttgttttctttcttgaggtagatatctgacaactgatcgagtaccattcacatgcttaatttgattaaaaaaattgcttttttttttcatattggttccgaaacgaatatttagtatgcctacaagttgtttcaatttataatggaagccatatatacatgcatgttcttctgttgctggaagaagaatcctttccgaaagtggtgctaatcgagaatatgttgatcttcttggttttattctttgccatcagaagtttgttctagctaggcaaggtggacatatgtttttcctttggtattttcttttgaaccaactgcaaagcctgacaagtacatatctgtgagatgccttttttaaaaaactttaacagtgataagtttcaccttatctcctgaaaaagaaaacagagagaaaggtaaaatatggatgggatgtatgaaaacaatgtttattatttgcaatgcgcgtaagggcatcaattcacttgtttttttacatcattaaaacgacattatggaagttactttctgaatcatagcctatcttaggatatagtaggcaacacgcaacgaaatcagagtctctacactctctacaaaagagggaaactgtaaagatcttaatcattttcagttacaaattaaatggtgtttcaatagcttgaaactcaataaagtttccttttggagagaggatagaaactaccccagctagcacatgcttgcatcgaacaataaaacaactttaagaccatatattcaagagcaaacggtccatcgatcatatataacttctactcctatctatatatatcgcaaatacgacaaatataccaattgagctagctagctataggatgatcaaccaatcaaataagcaacctgcattctcttcattcactcactcactcatactcatacatatatatgtgccccctcaataattaaaagctagatctacgtacacatacgctgataaaggtcgattgagacatcaccccaaatcttcccctaactttgctaattattcactggccttttcctttctatttctgctacagttttaatgaggagaaaaatagatgagctaccagttctttgcttttcctgagctatatatatttgggtggcttgtgcatcggctggcactcacccttgcacactcattctctagagaagggagagagaagagtgtagtagtagctagctaggagaaagagagagatagagagagaaacaatggacaggagagcagtagtgtatgatgctgaagcagttgatgatcatgagagacaaggtatgtgtacatgatgatcaatagctagtttactttgcacctaattgattgatgtaatattcagaagtgcccaattaattgtcaaaagtttattcaaataactactgtctgaacccatgctcatctctctatgttttttcctcgaaggcttttagaaggtctttgcatttgattgtgagacatgcatgtgtgggggttgtcatgcatgcatgccttttgctttgcacaacataacagaatgttaagaggggagctaggggacaaccttttctgttagcagagtgacatgcataaatgatgcaggatgtttgaaagctgcagttcaaaacatggtccatgcatatgcgaagcacacaggaccaatacatactcacatcattcatctacctttttagcttctaactaaaaaccacccagtcttaattactgtcaaattaaatcgatctgcccctacttgtcgtcatctcaatcacaaggaaattttgacagtaattgcaagtgtgtttacttgagctctctgcattgggttgatatgagatgatgatgatgatgatgatggtgatgatcagggacggtgtggacggcgacgtcgcacatcgtggcggcggtggtcggctccggcgtgctggcgctggcgtggacggtggcgcagctggggtgggtggtggggcccctcgtcctcgttggcttctcatgtgtcacttactacacatctaccctcctcgccaattgctaccgctaccccgaccccgtcaccggcaccgccaaccgcgagtacatcgacgccgttcgctgctacctcggtataatatatatatatcattataataatattattgtatttttacgatctataagaaggtaccacgagttaaaaagtgtcttaacggtgatatatacgtcaattttctcatgtgttttagggccgaagaacgtgatgttgtgtgggtgtgcgcagtatgtcaacctgtggggtacacttgtcgggtacaccatcacagcgagtgcaagcatgatgtaagttgctaattgccaatgttaagtatatatgctcgtgcccttcaattagattcaccaatcatcatatataaacgaatggaaattgaacttattttacgtacgtccgtggagtacgtgcatgcgtatatacatcaaacttggggcaaattaactaatcagtgcacattagaacttgaataattacagtgacctggcatgattaagatcttgatttaatatcgctttaacttttttttccatggtgcgttcgtgctcacatcctcctaaactttgtcgggatcgaaaacgtagtcgacaaatcagacagtagtaaaagtgcaccgaaaaaggtggcagagtatgtggctttaattagcagcctacatatagctgattagattatattaattaggctactttaattatccagtctacgagcataacttcgccctgaaacgaggagaatcccttgcaagcatcaacgatcgattttggatgcaaattaacacgcttaatgcgtgacacatcttggttggttaattagcacattctgcacgtacgtacggttgcatgcacgtatctggcgtgacactcacacatgcatgcacacttgtcactgttgcaatttcctaactactcatatagctcttaattgtaaaactaatcttgtgattagagaattattactctatccaatatttagaataacattcaattgctactattaatgatttctaaaatatttagattaaagaaatgatatccataaacttagctccaaaaatattcttataatattataaacatatcaaaattttataaacttacctttattataaaattgacggccagaatttcaaaagttttaacaacccccctcccccctaaatgccatgtttggcagtaacatcgagaaatagtattgtggttagtgaattaatttttacaaataatattttgagttcctatactagtgaattaatgttgagatactagatcgaagcattaatacacgtctaattaaagattactccctccgttttagactataagtcgttttaactttagtcagaacaacatttttcatccaagacaaatatattataacaatattgtcaattatagatttaataaaattaatttgatgttacaaatatatatcactatatttgtccataaatttggttaaatttaagtagtttgactttgatcaaagtaaaaataacttataatatagagagtaattgattaattaatggatggatgcagagcggtgaagcgggtgaactgcttccaccgggaagggtacggcgccggcgactgcggcgcgtcggggagcacgtacatggtggtgttcggcgtcttccagctcctcctctcccagctcccctccctccacaacatcgcctggctctccgtcgtcgccgtcgccacctccttcggctactccttcatcagcctcggcctctgcgccgccaagtgggcctcccacggcggcgccgtccgcggcaccctcgccggcgccgacctcgacttcccccgcgacaaggccttcaacgtcctcctcgccctcggcaacatcgccttctcctacaccttcgccgacgtcctcatcgagatccaggacacgctccgctcgccgccggcggagaacaagaccatgaagagggcctccttctacggcctctccatgaccaccgtcttctacctcctcctcggctgcaccggctacgccgccttcggcaacgacgcccccggcaacatcctcaccggcttcgccttctacgagcccttctggctcgtcgacatcgccaacatctgcgtcatcgtccacctcatcggcgcctaccaagtaattacccatcatcgtctcacttcctcgttaatggcgggcggcgatcgacgatgatcttatgtttgataatttgctgcaggtgttcgcgcagccgatcttcgcgaggctggagagctacgtggcgtgccagtggccggacgccaagttcatcaacgcgacctactacgtgagggtgccggggaggtggtggccggcggcgacggtggcggtggcgccgctgaagctggtgctgcggacgatcatcatcatgttcaccacgctggtggcgatgctcctccccttcttcaacgccgtgctgggcctcatcggggcgctcggcttctggccgctctccgtctacttcccggtgagcatgcacgtcgcccgcctcggcatccgccgcggcgagccgcggtggtggtcgctgcaggccatgagcttcgtctgcctcctcatctccatcgccgccagcatcggctccgtccaggacatcgtccacaacctcaaggctgctgcacccttcaagactgtcaactgatcgatgatcattaatttgatcgcttattaagtggttaaattattcagttaattaatgatcgatgatctagttgttagctcagcaacaagcaccatcagccatcagggagctgcctagctagagctgtggcctcattttgtttctaatttctttctctctgttttttttttggtgaatgattgatcgatctcaatgtactgaggttggttaatttttcttgctgctggttaatttgggcttaattttgatcttggagtaactagaaaacatgtaattcatcgtgttgaggatgagcaatgcaagaaagaaaataattattcgccaaaattaattaatcatgcatgtcattttctttcttttacatcctgatcaaggagtaatataattaatcagattaatgtgtcccaaaaggcatgcaagaacttaattagtgcatccatcgatctctgtaaactatctcgacttgtggtttgtggccttcaagtagctcctcactatcatctccaaagatagtgtaatttctgccatttgcacaaaactatgcacatattgcattattgccatgaccactaattgttctacttagttgattcaggaatcatctcttctctagaatgtggtcatgattgcttggtacaaccaagtttctttccattccattatatgtgtgtgcttccattacacatgtcatctactactctttaagcaaaaggtgattgcttcacaccacatagtacatacttaggcactgaacaaactgatgatgcagaagaatattgtcctcaatttgcctcatttgctgagccctggagggaacaagcagacatattcagatgcatatatatcatggtcatcatcaaccacccatacaatgcatgctaattctcagtattggatcccaactaagttggcacatgataaagtagcttagagggttcattcatgattcatcctgcaggtgcgatacatgatgaattgctgatgtgtgtgtggtgaattagtgcatggctctcactgtcagtagtgtcgcttctgtctgtcagtgtgcacatcgaaattcagatggaacaacgagtgcccactaattgcattctgtatctgtgtgtgttcatccaaaatggttgcatgcatcaccacttttctgaagacttgttctgctctagtactgctttgatatgtgggaccccccttcatcttttacgtatcttcgatcttacttgaaggagaatgacatgcatgtgcgtatctagttgggttaggcccacctgtcattgacacatacgtggctagctaattgaattcataagatgccagatggagctttaactaattaagagaggttaacatgggaattatatttaacatgcacacgttatggtttacagaatttgtagctaatgagaatttgtgggtatgcattatttgaaaattagaaatgtggaaataggtattatttttttgaaacgaactacagatgcaggcgttcatataaacatgcacacactcaccatatatctctataactacctccgaagacatggcaagatatcttgagattcacgaagttaccgagtacgttgcttacaactgaaagaataattgaccacaaatacaagcatccgcgccaaatctaagacttgaatatgagtgaacagatcccaccagcaagaacctagcaagttgagctatgctcacttcgtaaaattgatatttagtttagttcaatgttatactcttatgcttatatagaagcttagttgcactttgcaacaaatttcatatagaatgtattttcagtgtcacaaacataagttgtaaatttgcgtggaatatacctaagatacgcttataaaatctttgaaccttttcattttcagaaacgaacatttaactgaattatgtatcatcttccatctgtctaatatactccctccagtttttaatagataagggtattgacatttttacacacttttgatcatttgtcttattaaatacaagtatgctgaaatataagttggcttaaattatattacctttaatgataaagcaaaaaagtattattatgtaattttttttgaataacatgaatagacaaacgtacccatgtcaaaaagtcaatgtcatcctctattaaaaacgggtggtagtactttcacaaccacaacaagggagtggattttaatccctcgaggggatgtccctcgttgtttgcatgtcacttaaatagttatgaaaaaattaaaaatatttgtgaagatgtattaacatgtg

SEQ ID NO: 69016 - DNA, 6240 bp, Oryza sativa
tcccgcttagattaatccaggtttcatcgcacccattcaaggaagtcattgtatgaaaaaggcaaaacgtgcggcatgataaactgacgcgtggtgaacaagaatgcccggtttgtgactggtctcacgccggtcacgtcatcggcaggcacccgtgctcccacgttgcatctgcttccggcggagtgaaggtaggtatgacccatcccatcggagggtcattcggacagtggccattgcaaatctctgcccattaatgaaggaatgacagggtgatcccctgtgtcgggcgagtgacggcgctgggcctcactcaaggacaagctatcatttagcttccaggcgaagatgcgagccaagttttggtcaagatagggtgggtccccaccaaaaaaaagagtaggtagaagtggtgcatgtggtatccccttgagatataaaaggaggaccttgcccaccgaggatgggaggccagaaccagaagagaggggttcgagagtttgaactctcttgctctccggctctttgtaactccttcacacacagatccatcagaacacaggagtagggtattatgcttctcagcggcccgaacctgtctacatcgcccgtgtcttgtgcatttgctctctcgcgaacattccacagaccaagggctaagaacctcacttagcgcccccagccgaactggcaaaggggggcctgcgcggtctcccggtgaggagcgccatgctccgtcacacatacccaatagtaatcgactaagctcggcggggcccaccataataccaattcttatacggaatcatacctcgtactccctccgtactcgtaaagaaattcgttttggacagcgacacggtctccaaaacacaactttaacttcttgtttctataaaaatatttattgaaaagtgatatatgtatacttttataaaagtatttttcaagacaaatttattcatataacttttacattttcaaactcaacaacttgagagttattcataatttatattttcaaggtttgatttaaacattgtcctaaatgacttcctttatgagtatgaagggagtatatagaaggagttcaggataaggaaggacaggtagagttctatatggaaacgacaaggactactcggattgtatccatattggctccctagttctagttggacaaagggatgtctatggatataaatacaaggccccctaggaggatagaggacacaataagacacgacagatccacacacaagccagaacaaaccaatacgccaaacatcaacatcagagataagcctagacagacccaatccagtgcctacgaaggccaacaagagggatctagtgctatctctgatctcgatgagttcgtactcgaggaggaagactactctgtcgtcgactacgtgttggttatctatgccgccaagtcgatggcagttagataggttatcccaattattgtacttgtgtgatccagatgaataaagagcaacaccggctccggccaacaggagtagggctattacctgtcagataaagagtccgaacctgtataaaaatccttgtctccatctcttttatttcaatctcgcatataccctggtaccaataatctccatatcatgcaaataccgtagttgtgacctcctgttgacaacagctcaagacagagttcagaagcaatctcaagcttgaagcgttgtgattcaggtggggtgtttagatatttgttagtgtttttgcatgagaaatgaaactattcaacatttgtttgtagagtgtcactatgcaaaatttctttggaaagctctacagtttactactggtttatatactcctcatagtatatctcataattttgagaattgtcttgtgggagttgataaaaaaatctaccaaacttattcttgttggagcatccgctatatgttgggctatatggttgtgtagaaatgatatggtttttgataaatcaccatctatgtcctatatacaagttcttttcaggacaacatactggctccggtcctaggctcaactactaaatggctccggtcctaggctcaactactaaaatgtgatgaagaaatcaagtcagtgaaaactgcatgtcgtaatcttgagtcaatggttatgcagctgttcgctaactatgaatggagattcacaaatagaattcaataatttttgtgatctttttatgttgtgtgagtttttattagtttgtgtgtacttttgtttattcaggtgtgagtttttgttgaattggtgtaataattggctgtatctctttgagcaaaggtcgggattatattctattattaaaaaaagatatttgttagtgataaggcttagtagttacaatgtaatctagatagcagataagataagatagaatatgttcagagtttgatgtataatattatcaccttgtaaaccacggtaggggtatttcctacctatataaatgaaatcacgggccgggcaccgtttccgccattctttgatatcagatagtaacccaaatcaaaatgaagaaactaaattgctgctatatttacgctaacttctctcaaagacatgttatggcaccctttatacttcaacattagcaaggtattcttgcgaagatcatgatcaagaattcaagatattcaataataaatttatgaggctattttgtttaccaattttactacacccttatttcaaattatagattcgttcgaagtttaacatgtctatctttgaccgctaattttaaaaaatccatgtagtttaacaacatgtaaataatatattgtaaaataaaatataaatcttacgatgttaaactataacaccgtatatcactaattgatggctaaagattagaatatatgatttaaagaagacatagaaagaaaaatgtaatttgaaacagatgaagtatatatatatgaattgtaaaagactcgatcgttcgtaccaggtaccgggacatcaagaatctgcccctgggtgaggtttttgggatcggtgatcccgttgatcttcagcagcgtagattccttgaccccaaacctcgcggcgatcttcgatacgttgtccgcggcacggactttgtaggcaaagtgcgtcacattgttcccctccacctggtcgcagctgcagggaagtgggatccagagctcctgcccgacttccaggaagtcaggattggagatgttgctcgcggcggcgatctcctggtaggtcacgaagtcgtcaaattgagcggcgatataggacatattgtcgtttatctgtatgatgtggaagggctggctctcaggccggttggcaccggcgacgcaggagcagcggaacgggacgataacggtggcgttggtggggatggctgtgtgggacggggtgctcggcgggaggccgttggcgtcgaagaggtcgcggagagtggtggtctcgaagctggagaggagctcgatgtaggtggtggcggcggggggcgtgtagacgatggctgactggcatgttgtcggccaggtgcaggtgaagttagtggccgatgcggacgacgcgaggatgaggaagaggaggaggatagccgccgcggaggaggagaatgatggcaccatggtaacgatagctatgctatatgcaagaggtaattaagtgtttgagatgcccggtaagtttgcggaggtgagcgtttgcttcttcatgagagaggagtgcgcgcggacacaacacgtcaaaaaccatagggcaagtgtaatgtgcctgtggcgggatgaccggtagtagtgtgacgtgtgacggtgggtggcggtcaaaaacaacacaagccgtgttctgcggtttgatgtgtacagaggtcagcctcagaaagatcgagaaaatttgcgatttgttcgtcttttccgtcgtctcatcgagtccattaattctacgatcgaagagccccgatatgattgcttaaatccaagctaaaattttaattttaaaacttacctttgaaatttatttaatatattgtagacaaactttctttttcagcgtaggaatttaaatcacactaacagtacatatataaaaagataataagtcgtaatggtttataataagctttttgataaccgaggtctgatgttaccatccactggacgtctggatctgatggtttttatttcgaaaaattgtttcccaaagtcagtggtcaaaatagtgcagcgtgcaatataaaattgaccaacttttcctagactatactttattcatttattggctctagctattaggctgtgttcgataccatgggttgggaacccaaatcctgtgcacggaaaacggagcggtctattagcacgtgattaattatgtattagcaattttttttaaaaatggatcaatatgattttttaagcaactttcgtatagaaactttttacaaaaaacacaccatttagcagtttgaaaagcgtgcgcgcggaatacgagggaaaggggctgggaacctcctcatccgaacgcagcctgtctaattttgactacttttgagttggggctatctatttgtcaagtggctgatttttcttatctatcagtaacttttttagcactagctcaaatcaacaactcacacttcgcatattatttcccatgcggtgaagccaatatatagtgttctaacctaaaggtagaaaatatatattcttaggtgtaaattcttataaatatgaaatatataagtgtagcgcccgttccgtcgtggcgcctaacgggaaaactatctcttaaaaaccctaattgcgaaatttgtatcttcgcttgttgtctagtgtccgtgccatctcagatctcaaatccccgatctatcgtcgagttcaatcccgaatccaaatccttcccaaatcaattcctccgcaaaagtctaatttgcctcccccgggttcgatgggccgaatctctctcggcccatctcctcctccctccccagctctctctctctctctgtccccctccccctccgctccgcccgcgcgccgcgcgcgcgtgcgcgcgagagccgcgccgagcgcccctccctcgctctgcccgcgcgccgttgttcgcgcgcgcccgcgtggtcgtcgcccgcgtcgcgcctgcgctgtctgcgccgcccggccccgctgccctgccgcacctgcagccgctcggccccgcagccagcgcgcgtgcccgagccgcgccgctcaaaccgccgcgccgcccgttgcttcccgcgcgcgcgtgccgtggtggccgaccgcctggtcgccgccgccgtaagcctctgccactcctgcccgcgcctgccgcccgtgtcgtcgcgccgctccaaaccgtcccgccgtcgtcatcgcctcggccccgccactccgcgcgcaagccgccaagggacggaggcagagccctcctccctctgccgcgacgcccccgctcccctcctccttttcccaaagaagcaaggggcgagccccctttctcttcccctttctcctcctttttccctctcgccggcgtcacctcctgtcgccgttttggccgccagccggagcgccagctcgtcacaccgataatcggctgggacggccggagcaccatccccggggccttgatggcgtaaaggctgcgggggaaaggatgttgagggctgctcccccgtctatgaggacacgccccaacttcacattgcaaacggtgggggaaaccaccatcgcgatctgtcctccccgggaaatgcacggcgggtggtcggtctggtcgaagtgagggtaacctccgaccaccgcgcccaccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgccggttgccggcgggagtcgccggggccttgcccacacggcgctcctgcctcctctcctcctcccacttcctcgtccgcttagccaaacttttgaccacacggcagtccgcgaggtcgtggagggaggtgttgtgcacggaacaccacttgccggtcgggcgctccctgctgggagcgccagcctccttctttttgtcgctcgcaggcctcccctttcgggtggcccgcgaagcgccct

SEQ ID NO: 69017 - DNA, 41451 bp, Oryza sativa
caactagtttctgtaggtcaccaggaaaatctgcacggtactggagaaaagcatcaagaaaggtcagtaaaaacgtaacacaatttaaaagaaaagaaggaatctttaagttcaacaggaaaataatacagtgaggttgcacttgcccaagggaaaaacagaggtccataaatgttatgataggcagaattatacagttaccaatctatgatgtaaaaacacttaatcccatgattatagaatgctagttcaaaccaacaacaggagaaggtaggctggacagcatgcagatagtgatttagcaaagaaaaaaaaatcaatctgctttccactgaaactgacaattaaagaacatcgtaagagcgaagagaggtcataaaacataagaataaaggatggagacaatacatagtccatatggcaagtctatattccagtatgaaggactgcagaaagtatactcacgaaaatcaacacatcaggatcaatcactataacaaacagcaaagagtaggatccacaaacctcaaatgcaagaccaagaatttcttgggacaaatggtagaagtcgttgtgaataatggcagctacttgattgatactatcgagttgcttctctagctgcagaagacccaaaaaaaaaagaagaggtgagtgccaaagttcaattagtttgtatcatggctcagtaatagcacctgtaactcttggtggcttgggaaatatggaatcatagaaatgactgtgtttaacggcgtcggtcctaatgtaatgactgtcattatggtggctaatgagtgtggcctttggtgtatgggagcttctttgcttagggagttcctcagtaggtcgctatccccacttgggtgaggtcattgttttgtggtttcatgtaaacttaagtcctgtatgtctgtagggtgagggattgcttctgcttccctccccgtgttctcttgcactcttatgaaatgatacgcaactctcttgtgtattcaagaaaaaaaaatagcgcctgtaacatagaattagtgtaatgtctgggatgcaccaaatagccacacataccaccaccaggagctgcggcatgacagataagtcagccagctccttatattttgcttaggtttatcttcagtccatttgtttcattctcaacttaagagtttgttagacagacttgcgatgtgaggaccaacacagcaacactattatctcatgtaccttttctactctcccaccccctgctgtcggttaggacttagggttccctgtctagggccttgccaactgaagaatagaatatggtatgatctactaaagggaggtttccccataacacaaagcagcaagccagcaattaaattgtttgaacagttttactgtgttgccctaaaaaacagttttactgtgcgttattaaaccatagggatgcaccaaataggaggcacattagctacatgaaacacttgcttaaactaagcatgccatgaccatgtgactacaaagggtgttttactgtagctaaaactaagaattatttcctctacatttacatctattagggtgtagttttagttaaagtagaatacacactgagggaaatcatcaagccatgcatattaaattgaatcttattctactaagttttcctttctccaaaagctaatagtgatataaaagcatatagatccttgctaatagacattcttatatcagcaacatgcaaaaacaaaaagagcaaaacaaacaatcacatgtacacctgaaggcagcaccatacttgcaaacaagaataaataatagtcattaattaacactccaaatataatggacatcaattgatatttctctgtggattatcctaaatggtacagctaaaagccaatccatatgattgaacagcagatgttatcatctctggagctttggttgatttgcatatgtacaaacctgaactggcacaatagccttgtacaagagtaaggcgtccctagcagcatagcataactcctttgcaactcttgcggatgacaaacaagcatcctgcactggttattcaacagcaaaaatggatgtatatcaaatccagacttttttgtttacaatagccaacagcatttgcacagaaatgtgataaggaataacaaaccatgtcaaattagtacaagtactctagataatatatataaacagcagaaagaatgtgggtccaggtataccttcagggctccatgaacaagtttcattaattgaagtgctgatttagatataaaacacttttctggcaggaaaagtaaatcaacaatggaatcttctcgatcatgtgatgcctgaaataacaggcccctttaatatgttttgtacgatgaatttcacactatactgctcagtagtttgcacatgaaaacagggaatcgaccaaagcaactcacaagaggattgtcgtaatcataatgtacaagaagatgtcttgcttttaccaagatctcatttctcttccttacagcgaaatggacttcaacatcatcaacaaattgggtcaacttgccatcccttttttcatgtgaaatgaacatcatattcctaagagtattctcaaattcagttgtacttctcacaacatcttggaactcaattagcttggatgcctcatgaggaacagcctgacacaattgaatgattactccaattaatcaactcttgagcataattttatcaaatgaataaggtaaatgcataccttggagataaaatgtttgataaccaggtcagatattcttgaccaagttaactttgaaaaagactgcatccatgtgatattttctccacaaatggtctcacatacaaacttgattatatctattattcttgagtaaagagctgaaccatctttgtagcccttgaataatagtaaccaattagatgactttccaagacaataagaaatgaatacaacaatcaactttccttagtactcaatgcatttccaagatatcataatcatcactcaagggttcgtgatttcatatatgaaattgtctaattttccatactcaataaagcagccagcagccagaaaaagattttaatctttttctttagaagtaactgcatctttaattttttgaatatgcaacatatatgttgagttaatgccttgaaaataacaggcacatgattgacaatgaccaattagctctggtgaatcaagaaacactacgaaccacttacctgtagttcctctgttggggttacacacaagattgatatagggtattgaggaccacttttctcaagttcttccacagaaactgccacagatatgttgctgatagctggaactaggacatgcttgatcatcaagtctgctagctttgtcattccatagtctacagcatcaattatctgtacataaaggaacatcagaaaatgagaaagtgacttgcttttcaaagctcattgcagcatacaggtcatcaatacaggtagtggagacatggagcttcctactatatcacatatggcttagcctagttattctgcaacatctggagatcaaatgattcagggggctagccttatggggacccaagagaagtaagaaaggttgattccacaaaccacagaatcacctgctacgtttggagggtatgaaaagaataaaacaatagtatcggtacagaagatctaacaaatatgattggtgcaatatgctccttttcaaaggtgcgaggagacaatttcagcactctgaaattatccacctctcccgctggcaaactttaatgctattattgttcagtacttaacaaattgtagagcttaaagacaatattaccatttgatgttccaaatttccatcgaaaactaaataccgtagcacaaaaatatgcacttatgtatttcttattctaaggcaatcgctgaacaccaagataattcctatgatctcctggcaacatttatctgctagatatgttttatggtccaaatttggagctctcacaccaaactgattttctcagtataaacctcacctccaaggcctgcagagccacgcgaagctccacaccaggtgttccaccggacttgcctacaggcgcagtcctcaccatcaccttccctccctccggcgcaaactccacacattcctccaagttcttcgcaagcatcacttgcaactacattatcaccaaaaaatcattatcactgacagttagcacaactgcacaaacacaaatcgtaacaaaacccgaaaccctccggagtagaacccccatcacctcgtcgactagctgctcccagtcgttccggagaagcccgaacacgacgggttcgtcctgactagatccagatccctcgggatccaccaggagaggcttgagctcggcagcggcggcggcggcggcgagggggtcgggtgaggcgcgagcggcacgaagtcgagcggcgaggtcggctaccgaggaggcggcggcgaggtgctcctgccgctcgcggagctcgcggcgggcggcgaggaggcggtcggagagctccctgaggtcggagaggcccggggacgaggagagcggggcgagcgccgacgcgagggaggactcgagggaggaggacgaggccgaggagtcggcggcgcggaggagcgcggcggcgagcggggcgcggtgggaggaggcgaaggagagcgcggaggcgtggaggcggtcggagcggatgcggaggcggtcgatgaggaggcggaggtccggggccgagagcggggtggaggggtcggcgtcggcggtggtggagaggaggagctcgcgcacgtcgtcggccatcgccgccggcgacgaggcggtggtgggggtgggggcggcgctgcgggatccggacggggaggagttaagccgttggggacttgtttgataatagcaacaaaggtaggggctaggggcttaagaaaaaaattactccatgagtaagggcatcttccatagttgcagggtagtactccctccgtcccacaaagaaggtcgttctgctcacaagcaaatgtcttatatttgttgacgctgcacttctccaacagcacacagttgcaaactcctagaaaagcatccataaagaaagtgaaaagttttgaattgattggactggttgcattagtttagggcctgttcactttgatgtcattttcaaccttatcaagttttggtaaatttaccaaaaaaagtggctacatttagtttgctgctaaattttggtaattatataagaaatcctgccaaaatttggtaaggttttttttggcatcaaagtgaacatgcccttaatccatgaagtagcatatatggcagtgtactagtactactcaagccatgaaatagcagatgtggctgtgtactagtactactcaagcatccacatgattagctctaatcccataaattaggggcaaaattgccattttcactcacaactaatttggctcaacaatcctagaacgtctagcattttgggacggagggagtggcagttgtttacagtacccacaaattagtttatgtagaatgaaaagtaagatgaggcttgctttgaaaaaaatcgtaagttttctagggaattctatgatccggtattagttcttcaccacctccacactacctgctattttattataccgcggatatcctaataatgcaaaagaaagtctctacttaaggcaatggaacgttttctagattctttctaatttttacatgtcatttaaaatgtcactgaaaaatatcaaacaaattgagttacctaagtctatagttgaatgcaaatcatatgaacactacaaagaagataagtttttccagtcatatatttaatttgagctacctaatataatgccaaataatataaaccaacatttcaagaacaatctgctgaaattctaaaaccccataaagcaggcaacaatctgtagagtttaggcttagttagtcaacgcatgaagttttatgatgattacatataagaaaacaactagttccaaacctcctttctcattccttatctttttcctcaccatcacttcaaccacccgcttgcctttcttttattgatattattcaccctactggaaggacctatgccaaattggattgttagtgagaagtcaatgtgctttttagactcaaccctcaatatgaatgacgggatgctgaaatttgtctgtcaacactaatgtggtgttgcctaatcaagacacgagcatggtgaaagatgctgctacaactcggtaccgaagggaagacgacgatgacaaaggaagtagagaagactatgctccaaatcaagatattcctagaaaccaaaaagagcgggaccataatccaagttaagatgcatcaacgccaaggccttgttctttgttcaacaaggagttgctgagagtttgttctcatgtattactgacgccaagaaatgaattaaggggaagttggttggaattaattcaactcttgaaacccttgtctagcctactctttagctcatgttttcaagtgttcccgaaacataagtcaaactagttcactgcaacacttgaagttcttagacaagtctagccacatttagtagctagtaactttactagcaggtagtagtactactagttgagctcattaaacttctgtgtatgtcgttgtatagcctataaataggcaaccatgcatgtatgaatgaccgatgatatattgtccaacactttgagtgaaaaaaaacaagctagctaaatacactatcctgactcctccgcttctagcatgagctattccagtgcctctgtcccttgcgcttgataaatatttttgaaccaataggctcctccgatgtcgacgttagtgaggatggatgccattggtgtcttcctctcatcaccaaggtagcatattttggtagtccctgatcttgccgagcgtggcaagccacggtactaggggagacagctctcattggcggcacacataaacgcgagagtgaaggacaacatcgagcgggtcgttgagaaggtcgagccatgagttgcaatgaccgaggaggaggcggtggcggcaacgatagggcctcgctcgttttctcgttgacgacgtagcgatctcgatagaaaacaagatcttcatgggcaagaatggaaaatgaatctatttatagcttctaattgagggatcacatcaggtgcaactgaattttggcaatttaaccttttttatgaaacttattatacaaccctagaaaaaatttaatcgaacctagacaaagcctcagctccaaagacttggtgatgagctttatgggaccgacctctataataataaaatacatgggctatgattcactaaatgtcaagcatcatggtggtttggtgtctacttgccttccccgacgcacgtgttcaactcctctatgcccctctttttttcatttactttttttatcaaaaagcaacccgctcgtttggattcttaatgtttattatagtagccactattaaagaaaactattttattgagtctgctcttttgttttattggttctattattattattattttaagaaagaggtgagggggtcaatgctaggtcccatggtactgagaagttgggccttagcaccaacgttggcgtagtttttgttaaggctcatttgtataataaagtttgtaaaagggttaaagtgtcaaaattttcatgtgcatggtaacaacgcaagcttctaaaatgcaatacacatactatactagactagataaagtactagatgacatcaaatgattatatttccaaaaacactcagatgattcaagtatgcaaactacaaaaattagcaaacagtgaaacctcaaatcgtggcttcaacagttcgatataacattataacctcatcacatgtatgaaagacatttgcaacattgctaaatgaaaaacaaattagccatatcatgtacagcatagacggtttgaagcatcagagttgttattattggtcgtgaagattatacatatggattaaaagaaaaataatgaaagaacaatatacagttctactaacctgtaattctgatacatacaacaaatgcatccagattgcctcttgttctgtttatcttaatttagaccccccacccccaccctatgcgaggggtgtaatcagtttaatttatttttctttttatacactcgaattaaagagcaaaactttatcctatcttcctttctcttgtatgtgcacttataacttggtaataagcatgctttggatggggtcctgctgtgatgtaaaaattcagttctcgctgtattcaaatattgcaccagtatgattgaaaccacatgacacatggacggcccttgcattcttgccgaattccaccatcataggttcaaagtaatcaacatcgtttccgtgtccctgaaaagcagtcgatggttagcacaatcagctgaaatagcaatttcagcataaatgaaagggaaaaggtccatataccacctaaactttggatgaagtaaagcagggatggacatatttaaattttcaaatgaaggtagaccaatcatttttactgtactaatcgattggacgaaaaatgtgaaatcaagtaagtgcacaggattaacatgacaaacaatcttgtagttgcagacttgcagtggtagcaagtaacttactaactgtccaccagaagaatggccctcttcgaaaaaagtaccgttagcacctccccagccccacgtgtaaatatctccacctgagtgtttccagatgcttcaaatatcagtaacacgtagcaactaaataaaatatgagaaactagactattatctaatatacaataatacaaacagggcagtggcaaaagtgttaaatattaagtcatgatgatggaaacttgttatcaatatataactatttgcttcaaacaacgctgtgctactaagttatactccctccgtttcatattataagacgttctagcattgcccacattcatatatatgttaatgaatctaaacacatataccgtttcatattataagacgttctagcattgcccacattcatataaatgttaatgaatctaaacacatatatatgtctagattcattaacatatatatgaatgtggacaatgctagaaagtcttataatatgaaacagaggaagtagaatccaacatactagctaagtagctaaaagacagtacaattatggtacctgaaattacagcggtgtgcttccaaccacatgatacctacataggatatatggtgagtgtccaccagaaattgtaattagaattgtccatgatagatgcaatatataaaaaaggttcgaacagatgactagatgaactaaccttagatacaggaaacttaaataaagaactcttcagaacctccggagagcgaaccatgtctgtaccactggtaaggaatttaatgtaagcaaacatcctcaattttgataaacattggtacaactgtaacaacaaaagttgaagtagcaaatttcttgacaaagtggaaaacaaatacccaagaccaaggcagccattttcatttgaaccccaagagtacaaatctccactatctgcaggacatcacaacatatatttttagaaacctacaacaatagaaacaaagctgtaattgataaattctattgtgaaaacttatcatgaaaattcaccccccccccttcccagtaatggtacgtaaaacaatagcaggcataaaccaattaaattgactgatttgaacctttttgtagtatggtccaggacaacagaaggataaggcagactaataattggaagcataacaaaggggtttctggtctgagccaggtatatacagagccacatttcaaccagcgatccaaatcactgagaaggatctacctatataaattccaatatattgtatcccctaacctgccattttaatttggagaacaatccttattctaccaggaaagtaaatgtttatgggcaagattttgatctaagtacattatggaaatacttaatgccatggtgccttctaccaagttactgtaaacaaaagtaatcagtgcacctttgtataccaagttactgtaaacaaaaagaaatcagtgcatctatgtactcacaaatgcatagaacaagaaaacgatacctgtcacaacacaagtatgataacctccgcaagcaacctcttcagaaaatggtacctcctcaacaacagttggtctaagttcatcacctgatcttccaaatccctgtaatgttgatgttaaatacaaaggaatgaagggaattcgaaaaaatagatttcaacaagggcaatgaaaatcaatgccatgcgctgtaccaccttctcagtcttctgcccgaatatgaacaatgtacctttttctgcaagttgttgtgtaagagaagtgtaagatggggaaattatgatgtgtacaatttgaagattgattctccatagtcttaccatcgatacaagctgagtgcagcattcccgcagctatccttttaatctggccaatgtacaaatacataatatgagaacggaaacactattatctggagccaacattgaatctaaaagtaccttgacaccatcaagattcttgatcaaccttggagtatattcactgcacaattaatggtacaatcatcaattttttcatccttggagtatgttcactcacaattaatgtattgcactatgcaaacacatttagaaccaccaaactatttttacagtgaagattctgatagaatgtcaagtgaggccaaaaatatgccaggcactcactccagcacatgtcaatagcttagagacgaacattagtgaagtaatttccatctaatcagtatataagtctctgattaattttgtttcttagtattcaaaatatttgctagagataggattagattacattgctaggggttaagcaaagaggttaatatctattatttccttatccccttctctcttcctccatcctgtgcatctcctacttctagcacattctctcctgccatggcaactttcaagaattagatcctcacccacctattattgcatcacccaccacaaccccattagatccaatttatccaaaccaacacatgcctgtgacaaacttgtatatataacccgcaaatgatgacatatgaatttgttgccagcttggagtagagaattttgcatctctcgtggttaagattttttttcttttatgtttgtatctttgggttaccacggaatgtagagtactggtgtataccaaactcatgcataacaaaagttatgagcgagttaaaattttcagagatagttaggctcataccttgtagttatagagaatcccagtatgctagttttatgtccatgtccaagcctgccagcaccagcagctccccagctcaagacttcaccctcctcttcagaggaaaatttcagaatcttaaaaccagtgatattcaaaaaaggttgctgtaatacaactacttgttgcactcaccggtagtagcaattgaatgctccgaccccaaagcaaccattttcactctagcgtcagccaagcagtccacctttcttggggtagaaactacttttcctgcccctaaaccaagtaataagaaaaaatactttactacgtactgattaaaagtacacaattgatcaggtgatagacttagactaccatattgccaaagtaaatcttagtaagattatccattcatagttggatactgatgcaaagacatacgaggcaaatagagcttaagtggtcatgtaaatctgcatgcgtatgaaattatcgtatagctcctagcttaaaacataaacacgttcaaaaaatttctgggaaaaagtgattttatgaaatgacagtacaaccatgtgttgccttaaggaagtaaagtaaggatatcacgttattacttttgccaagaccaagctggccacttgaatttctgccccaagcgaagagcttgccatccgctgttgggaacaaccaaacacaaaatcttagtgtaaattggtttcgacaattacacccatgcacagggtgtgcagcataaaataattttttttccaataagaagcataaaataaatttggcaaatataaataaaaagtatcaatgataagcctgtttatctcactaaatagaaaattataaagtggaattttgtattattgtgcactgcaagtagcatataatgaataatcttaaatttgtatacaatctacaaagaacaaacgagcagtaagatatttcagctaaggtatggattgcacagcttaggtctgggtagagtgcataattacagataaaattaatttttatttgaaaatggagcctattcaatatgtaacatacttccttaaatttagtctgtgtatccaccatccaatacaatagtaggaaccataactacaatcttctaaggagagtattgcagcaacatgcacaatttctgtagatttctatgtgatggttgatgccattaaggatgtcagtgggctaatcaattgttacacattgacccagcctagttcaactgaaagtagaccttttcactagcaatgaagaaaggtgcattgttagttgaaccagtgggtcataaaagggcacccatatgtcaactcactccaatccctattccctagataaacctagataacatgcacataatcatgagatctagtagtaaagtaacactaagcatcgtgaagccagaaatgatttgtttggttctattctcagatatttatggtcatttcattacaaaatggcaatgcttgaagcgacctttacgcagagaagtgtgaatgctgctgtgctacaatttacagtaacataacgggcctttaagtgtgatattatcagtatatacattcccttctcctggtcaaacaaaatcatgtcttgcactttttgctcaccagttactgcacaagaatgatggttgccagctgaaacttccacaactttctcatcaaagccagaaacttcaataggctcctgcatgcaaaagaaaagaactattttatcatgcacataactgacattgggaacaatgactacatagatgaaaataatcagatctgtagattccatagcttatcagggaaatgatctaagttgaaatcaaccaggagaaagactgaaagacaatccaaaacaatctctttatttttgacagatcaaaccaaaacaatctggagactacaaaaattttatatcaataaatgttgtaaaattgacaattggaaaatgtgtgtctgctttatttcttaagctcggggtatcaagatctgattaaaaaaaaaagtgatactgctcatacagtaagagtggtttttgcaacatgtaacaggagtcagaattgatttggtcaatccccattgcaactctgatatgtccagccagctttcgcttactgtgtaaaagtaggctggctcacaatgtagatgaaaatttcacatggaggcatgatgtacaagaagctcagtaccagggaatgagtcacggaggagcctatcccgagctgcccgaagtcgttgagacccgcggcgaacacgcgcccgctctctgagcaaaaccagcaggccaaaaatcacatactcccacattaatctcgattcaacacaatctctctctcgctcgagtaattacacaagcaggcgatttcaattcaggagtaccggtgaggaagagggtgtgggcgccgccgcaggcgagggaggcgggcgggtcgtcgtcgtcgtcgccggggcggccggtgaggaagaaggggcacgccgtggggctccaccgcgactccagcgcccccatccccagccgcccgtagtccccgttcccccacagcgccgccaccctccgccgccccgccgctggctcacccgacgagagcatcctcgccgcgcgccgctgcgaccgccacggccacggccaccgcctcgcccgccacatcggcggtggttgctgctctcgcctctcgcgctctcgcgctctcggctcgcggcgtcgggtgagtccacgtcggcgacgagaggctgctcctgctcgcgttcgcgcggcggaggcggagcccaaggtaggtggactggtgatggatgggcttggtgggccgtggagtgagagagaagaaactgggctggtccgttacgggctgggctggctgttgctcggtcggcctatcaaattggaaaaagtatactttgactcccttaactatggcacaagtatgattcatgatctccaaccacaaaaccgggtatatcgactcctccaactatcaaaactggtgcaaaatatatcccaggtggttttataagcggttttagcttacgtggtgcttacgtggcagtgttgacccggtctccgtcatacgtgtcgttgacatgtcacttatgtggcattttagcatcaaaacaaaaacaaaaatacgtgagaccaacatgtaattcacactaaaaaaaatagtgggacccaccgacatgtgtgccccacatgtcatcatcttcatcctttctccttcctctctcctcttctctctccttttccccttcctcttcctctttctgtggcctcctcgctcccctcgcgctcctttctctcggcccaagagcgccgccgcccatctgctgcgccgcaccggtttatgcctgaccgccgagctccggagctgcccgccttacctcctatccatgacgccgccgaaaaccacttcggtcctgacgccgccgcctgtcctggagcaccgccccgcacagggttcgacttcccactgtcgtcgcatccgggaccccaccggtaacgacccctcccaaatctcagcttgaggaggaagatgctaaccgtccaaccaccttaagaacaaacgattaaacaaaaacagattaatttagagccttgtgatgatgtgcaagcaaacggtaaaaaaatttgcagggataagaaaattcccaggagccgaatcagaaggggagggaagaacacggactgaacagatggaagaacatgtatacttggcagggtaaaccaatgaaaaaaagcaacagatgtgcccagaaagccaataaaagagagagaaacacacttttaataaaaggaaatgcttgcttaattgttctgaaccaaaaaatcaaaggaacaaagaagaagaggaagaaggacacaccaagatcagcatgaaaagaaggggagggggccgccgttgtctgccgcctcctcctggagccggtgccgccgagcttcttactcgccaccgcctcagccatggccatggccgtcaaggccaacacaaccggcgtcgtctctttctcgctcgtccttaagccgtcgcggggcgacttcgtcgtgcgcaagtggtttgactccgccggcggcggagacgactcggcggtgacgacatgtgaccgacatcggagcaccatcccgacactggaggcagcgacaagcaggggcggatccaggaacaaaaatttggggggctcaattacacagtttcttcaacctctagccatctagggacctttagtttatcattcatggtgaaaaaaatgaaggggtgctccggagggtatccatgtatcttgtgggtgtaggggggactcgagtcctccctgcacccacgttggatccgcccctggcgacaaacactgccatggcacaagaggaggaaggaggaacaggaagttgaacggggaagaggaaggagagagaagaggggagaggaaggaggaggaaggggatgacatgtgtggcccacatgtcggtgggtcccactattttttatgtgaatgacatgtcagtcccacatatttttgttttttgtttttattctaaaatgccacgtaagtgacacgtcaacgccacgtgggacgaagaccaggtcaacactgccacgtaggcgccacgtcagccaaaaccgcttccaaaaccacttagggatatattttgcaccggtttcgatagctgaaggagtcgatatacccggttttgtggttagaggttatgaatcatactcgggccatagttaagcgagtcaaagtatactttttcctaccaaattcggggagtgtattaaattttggcaagttatcttttgaaattttttgctatgatccattcattggctctttgcagctgagttcgatgcggttaactgtcaagcgtcaacaagagagcacattttttacatatgaatatgttgtgtcacattgtctttcgttatcggtttgatcaaatatagcgtggcaaccatatatctcttctgaggtttaaaaatatgaaacatgtttgttttatgtcgataaatctttgttccatgtaaaaacagggttctaacctactaaattagtgcttaatagagaaaatcttaggttgggcctgatatttttatcaaagtttcaactttttttaagataatgatcaaagttttactttagaatatttcatattcggtgtagctctagctctaggtgactaaagtagatattgagtatggggtcttgctaacgtcatcaatatcctcatgtactcatggaataggagtacgaggcagtgtgctagcggttttttcccaattctcaacattgggatcaaaaggcaggtgaatgcttggggcaacagaggtagtcgagcttcatgtgcagctgaggcaaatcttaagcttaaaagagatggcgagctagcaatggttgtagtggtggggaaccagaggtggagaagagagatataataaggtggtttaaatccaaaaaagataaaagtacccgactagtaaagatattgatattggatagtctattggatatagccctggtttgaagtgagaaaaagttatgtataaacataatttattttataatgtgagacggttatatggttttttgtgttcagctcacccttcttcttcgtcttcgatggccccctcaccatgaaaaagtaccacataccttccccatagcccttgtatttctatatgcatgcatattgtgttatcacaaatcaattggttcatagatatacataacttcaaagcgatcaatcaactaaagaagattaaattaccaatcatttcagaatcatgacgcatgatattgacctcattgatgaggtagagaggcggtttgcgtctcttgatcttaccgcggaggtggaagtccacgagctccttgtccgtcggcacaaagtggaagctaggacttaactgtagccgtgacaccagctcatgcttccagctcaccactagcaccgccgacccatcaccgtcgttgccgccattttccattatcggataatgtacttatgtggcttctaagttcttatggcaatcaaattgaaaaaaaaagaaaaaatatagtggggcattgctataataaactagtatttatatacgctaaaactaattgtagttattaactttttttggtaggttcttgtaaatgtttggtgtttccaagaagggaaaaagaaccaaaaagaatacttcctccatattttaatgaatgacactgttgactttttgacaaacgtttgacttttcgtcttattcaaaaaatttatgtaattataatttattttcttgtgacttgatttatcatcaaatgttctttaagtatgacataagtattttttatatttacataaaaattttgaataagacgagtggttaaacggtggttataaagtcaacggcgtcgtacacgggagtacagaggagttgaacccgaccgaggcaggaggttacgggttacctggttcgagcgacggaccgagaaaacaccgacccgagcctagggtttggccttccccatccccctccgccgcgccgcacgtgtccaccacactcccaaagccaaaggagataccccctccctcccttctcttcctctcctcctcaccgcagctatcggggagcgccgccgccgccgccaccgccgccaccgctaggctttccttccccttcccccaccagaagcttctcgccggagaaggaaaggaggaggagagatggcggagcggctgacgcgtatcgcgatcgtcagcgaggacaagtgcaagcccaagaagtgccgccaggagtgcaagaagagctgccccgtcgtcaagaccggtaatcccttccccttcccctccacaccctcacgcggtggggcaactcgaggaggcgagtggtctccccgtgccgacgcaatcgaggcgtagatcgatccccgggagaggcttcgccatttttgcgcggggtcagatccggggagatagggcgcggttgaggtttagggtggtaccctgtaagttttgcagcttctggggttgtgccacagctgtttgttttagagactagattggaattcttcatacatacacagtgctagtattagtttaattttgtgtgtgctgcgatatcatgtaaagttccagcttccaaacgagcacgcaagctgcggttcctagttgtttcataatcttgccgcttgatatgccgtgcgctaaggctggcgatatgagtttcctgttttgagattgtatatgtggtatggcgattttacagggaagctttgcatcgaagtaactccggcgtcgaagcttgcgttcatttctgaagagctgtgtattggttgtggtatttgcgttaaggtatgtttgctgctattatacatacgcatggaactaggatatgtctttgttctgtaatgtatgtttctcacttccgctatgatctttgttgcagaaatgcccgtttgatgccattgagattatcaaccttcctaaggatttggaaaaagatactactcatcgctatggtccaaacaccttcaaattgcacaggtattgatgtttgatttgaggagctgtgttgatatgaacttttgcatttttttaatccaagtattactgtaatttaggtgaaaccatatctttggatagttactgatttagcacttgcaggttgcccgttccaagacctggtcaagttttaggccttgttgggacaaatggaattggaaagtcgacagcactcaaagtgttagctggcaagctcaagcctaatttgggacgatttaaagtatatatttttacctcgtgcccaatttctctgttgctgactgttaaattatgtgttctcatagaaagttgacttccttcctttccttttatactgatacaagtaatgggaatccacctatatttgttgcagaatccaccagactggcaggaaattctgacatacttccgtgggtctgaactccaaaactattttacacgcatattggaggataaccttaaggtattgcattgccacttctttttatccattgtgtttgtccttcttttaggcttttttagcatgtactctgcgacagtaataaatatcttaatttgtcgtttaccatcactatgtgtgggctctgagtacaatagcatcagtgaggtatttgtttcagtcttatttttggttctatagcatcatacatttttctggtaaacttttgtatgcatgcaaacagtaacaacacatagcgtcagcaagatactattgatcttccacttatgcaacctgcattaaattatgcactcaaatattgtccgaatctcaggtattaaatattgctttgatttattacatgtcaaaaaacccttagtagccaaaaaacagatattctggcattggaatagactgtcgctatgtttgatattatcagtattgattgcttcatacttctattaacttacatgcatgctgacatgctctatttctctttcctaggcaatcatcaagcctcagtatgtggatcacattccaaaagctgtccagggaaatgttgggcaagtacttgaccagaaagacgagagaggcgtgaaagctgagctttgtgtcgaccttgaattgaaccaagttattgatcgaaatgtaggagatctttctggtggtgagctccagagatttgcgatagcagttgttgctgtgcagaatgcggaaattttcatgtttgatgagccatcaagttaccttgatgttaagcagaggcttaaggctgcacaagtcgttcggtctttgcttagacccaacaggtaacatattcgttatgttattactatgattatgtaaatttaaactttgacgaatgcaatatcaagttctatcctatgtattttcagctatgtgattgttgtggagcatgatttgagtgtcctggattacttgtccgactttatttgctgcttgtatgggaagccaggtgcttatggtgtagttactttgccgttttcggtccgagaaggtatcaatattttcttggccggatttgttccaacagaaaatctacggtttcgagatgaatctcttacttttaaggtaacctgtgccttttcagatttagatttttggctatgtgatgaaacattgtttttatgtatgttctgtcctttcagattgcggagactcaggaaagtgctgaggagattgagacataccagcgatataagtaccctactatgagtaaaacacagggcaatttcaagctcactgttgttgagggtgagttcactgattcacagattgttgtgatgcttggtgagaatgggacagggaaaactacattcatcagaatgctggtacgccacccttcctccgtaactaccctaatcttcagttcaaaatcaatcaactaaatctgcagttatctttctgatttgttatgaatggataggctgggttgttgaagccagacactgtggaaggaactgagattgaaattcctgaatttaatgtgtcctacaagcctcagaagattagcccgaaattccagcattctgtgaggcacttgcttcatcagaaaatacgggattcatatactcatcctcagtttgtgtctgatgtcatgaagccactgcaaatagagcaactcatggaccaggaagttatcaatttatcaggtggtgagctacaaagggtggcaatatgcctttgccttggaaaggtaaatagatgtttcttctgacaaatataatacaccatttttgtgccttttaaaagttttaagacttcatgacctgtctagttatatatatatatatatatatatatatatatatatatatatatatatatatatatatatatatatatatatatttcacatactatatgctcatttggcttttgtgaccaaatcttctaggtctgcatttatgttcctgcaatgttttttaaattatatttgcatcaagaacaacaatacatagaccgtaattcgtatgatatttcttcctgttttatgtgggatttcagaatgcattaaactacggatacatgcacatggtctttctaaacctgtcactgatggatttcaatgagttctattccttgctcttctcagaaatgccattttggaatctgttttagttggcttagaacacattttatccatttatatcctttgatgtggacctggtgtggctcaatctgttttgctagatgacattggagttagatatttgtattgttgtatgttttacttaagcatagaatgactcaagaaataattatttttcctgtgggcctactgtcatggggtagatcataagaggagggagataaatcaatctgaaatttgtaacactgattagacaatggtcttgaatttggagacttgtagtgctacagatctcagtcgcggtgtgcttttctcataaaataacaatcaaagaatatgtcttgtattatttacttttgtttgcacttttgaagcctctgaataatggctatgaacaatccaattgatgatccacctaacatatccgtagtactttcatgtggctaagcacctaaatgctgtattgcctatataaatattgacttgattgtcagcttattgatacttgcaatgtggtatatgttcagcctgcagatatctatctgattgatgaaccaagtgcctatcttgattcggagcagcgcattgttgcttcgaaggttatcaaaagattcatccttcatgcaaagaaaactgcatttattgtggagcatgatttcatcatggctacctacttagctgacaaggtcattgtttatgaggggcggccttctatcgactgtactgccaatgcaccacagtctttggtatctgggatgaataagttcttatcggtaagttctgaatattaaatattgagaagagatccacaagtttgttgtaataccatctcgcatccttgtctttggttcagttgtaggcaacttcctcaaaagattaatttttcagtagagtttgacattctatatctgtttttagttgtcgaaagatgtcccacttctgtttatttttcagagtatttcatttatgttttcacatgctaatgctttctattgtttttccttttgtgcatgatagcatcttgacattacttttagaagagacccaaccaactataggccaagaataaacaaactggactccacaaaagacagggaacaaaagtctgcaggatcctactactaccttgatgactaatttgaaggcgtacaggttcctacagctctcatttatgctggagtagtttcatatcattttttaattcttattttcacttattaagtaatttcgtttttcttttgccttgctgtgcagaatcttcttgtggagcttcccgcccataatttgcccaggccttcgatgtcctacgcattacttgttcagaaggttactttgaagctaccacagcttgaagcatgctaaataacttggctgcaggagtgaagtggtatcatcatcagttataaggctgagcatgtgatgctgacacttgagttcttttgctggtttgatatatatgatgatgggaaagagagatgttactgttaaactgagcaactttgtcaggatcggaagattgtgaatttttgtgtatttttgcattattgtatcgtggatttaccaactggcacccttaaatcgttggttttataggcataaagtttttgagctgttactcatgttaccaatgttatcaaagttctctgagttattactgttaattcactttatcgagataataacgtagtttgtctttttttttattcagatttttaaaaatctgtagtagacaaaaccgaggtttttctttgttttgatcggatgccagattcatttgcttgtgtttagttttgttgtgtcaacgagaatgattgagttgcgttacatgcagattcatgttgtttgtttctccacaacttacagtcgtggaaaatttaaggttgcaatgtaagtgaaacttaataaatctattatttgcaagaagccaatattagaaaacaaactatgataagaaacctcaaaattaacgctaaaattaagttttggaatttaaattttgtttgtgaccattcttccaagtagaaaacgatagctccatcaaacaccataaaagttattgctcatttaatttcttgtcaaaattaaccttaccaaaattgatattaccaaattaattttggtattaataaaatttgggagcttttgttgcatttggtttgaccccttactaaaaattggaaaagtttttttggataggaaacttttagaattaccaatatttggtatggtagcaaatgataaagttacatttagtttgttaacatattaaaatttgataatgtcaaaacttgataaggttaaaaatggtactctatccgtcccaaaatacaagagattttggtaggatatgacatatcacagtattttaaatccatagtgataggaatgtgtttcatccaaccaaaatcacgtctattttaatatacttaaatggtaggatacgatatatcacagtcttttaaatccatagtaataggaatatgttctatccaaccaaaatctcgtatattttaatatacttaaaatgaacatgctctcggtgcataatacaaaggccttgttccagaggtgaaatgttttggcgtgtcacatcggatatatggacacatatttgaagtattaaacgtagtctaataacaaaacaaattatagattccgcctgtaaactgcgagatgaatttattaagcctaattaatccgtcattagtaaatgtttactgtagtaccgtattgtcaaatcatggtgcaattaggcttaaaagattcgtctcgcaatttatacgcaatatgtgtaattagtttttttttctatatttaatacctcatgcatgtgtcgaaacattcgatgtgagtaggatggacaggaagcttgtggcttgttagctcacttggctcggcggcaaggcccaagcccaagacaacagctgaacaacaaaaccctaggcacacgcaccgcatctctctttgtctcgcgaatcctcgtctcctcgatccccttcggcccttccgttattcgcatgttccgtatccgcagtgcgccgtcgctagccgctagggccgccgccgccatcgccggacttcccctcctcggctcctcctctaccagctacaaacctgcgtttacgatggaggaagaacgagaggtgcaagagcaagtgcctcaggttgcaagcgtggaatcccagagcaaacacatgagcgtgtcttgttggtttggctcgcgaatctaatgagctagctctagctttcaaacgagccgagccgagctgggtttctagctcgttaggataacgagttgagccgagccagctcgttatcctaacgagctagaccgagccgagctgagctggctcgctatccacccctagatgtgacagggttaaaagtttttgcgtgggaactaaaccgggccaaaatcttctcatggtcatgtaagttgggtacgtacgtattccacttttaaaacaacaaggtggctgggacaacatgatattactagtacgagtaattttctttcaacgtatatatttttataaccagttgattagaccaaaagatatcttgagatgagcttcctttcgctctctacttcacacttgttcaatacggtacggacagattttaaccaccggctgcctgcaagtagtaccggtgtgtccgtgtctgctcgactgctctccctctcctccccgtcttcctccctctcccggtctccccttcggttgccgcgtcaccaccaccaccaccgggtcactgccacgtgggccccacacccccacctccgcgacctcgcggccggtgagccgcactgcgcctcccctccgctgggtacaaaccgagtgaccgatctaccacctccacccaccgccatcccccccaatcccccccacacgccgcgagatctcccgcctcctcctccacccgccatggatctcctccgcgaccgccgcctcggcgcgctgctggtggtggtgctggtgctggtgagcggcgcggcggtggaggcgtcgatccacacctacgacagggagccgttccgggaggtggggaacgcgttcctcctctccgggggcagcgagggcgtcgtcgccgacggggccgacctcgccgcccccgcctcctccttcatcaagtaaagtttcccatcccccccgcaccacacctccgcgtctcggtggttggaaactagtatagtagtaggttctcgaagccgctgccaagggtgagaggcatgtgctgctggctgctcggtcttgaatcgcctggggattaggcgtcgccggcgctgggaatgggaaatggggggcgaggcgtcaccgctggaggatcccgcccgcgcgcacggttttgctgagtgcttgcttgattagtggcaatttaacttttgggatttttcattttggcaagacattagtgctcagtttgtgatttatgaccaaatttataattgtgttgccgatgaagtaaaattcgggttgcttagatacacctaacattgaaaatgataaaatctgcaagttgtgacccacacattgaactcggtgctcaccatgtagttgtttgcagtgttttgtgtcaatattgttcactgcagttcattttagttttatagacttttagttcagctttgaacttcttgtgctgataagcagggctgtgctaccgccgtattaaaccgatgcaggttccactattatcattttgagtaacatttgccatggattaggagaattacatagctagttagctactgccaatgtgaattacggagcatgttgacaagctgatatgtgggctcagaaaatcatttggttgatgctgtccttgtgcttactagctgtttctatctgttttattgcgtccatcaggctttattttttgtaggaatatgtatgggtttaatcttttctgggatctgtatgtgttagtttaccgatggaaagaactatgctccattcataacaattgtataatttagtattaaccagatgctgggttttcttactgtcaggttcacgaatgttactttctggagaactccggaatcagctgaatcacatgcaaaaatggcacacagtacaggtctggtacaggccattttatttgaagcagctgacagggataacattgggggatctgcctatggtggacagaggtccatatgttgtacccctgaccttgctaaactagagggctgcaaacaaggggaagtaatcaggagaccatcctctgatgatcctgattggccttatgtgctagatacacacttcagtggtagtcacctttctgtgaagttagaagatgaggtagttcgcattaccaagacaggcatgtacaacttgttcttcatttcctgtgatccaaaactgagaggccttagtatgagtgggaagacagtctggaggaatcctggcggctacctaccagggcggatggcacctttgatgaaattttacgtttttatgtcactggcttatctattggtcatggttgtctggtcgagtcagtatataagattctggagggacatcatgccaatccagaattggatcacactaattattgcacttggcctttttgagatgacactatggtactttgaatacttaaacttcaacagtagtggtgtacggccaattggaatcacaacttgggtggttactgttggagccatcagaaaaacgatttctcgcctattgatcctttctatctcaatgggatatggtgttgtccgcccaaccctgggaggactgacctctaaggtgttgctccttgggctgacatatttcctggcttctgaattgctggatattgcagaaaacgttggaacaattaatgacatttctgggaaagcaaggcttttcctagttcttcctgatgcctttttggatgctttcctcatactttggattttcacttctctctcccgcacacttgagaagttacaggtaagctatatttgatgtaatttttcttgtctgcttttataatgatgattactccctccgtcccaaaatataacaacttctacaccaacattctcttctcaaccaatcacaaccctccaccattcaattttctcacctacctccacttctcatccaatcacaacccaaacctatttaattctatctactttcttagtaactgtatccaactctaaaaatgcttatattctgggatggagggagtagcattttatccatgttttctcttttcaataaagtcataacatctgatgttttggtggtggaggaaataagtgcttgcaattcttttctgatgcgtaactaactgtgatctggtggagttactagtgtatgaagaacctatgatagtgatgttaatatcaaaattctaatggtgttatgtgtgctcacaaagaggacaagtgctttaaacagtgtttataatttcataaccaagtctgttgaaccatgccaaaatagaagtatgtattgtgttgcttcttaatcatcacctttttttattgctcatcaggctaggaggagctcagtaaagctggatatatacagaaaatttactaatgcattggcggtatctgtaatagcttcagttgcctggattggttatgaggtatgcaaatttgactttgttaatcaatagtgcatattggctcactgacctatgttcctggattggttaatcagtaatgtggtgcgtattagtctcttaagttcctgtaagctttatgaacatccaagtacgtcattatcacatggcattccaaaattgtgccctctgaaaacaacaaagtcttctttataatcaaaatttatctgctatttttagaggacacctctatcagaatgtcttctttgcactttagtgcttcactatttttatgatgtcctgataaagcacccatggaaaatttggatgattcattttttttcataatacttgggttctaagcctgatcataaacttcttctctgcatgagtgtgaaaaagaatcatggaagacattactcacttcatgttctgcaattttcttcatgctgatatgagagatggtttcattcatctgcagattttttttcagggaatcatctgttttatagcattatagctgtgataaataacctgctctgctcaacaatggcttcattttgcaggtctatttcaaagcgacagatccctttagtgagaggtggcagagcgcatggatcataactgcattctgggacgttcttgcatttgttttgcttcttgtgatttgttatctatgggcgccatcccagagctcacaaaggttaaatctttgcctcttcaatgactggaaatgccatagtgaaagtagtagtgtagcttgaaatgacttgaaagtatctgtgttgctacttgtaataaccagcttatctactcaaaatgccgatagctcgcctggctgcctgccatcactagaaagtagtaatgtgtttttatacggcacaagaaggttatctttgaaagcgctctaaaattgacatgtcaaaccttgtccagatacgcatattcaggcgaagctgccgacgacgatgatgaagaatctcaatctctgacgaaggggaccgacggtgatgtagggatggtaaaggttgacaaggacagaagtggtggtgtcagtagtgctttcagcttggaagacgaggctgaggaggacaaaagagagtgacctgctggagcaagaatgctccaaggttcctgagctttcttcttctttttggtggtgatttgatcttctcttttgtaccttctcagttacacaggtcatgtagaagcgcaccattttatccattcctgcgaggatagtatgttcgtggtgttccatgtggagtttcacataggccaggatggtgcacattatttaaatgactacacattcacaacagtgtacatatctgtttttgttaccggttgtgcattgcctgatgtatcatggtatcatgtatgaaactggtgaacgcagtgtttgacagatctgtttgcctaattgactggaagttgcagatgaaaaatagccaaagtttttaatccaaaactccagttctcctgcactagcactaaccatccaattacttcaatgcttttggttccaagacctggcatcaaggtatttaagccataacagttcaatctttctattgttaaagcatcagcagattctcgtgagaagatttttcaatagcggattctatgcacgggatagataaaatcgtaataaaacactgttcgttgtcgtgagaagattttttgatagctggattgtatacatgagataggtaaaggcaatccagatcctctgcaggcagtattgctcactgacatgtggatcctacatatccttaggcccacatgttagtgaagagtactgcactgcagaggaccttgagggcctgtttgggggagctttagattctgagaagcagctgtttggtagccagcttctgaaaatctagaaaagctctgaaactcagcttctccagcttctgacttcttagttcatttttcagaatatgtaactacagattctcagaagctatggactgtttgggacagcttctagcacccaaaagctgcacctgggacaagcttgtttgagtcactcaggtaagagaaacaatccattttttttcagattttaagaaattgtagttataaattcagaaaataaactagaaaccagaagctagaaaatctagcttctaccgtatcctcaaaatgtagctaccaaccagttatttctcggaatcttaagctctccgaacaagccctttatcataataaaacactgttgtactctctagctgaagctgtgcgtgcagccttgagtccttgacagctgacgttaaacattccaacggcagatggcatcatggcaaacaggcaaagagccaaagatgcaggctgagcatataaaacccttgctggtcaagccgcggcatgactgacaattgcacaaacatgcgtcaaagaagtacaaggccaaggaaagatgattacaagtcactggttaactcgagaattgatggctgtgacaccgttcttgatctaggcacaagattcttcacttcagccaagcaattttctcatcaagaacgaaagagtacaaggatggcatgacaaactctggattcttacagagtaaaggctttgtctgattcttcctccctctgtagaacggtttgttctatgttgtgagttatgacatgctttcataaactcctccctatttacacaaatgaaatcaggtgagctccccttctaacttgggttcaaaatgagaacactgtaagcggtttgaacaacacaactaggcatctacaagccttaccttctgcaattctgaactagagtctagaggtcatgagttgacatgcttgtctaggaaagcgtttgccagatttctgaagctggtattagcatctccagccacggcatactctcttactgccttaagtacttctggtttcagaatatctttctttgtcgaagggttacacagataatataaagccccaagtgcatagttcacctgtgaaatcattggaatggaattattcgtataggagaaactacagaaaagtgaggaatcaataagaaaatctattttttcaaaagaacaaaacattcatttcagtaattggatagtgttgaagttatggtttcagaaatactaaccgtattcttcactgggctagataagcattgtatgaccaacggaattccaccgcaatgagtaatgactgaagcatttgctggatctgcatgtatacaaatagaccaataagattttaaaaaaaatctatgtttgctggaaacacaattaaaaagtgggaacattaaaagggaaaattgggagcttgaagtattgcattgctcaccggcacaagagttacagattccaccgatgccaaattcgataagcctttcgtttggctccgtaatgcagtccaagaacaattctaggatatttagctgagaaagcaaaacagatagacaagttactgaacatgatcgctaattcaagtcaatccttatagcacatgaaatctgcacaaactgttcctaaagaacaagtgtgcgagataacaacctggcgcataaaggtgtagttataaggatcatatgcgaaattcgccaaatttgcaacaattctctccttggactctgcgataacaaaaataaaatagaatcaatgaacaatgtttaataagcatccaatgccatgtaaactctggcgtccatgaaccgatgaacttattctactcgacagtataatcccgaattatattttcatttttaaaaaatgaactagcttatgctggcttttatcaataggagaaaaatgcagaaacaattcggctgctatggacaacctaacgacggacggtcatctcatcatgaattgggtttgcaagacgagaaatggaactagctgaccttcatccgtggcctcctggaactgggtgacgagatcctgacgaggcggacgcaaatcaaacggagaaaaaaaaatcagctgatcagcgcgaggattttgcaggataaaccagtcgaatcttttccatgagccaaaaagcaaagcaaaagtgagccaacctggaggtgctggtctctcggggtgccgtggcgtccggtccgctcgacctgccgctgcgcgttcgtgaacatcgatccccctccgacccggcagagagagagagagagagagagagagagagagagagagagagagattcccgatctgctcaccgcgccgccgtggttgggggggagaaacgctgctggtggtggtggcggagccgatgcccgcgggaattgggggcggtggtctcgacgagctccccacgcacggagagcctcggctcgcccagcggaagcgagggggcacctctcgccggagtgatgccgccgccgccgtgtttcgtcgagaggggtctcgccggaggggggatttgccgccgccgtgtttcgtggaggagagagagaggggagagcggggaacagctcaatccgggccgtacgacatcgatctaacggtttcggatggggacacgtcatgcattgaaacacagtttcgggctcttttttggaacgaaggattttcatgggaaatttatagggtttatactgctatatacgtactgtacagctcatatacggttagatatatacaaccataccatagatcaatataagagaagagcatgttcatatgtattgcagctgtttaccaccattgatcaaattcagttatacgtgagtcggatagttgggtcatatgcatagtaattttcgatgtaactatggaattattttatatttttccaatgaagctctttggttgaaagatctggctacaaaatttttattggaatcctttctttcctccaccttttaacttttttaggatttcaaacaggagctcaaacctcttggttttgatttcctttgaaaagtccaattcaccgtgtctcttcatctctcttctcaactctatcttaataatacgagtatctaaattccccatgaatttcttatgaagtatctaaatttccttcgaattccctgtgaagtatctaaacaaccgttagatatattcatgtgtcataggtagtgggccgaggggtcgaggccctagggataaggatagagtcggttggataggattagattggatcctccctccatctatataaggatggtttgtatcgttattctagtcaagcaatgaatcaagattagtctctcccaacctaagtccccttctcatccctagcagccgtcgccgcccggctatcctcccggcggtgtttacccccctatgaatcctaatccataacatcatgtgttttcaattcccgactttctatttctgcgtttttactatttatgtgtttttttcaatttctgcgttccaaaggagccctagcagcttagcaactctgatctttccaacgttgaagtatcagtgcatcttgtaatggattttgctcttcctttttttttactaacttcttacaaaatctactcttccttgcaatggaggacaaaacaatatttactgcaaaatcaaggcaacgagtagcatagtaaagctctcgtgtggttgcagcagtcacactttacaaaccattgtagtattgaactggtaacctagagctggcaaaatttgggaaaagaaatacagctgatgcagttgtacgtgagagacttctgagcacagctggggcaaacagattcagatgttagcttttgagcaaaccaaatactgttaggttcaagaactcagggtcttcttgttggtgtcttctcaatctgtgacgcggagtggctgttcattcttcacaatcaactcaacttgattctggtcagcccatacagctgcatccagatacccaagctcatataatttgtctagaacctcgtcttcggcgggttccagagcccagttaaacagctgtaattgatttgagaattgagacagtgtcaaagtgaatcaaggtgagtggtaaaaattgtgcatttcgaaagtgactgacctgtcgggggctagctctgttctccggattgcagtctggactaataccaatcccttgcaatcctagtcgactggctgggaaagcacaaattcgaacctgcaattgtaggcatagtgtcaagaataagcattgcaaaacaggcagcatggcacattgtcctgttgtatgcatcaaagatgtgtacacaaagtagtacaacgcaactggttctgctaatggatatcgtggggggcctccctcactgtttccggtaaaaaaaaaactcagagtagaatatttttggagacagagaagccctcaactcacaagtgtgatgcatcctgcatgagacaggccaacttgcacacgcccattcagaagaagcggtttcagaattgcacattcaaatttcagtacagttttttaaaacagattgctcagttatggaaaaggaaaagaaagaagataccccaaattcaggttatacagttatcttcactgtaaagtataaagagagcaacagaaaatgtattaaatttgagaagaaaaacacattattatgtactcagcttatgatcattttagtacatgaacacatcacagtgcttgcacctactacagaacaaaacatgtctgaggtgtccctatgttgcattgttcaaaatcatagtctaaccaagacagacatgtcatacggttttcaattgtaaaatcaacaatcagtgggggaaatgcttttcatacatgtgcagaaaactcaatagttctagtgatcagaataattttgcagaaccaaaagaagttatgacatactgtttcggaagcagaagttggtggcataaacaacgtaaggcccccatcaatgcacagcctgttccggaagaaagttgcaggcctgggagctaaatatctgaaacaagcacacccaattattcttaaacttagaacacaaaatatagaagatacatacagtacgagtgaggaaaagttaacatgaatcttacccaggaataaaagaggatgtaataactgcactgattacatcatcttttgagtcaaattggtcaaccagtaagcccctaggcctccaggacagctgagtaatagcaactgatgagaagaagttaagtgttcttaattattaaatccagttacttgtcagaaaataatgtagcagaaaatacacacagcaaatatgaataagcaatggttgaacagtatgaagcttaccacggatccttccgttgcacctaatgtgcacatcatctgggagaaacctgtctagaacatccttgagtacagcctgctcaagtgcacaagattacaaggttaaaaacatatcattcaatcagccagcacatgaactatttagtgacttgagtgccatatatgtctgtcgccttcagcgtattttttaaaggatacaccaggttactcatcacagttttctcgaattattacagtctaaacaccaaggtattgcaaagttgaaacatagttggcaaattggtcataaataaaccaatgatctatcacacatatagttgggtataatttacacaggaagcaaactcacatgttggccgcaagtataattaaaagtaaacaataaatggaaacagaaaacttaccccaaggcgaaaggctgtcccattgctccgacagttatcagctagatccttggtcacttgcaaagcatctcgcatcgtgttcccagatgcaatcactgcacagattatggcaccagctgatgaaccagctaacggagttctttcctaatgtaagtcccagataaagaaaccactataagaaaacttgctaaaaaaaaaagcagcagcatacatacaaaatgtatcacacgtaagtcctaaaatcacaagcataggaatgcagaatttccatgcataaaaatagcaggcaatgttaccacctagacagtacagtagcataaaaattgagagctctagccagccatggcaccaacaagctactcctactactcctactaagctaaagagaccaacacggaaattcgactgttgttagccacaatttcatctcgaaagtaacccgctcattggctaaagagaccaatgtgaattggattgttgttagccataatttcatctcaaagaaacaagccccaatagctaagcagacaaacgtaaattggattgttgttggccacaatttcatctcgagagagaaacaatctccactatcgtaggcacacggatctcacaattcatctgagcagaagctcctgtctcctactgcaaaaatcaagtacgcgttcgcgtagaagaggtaagagagatggggggtggacgcgcaccgtgaggtagcccctgtcgatgaggcactgcgcgacgccgatgtggtaggggaagagcagcccggcggcggagaagctgaacccggggccggtcagctcccgccgccgccgctccgcctccacgtcctcgggccgctgctcccacaccaccccgtccttcgcctccacctcctccaccgccgcccccccgcccctccccgcgcgcaccagcagcgccgccagccccaggaacacctcccccgtcctcaccgcgagcgacctcttctcggtcccctcgggcagcggcggcggctccgggtcgcggcccgcggcggcgcgggcgagcatgaagcgacggaagccccccggccgcgcggaggcggaggagggaggggtggaggaaggtggctgcggcttgggagggaggccggaggcggcggaggagaggagggaggaggccatgggggctcgccggcggccgccgacgacgacacgtgtgcacgcgcggcgaagcatctgctacgtcgttaattcgtttaggtgcgtggaaaaaataattaaaaaatcgatgtagttttcttgtttctgtccttttgttttcgattttattttccgtgggcaaacgaaacgacacgtgtcgctgcccaagtcgatgtacgtcgtagctttggatagtagaactccgtatgcaggaatttttcgtgtcgtggcattggtatggctctgatcggaagtagtatttagtttcggtatcacctatatatttttcgacaaattttctcctaaatatttgacagatataattatagtataatcgtaatataatcggcacaggtgataaccagaggagacgtggtgcgcgttcaagaagctggatcgatttgtgtcgcgactccgtccaaatcgttgtttatcataaccttttgaaagatcgggaaccctagtgcacatcacaccctaattcgatgatgaagctgttgccctccacgctcaagctgtcattgtcctcaacgtcaaagggctggtgcggtctcttcctcgtcgtcttcggcaagtacgcgctcacggatcacgtcctcgctgacaactctcacctcaaccacgtggattgggcacagatggactgcgtcgtcctcggctagctataaggcacgatctccgccgacttgcttcaggaagtcatgttggccacggctacggctcgctctgtttggtgtgatctcgcccatcaattcctcggcaaccaagaatgttgcaccatcaatgtcaacgccgagttccgcaacttctctcaaggcgagctctccgtcaccgactactgtcgttgcctcaagtccatggctgacacgcttagcgacctcggcaaacccgtctccgatggtgcactcgttctccagctaatcaccgggcttagtccccgttttggcaacatgcattcacttttgtccatgtagaaaccattcccatcgttcatggatgcacgctctcagctcccgcttgaagatatcatgaagggctctcaaccggcagaaactgcttccgtgttcgtcgcagacaccgtcagcggcgcctctcgtcccgctagcagcaacaacggttctggtggcgttccccagaactcgaccaacggctccgtctccggcaaaaacaactcgcgaaaccacggctgtggccacagcaactccgatggctccggcggaaacaacggaggtggctagggcaacaccacctacgcaaacaaccaaggccggcccaccacctcccccatgaagcaggccgctgttccggcccagcaccaggcccagtggccgtccccttacaattcctaggccgggacaattcagatgtggcctgccctggtcggtgaggactttgatctgtgctctttgtctagctcttgttgatcttctcataaaaagggtaaaagatgaccaataaactaaatagtgaactttcgatccaccgccgcaggacgcctgacatgatgaaattgacggaattgctcgatagggcaacggaaagagattttagatgctaataaagtgaatgatgaactttcaatgctataaagccaaaaacgaaaacttttgttactataaatacaattttgccttaaaactttattgtacgtactttctatatctaaagtaatgaaagaaacaatctttctcgaaagcacattgggccacgtagtgttaaaaataatggccatcgaatgaatgcatcgagaatggatggccatccgatcattaacgacatacatgcggtagaaaaaaaaaacatgccgtatgcacttccctcccgagccttatagtgtctcctggcaagaataaaaagaccactgtatgtgaaagacaataagttatactagtttatgatgactataaccatcctgttattaatggtgtggatgaaatcttatctataatgtttagaatttgagtattagtttgtgcaaaaaatagaaatgctaatcaataacagaaaattttaaacagtttgctattgtaagatatacttgcaaggatgattttgtaggcagtggcatagtagaaccctttgtgtcattgaaatgaccatatgtgttattttgagcaaaggcatgatttaatgttgtcattgttcttacttttctttttaattcctacaatatgcatgtgtacagccctctggaaattctgcaacccaaaagccagaaccatgtcaaatgctccctcctgtgctcactcagacgatcttttaatccttgagttgcatgatcttcatgataacaactgaagttaacttacttttatgaagtaatttgttaatgtatataatattgtacgacttagtattataaattgcattttatcttattttttgttaaataaaaacacattatatgaaattacattcttgatgagtgcttttttttttcttctagcagctgaacttccagccgaaggcacgtgaaccttcttgattcatcctttttttttttcttttcatgcaaccattcctcccttcactttcaatcctatgtgccactgtgccagcttcattcaccatatcaatccaacagtttatatatttttcatgatgtggctcattctggagcgacaatacattttcattcgctagcggcctgccaacgacataaagattgctatgtacacgatccaatcgtccaacacgcatatgactaagtttaatcaatggttaccatgatttgaacctctaccctttgattaatttatggttatacggcttcagtcagtcttatgtggatagcacaacttgatcgaatgcatagtgagactctcgatacaaacacacgaagaagcaaaagatttttctttgtgaaagatcaccaatcttaatttggagccctcttggtcgacttgtgtaaactcattcagcatttggtattcgttcaagaaaaaatttaattcgttcaccatttggccaccatcccagaggtctcactttggagaccaatccccatcgggatcgtcgccaaattgctacaggtcccaagtcaattctctctcgaggattggcctggatccgatcaagattaggcttcctatgacagcgtttctccagcttccaggtaaataaatggacgtgcctcattcccctaggacgtcaacttgatcagccactgttgtcggttcagtgcccttaaaacttaaaaaaagaaccgatcatttcattagattaaaccctccatcaacattggttaactaatgcaagtactagtattagtatacaataatatctctcacattttgtcggcaagaaaattgcaactggagaattggagggttttgttcctctaactacaggattgtcagtgtcaggacactaaacacacggtcgtggccttttctggaaaaccggaatttcgctggattttggtagtacggattttacgccaaacagcgcaatttgttcctaaaaaaatgttaatttcatttcttgaagtcactcgtcagtacagcatgttgtcttaggcagtacagcatgctgtcagttcagagctccaaaccttaaaacacactagtatttctttaagcaccttgtcagtacagcactgcactacaacatcttctcagttcagccacatactccgtaaagcctaaactgactggctgttttaagtttaaaaaccattgcaatatttgaaataaatgttaagcatctcgagatctgcaattcgattgatctttaatcttttgtcagcagagcaatttgtggcttgatccgggatcgggtgttttgtagtaattcttctcgaagctggaggtgttttgtagtaattcttctggaagctcccgtgatccgaagctggaggcattagaaacagtttagccctgtttagttcacaaaacaaaaatttttacactatcatattaaatgtttggacggaatattaaatatagaaaaaaactaattacacatgattgcgtgtaaattgcgagacgaatcttttaagcctaattgcatcataatttaacaatgtggtgctacagtaaacatttactaatgatggattaattaggcttaaaaaatttgtctcgtaattttttgacgaaatctgtaatttgttttgttattagactatatttaatattgtaaatgtgtgaccgtatatccgaaaaatttcccctgctaaacaatgccttattttctaatgagcaccgactcaccgacaattctgatcaaacaagtctctgaaatgagatcagaatcaaaagcattggcaatgcaacagtcatgtttcccactctcaataacaagaagcaactgaagtttatttatttttatttgtttttgctttgaactgaagatttcattcgaatccaactatagttttgatgatcatatatacttcacaaaaagaagtaaacaaaggtacaaaagcaagatcaaaagcagggtagatttgacttgaaaagatgcaaatttgggccgaatttatctgtccctgctattaccagcactgataatttcattttcttttcttttttactgtaacgaacgagagagaacgaaagagctaggcgcgcgtccaggccaaggccggcggcggcggcgccgccgccgccgcgtcaccgggcggctgggtagtctaacggcagcggccgcacctcgtcggagagcgggtccttgtggcggtacccgtag

SEQ ID NO: 69018 - DNA, 16318 bp, Oryza sativa
cgccgctgctggccttctacgccttggctaattcggcgctcgtcacgctgtatgcgatgtgttggaaggtgagctcgccgccgccgagctcgccgtcgccggctgcctcctctccttcctctcccttcgccgccggtggggacgcaatgttcttgttcttgtggcggcggcggcggcgacgtccgccggcgccagcgacaagccaacgtacgagaccaagtccatagacccgagcctcgccgtcatgacgttgccggcgcctgtaagtaagctatccatatccatctagttgcgccgccgtgtgcatgatctcgcatgcgccgacgatttgttcaccaccaggggcggcggcgtttgctcgccggagaagaagctggtggtgccggagagcgtgtgcgggcggccgctggggctgcagttccaccacgcctccggcgacctgtacgtggccgacgcgtacctaggcctcctgagggcgccggcgcgcagcgggctggccgagaggtggtgacgacggaggccgccggcgtgccgttcaacttcctcaacggccttgacatcgaccagaggaccagcgacatctacttcaccgatagcagcagcacgtactggaggaggtaccccaaattaaatcaatcggtcatgttcatactgcacagtgtgcatgcatcatgcagttaatcgtgtgccacgctcgccctccgctgctctgccgccgcgctcgccctccgcttctttgcctgcagctgagctcacgcccgccgccgctatgctgccgcgctcgccctccgctgcgccacctgcatccacgtgtgccgctccgcctaacgccggcctcactcactgaagaagagaaagagaggagagagaaaagagaagagaaggagaaggagaagaaaagagaagaaaaaatatgcagctgacatgtaggccctatgtactttttaaaatttcttttgctgattaggataccacgttagcgaaaccaccaatatatactgccatagaaccttgagtgaacggttttagtaagtttagggtaaacatatctggttttgtggttatggaacctcaaaaattctcgctattaacttgagagacctctggtgaacttattcctttccaagtcaaattattatccttcacctaagttccttttctcatgggccgattcacatgagccaacccttctcaaaccgaagtccaatatacctacccctcaaaacacagtatcagtactggatcttcccatggacccattccaacaaaatgtctctcctgctttacccccaaagcccaaaaggagggctgggaaggtgatcttgatggatttagaaaggaggagaagtgcaagtatcaacaaactttctgatggatttatgtcccctgatccaaacttgggtgtgggaaagccaaggggaaaggatagggcaaagagtaccaagaagcttaaaatgttggctcaagaaagtggtatcttactctctcttaaccctttgcctctggaacttaacgatcctaatgcttcagatgatgagattgatgcccctctcgccgattgttctatacggctccttcaacagattggcactgaggtctgtgggatgaacagggagatggtatctgccaaagccttgactgcccatgctggaactgggagtcaccctgctgctgcatcctaattctgtcccaatgaacagttctattttgctattttgtgaccctgtgttaggtctctcctgggtctgtaataatgaatttgcctttaaaagctgtgctactgtgatgaatgagtcatcttccatgaaggctccaaccgttggtctttggtcatgtattatgcataggactttatcttgtttctttttgatggacaatgaattcgcacaatagaaactggaatattttttgctggaattttaggggtctcaactctcctgcccgttgtcaggctacaaagcaaaagatagatgaaagtgcctgctcgattttttgtttataagaacaaaaaaggatcttttttatgctaagtttcttaagacgctagcccctaagtgatttgataatttctttttctctccttctgttggagcctcggggggtgttttcattggctggtgtaactctatgttttctagagttcacctacagcaaacccagcatgctttagttgtcatgctttagttgtcagtttcacttcaaagttaaatggacagaattgggttttgatcaatgtttatggcccttcccatggtcctcagagagatgagtttgtacagtgcctacatgatcttgatattgccaatgattattggatgatcctgggagatttctgttagaataaatgggctaggcctgatttttctattaaatctcaagagcccataataaatgttaaggataataataccacgctgcaaattaaaagaggagtatctcaacttaaatagggagttattggaggctccctgttgatcggttgaggtggggattggaaagccacacgcgcgcgcgcgtgcgagccgagccgtggcgtggtgtgcgtttgcatttctctctctctcctttttgcaacggaccagaatccaatcccgcgagatttcctctgcgtctctctctctctctctctcctttttgcaacggacaggaatccaatcccgcaagattgcctctgtaatatatagccgattcaatgcgattgatagcgtggttactgcggcaacgggcggattcctttcctgcgatattaggaaacagaggaccccgatcagatctgagagcttagtttccaaacgctggttcttcctcctagtgcctgtgctacttctgtttccccgattctgatcacttgcgcgcacgagtgatcggaaagagcagagcctccgaaaccacaccttcgtttgagatctgcacgggtaggcgggtgatcaggtttttggggagtgcttccgcacgactgctctctcttaatcatcgtcggtggttctgttcggtccgcgtcacggcgatgtctactagtggtggcgtcaacaaaggggccccaggaactggaaatgcaccgatcgacaacaccaacggaggtagttctgcctcacaatccagcggagggacctttacagggtataacatcctactgctatttctgttttcgttacttctggtaatcacaattttattgcattgtctacatgatgttgatgcttattttatcttaagcatgctcctggttatgtttaattttattactagatcacctcatgttgttcatgccatgattattgtcttaatattttggattaaaatatgccgatatatgactatatttccaacaatccaaaaacctgataggtcattttcggtagttggctttgctgctgcactgaaaccacatgcttttgatggttctaattataagagatggaaagcacgtgcactactgtggatgacagcgatgcaatgtttcatggggaaaacgaagtgaaccacctttctctcctgaggaagaggttaagttcgaggcttcggatttcctgttccgtggagcattgatcagtgtactcgctgacaatatagtggacgtgtatatgcacacgccttcagggaaggacatgtgggatgcacttgaggccaagttcggagtttccgacgccggcagtgagctgtatgtcatggagtagttctatgactacaagatggtcgatgaccgttctgtagtggaacaagctcatgagattcagatgttggctaaggaacttgagaacaacaactgtgagttgccggacaagtttgtggcgggaggcattattgccaaattgccaccttcttggtcagattttgccacttctttgaagcacaagagacaagagttcagtgtatctgatctcattggctctttgggtgttgaggagaaggcgagggcaaaggacaacggggcaaaaaggtcgagggaggttctagtgctaatatggtacagaagaagaaccctcatgcatcccacaacaacaagaaagtcaagcctgatgtcaaacccaaggctacaaccaattttaagaagaaaggcaagggaaaggcaaagggagactgctttgtgtgtggcaagtctgggcattgggctaaggactgtcctgagcgcaaagacaggaagtctgccaacatggtcatttgcgaggcggaggaatattggggtacggtaaaattttacctaaagttctctctgtttttcattcacctgattggtaggttgatactggtgctaatattcatgtatgtgctgatatttccctgttttcttcttatcaggtcgagagaggttcctccttgttgatgggaaacgggtgtgacatcccggcccaataaggattaggcctgtgtggcccatgtgagctgtgtgcgcatgtttagtaccaccttgctagtttagcacgagtggaaccgacttataaggcctcttccctccaaccacatcactcccttttacacgaaacgaggacgaaagtgtaagtggggtggtgtgtgtaagtgggcccgctcgtcggttgggctgggctacgcggttctagagggagggctgttacaacgggtcattgcggctgttcatggtgttggtatagtcgatctaaagtttactacgggaaagactgtgcagctgaacaacgtgcagcatgtcccttcaataaagaagaatctagttagcggctctctaccatgtagagaagattttagacttgtgtttgaatccaataaatatgtcatatctaaatatggaacttttattggaaaaggttatgacagcggaggcttgttccgcatttctttggatgacatgtgtaataataataatgttgtgaaccatattagcgagaatgatacgtctaatgtgtggcattcgcgactttgtcatgtgaatttcggttgtatgacgtgcttggctaacatgagtttaattccaaaattcactttggtcaaaggttccaagtgccatacttgtgttcaatcaaaacaacctcgtaagcctcacaaggcatctgaggcaagggatttggcacctctagaacctgttcattccgatctgtgcgaaatgaatggcgtgttgactaaagggggaaagaaatacttcatgacactgatagatgattgcactagattctgttatgtgtatctattgaaaacaaaggacgaagcattgcattactttaagatctataaagctgaagtagaaaaccaacttgaaaggaaaatcaaacggttgaggtctgataggggtggggagtatttttccaatgagtttacatccttttgcaaagagttttgaattattcatgaggcagccgaaagaaacggttgaggtctgattggggtggggagtatttttccaatgagtttacatccttttgtgaaggatttacagttgacacctccctattcaccccaatcaaatggggcagccgaaagaaagaactgtactctaactgagatggtgaatgccatgttagacactgcgggactttccaaggaaaggtggggtgaggcaattttgactgcttgtcatgtcctgaataaaattccaacgaagcataaagaagtaacaccattcgaggaatgggaaaggaagaaattaaatctctcatacttacgaataaggggctgtttggccaaggtaaatgtacctatagccaaaaagcgtaaacttggaccgaatactgttgattgtgtgttccttagttatgctattcacagcgtgggttatagattcttaatagtaaactctggagtacccgacatgcgagttggtacaattattgagtctagagatgctacattctttgataatgaatttcccatgaaaaatatacctagcacttctagtcaagaaactgtcataccccatgagcactttgcaccgatacaacataatgatcaagcgcctgagggaaatcctgaggaggataacattgcagatactcgtaagagtaagagacaaagggttgcaaaatcctttggagatgactacattgtatacttcgtggatgacactccaagaacaatagaagaggcatattcatctcctgatgctgactactggaaggaagcagtacgcagtgagatggactcaattatgtctaatggtacttgggaagtcgttgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggatttttttgacacctactcaccagttgctcgcctgaccacgattcgagtactacttgctctggcagcctctcatggtcttctcgtccatcagatggacgttaagacagctttccttaacggagagctagacgaggagatctatatggaccaaccagacgggtatgtactagaaggtcaggagggaatggtgtgtaaattgttgaaatccttatatggccttaagcaagcacctaagcaatggcataagaagtttgacaccacacttacatctgtcggctttgttgtgaacgaagctgacaaatgtgtgtactatcgctatggtgggggagaaggagtgatcttgtgtttatatgtcgatgacatattgatctttgggaccagcctcaatgtgaatgaggaggtcaaggactttctgtccaagagttttgaaatgaaggatttgggaaaggctgatgttattcttaacattaagctactgaaaggagaagagggggggattacacttgtgcaatcccactatgtagacaaggttttaagtggctttggatacagtgactgcaagccagctcctactccttatgatcccaacgtgctattaaggaaaaaccgaagaatagcaagggatcaactgagatactcccaaatcattggttcattgatgtacttggctagtgcaacgaggcctgatatctcatttgctgtaagcaagctgagccggtttgtctcaaatccgggagatgatcattggcaggctctggaaagagtaatgcgctatctaaagggcactatgagctatggaattcactataccgggtatccaaaagtactggaagggtatagtgactaaaactggatatctgatgccaatgagataaaggccacaagaggatatgtgttcacacttggaggtggcgttgtttcctggaagtcttgcaagcagaccatcttaacgaggtcaacaatggaagcagaacttacagcactagatactgcgatagttgaggccaagtggcttcgtgaattcctgatggatttgccggtggttcaaaaaccagtgccagctatcctaatgaattgtgataatcaaacagtgattattaaagtgaacagtttaaaggacaacatgaagtcatctaggcatatcaaaagaagactgaaatctgtcagaaagcagaaaaactccggagtgatagcattggactatgtccaaacggctaaaaatctggcagatcagtttaccaagaggctaccacgtaatgtgatagacagtgcatcgagggaaatgggcttgatacctacctaaggtcgcacaatagtggaaacttgtccattgtgatcggagatcccgtaaatttggatggcgaaacaaactattgtgtggctgagagaagagacccttgaaaatggctcattttcatgatgtacttctcttctattctgcatggtaggatggcttatgccttaatgtggtcctagtagcttttctaagcagagatgttgacctgcagaacatctcagaaggaacacacctatatgagttcgactgctagtcacagtctatgagatttggacgatctctagatactcatgaaagggcctggagtttgacttatatgctccaaacagaggggatgcaaatggcagcccagtaccagtcaaaggtttgagtgaaacctgatcacacaagactgacaattcaaggcatagtccattgttcgttgtggtctgatgtagctcatttcctatgtggaagttcaacttaacagtctctaccaaaacactggtatatcaaacaggttcaactttgagaacatttcttatgagccatgaaatttggtgaggattgttagaataaatgggctagacccgatttttctattaaatctcaagggcccataataaatattaaggataataataccacccttgaaattaatagaggagtaactcaacttaaatagggagttattggaggctccctgttgaccggttgaggtggggatcggaaagcgacgcgcgcgcgcgctgagccaggccagctaggccgagggcgtgggcgtgcgttgcgtttgcgtctctctctctctcccctttttgcaacggaccggaatccaatcccgcgagattgcctctgtaacggacggccgattcaatgcgattgatagcgtcgttactgcggcaacgggtggattcctctcctgcgctattaggaaacagaggaccccgatcagatctgagagcttagtttccaaacgctggttctttctcctagcacctgtgctgctcctgtttccccgattctgatcacttgcgcgcacgagtgattggaaagagcagggcctccgaaaccacacctttgcttgagatctgcaccgggtaggcgggtgatcaggtttttggggagtgcttctgcatgactgctctctcttcgtcatcgtcggcggttctgttcggtctgcgtcacggcgatgtctattggtggtggccgtcacagcaatgtctaatggtggtggcgtcaacggaggtgcgccaggaactggatacgcaccgatcgacaacaccaacggaggcagttctgcctcacaatccagcggagggacctttacagggtataacatcgtactgctatttctgttttcgttacttctgttagtcgcaatgttattgcgttgtctacatgatgttacttctgttagtcgcaatgttattgcgttgtctacatgatgcttattttatcttaagcatgctcctagttatgtttaattttatcactagatcatctcatgttgttcatgccatgattattgtcttaatattttggattaaaatatgccgatatatgactatatttccaacaatttcaacttctatagatctgttgacaacagaaataaaccggggggcaacatgaatgatatatttatcttcaatgatgtaatcagttccttgggcctgctcgagattcccctaagtggaagatcttacacatggagtgatatgcaagctgatcctcttcttgaacagcttgattgggtttttacttcggctaattggatcagtgtcttcccaaacacgcaagcactagttacggctaagaatacctctgatcatgcccctatcaagattcagattgccacctccattcctaagtccaatgtcttcaggtttgagaattactggttgaagcagcctgggcttttggatcaggtctctactgcatgaacagacattcctcacataactgatcaagcaaaactgatctttgctaaatttaagagcgttgctctcttaagaaatggagtcaatctatctctaagttgtctagaacaattgaaaactgcaacaaggtgatcctgtttctcgacaaattggaagagcttagacttctgaatgtgccagaactgagatttaggctgatttttaaagatcatgttgctcatctactccacggtcgagagctatattggaagcagagattcaaacagaactcagttcttttagggggtgaaaacaccaagttcttccatgcaatggccactgaaaggtacaggaaaaatgccatctcctccttgcttgatcagaatggcaatcaggtgtttgatcatgaaggaaaagctacaatcctctggaatatttacaaaaataggatgggagtttcggatttaccctctatggtttttaatcttccggatttgtttgacgataatggtgatattttctttctttgtgatcaaatctctactaaagaaattgattgcgtggttaagaatatgccaggagataaagccccaggcccagatgggttcaatggatgtttcttcaaatcctgctggccaactattgctcaagatttttataggatgcatgtgtgcagatttttggggtggttccattgacctttctgccatcaactacataattaatacatggtcccacctctcatacgcacataacgtattggagtacatgttacagctggctacaaatctgtagcctattttccttctctctcttctcttctctcctctacgtgtgcttacagctaacttgtagcctgctattgtactcactctaattggaatgtgcatgcacacattctacatccaaccactggacataatggacaataacaatttggcacattcaatgagcaataaaagtaggcaaatataacgacaaaggagacacaagctttgccgcagctaccagcactggtggagaaaacctttttcctcctggttcgtaacccccctttagtctcggttgtccaacagggactacgaatccgggactaaagatcgctatctttagtccagggtgaaataaccgggaataaagatgagtcaaccacatggtcggcagagccatctttagtcctgttggtgtagctaccttttttttatttgcatgggcaacagggccatgcatgtatctatatatgtaatacatatatacatgcataatagatatgtatatattaaagcacttaacattttatgtgcatatatgaccaaaacatatatttacactaaagtaaatgtgtacatatataaaaatagacatgtattaattacaattcattatgtcctagctagctacgacttcgacgtagtagtcgttatctcagaagctaacgacttatcaattgtatttccgttgtagtagaattcaccctcgggatcaaggacttgttcgttgatgaatcctatgagttgttcttgaaccgccgcgataaattccttgtgtgtgaggttatccctcatgtgaataacctatgaatatatgaaattaattagtaaataaaaaatcgatacgtacgcaatgaaatttggaatttatttatatgtacatcgagctctcttgtggtgtagatttgggttgtaaggcagtggcaatactcgcatacgtagtagccgcacaaattagttccctggtcttgctttgcacactacatatatatacatgacaaacggcgagagatttaatgaatatacacttatatttgaattagagattcaatataaatgtagagcatgtacttataggaaatttgaacctccgcctaagcttttctttccaattgccacagaccaaatgacggaagcgataccaagccctacatggagtttaaagctatgattcgtagtagcaattaatagcaaaattcataataacattggaacttatgacattacatgtctataagttcaaaaacctagtcaaaagtagactcatctttattcattgagtcatagacattgactctgtaggcctctaagtcaaagagtaaaaggacctagtggaatctgcaatatgtgtgaggtgatatatgaaaaattgtacatctatatgtatgggaacgaacttttttcggaagacagtaaaaactaacgctgtgttgtacggcaatagtatgaacgtcttgaaatgttgctccttcaggagatagacgagattgtcctctgtggcttgcggatacttggtgaccatttcgatgtttactttccgagggtcgatgaatctagtatcgaaaactccccgccgtcgggccctttgaatctccattctacaacgatataaaggaattgttatatatatggtgtacatatatatacaaggagctaattaaaggaacataagaaatataactcaacgatacgtacaaaatccatgcgctcagaatagatacgtcgagggcgtccagctggtatagttcgtagatatccttgaaattgatccagagaacatcttccccttgtaagaagtcggagatcttgatcctcgctccgataatctccctaccactggcgctcatctccatgtaccattgatggaatttgtacatctgtgtcagtagggactgcagctgctcaggcttgacaagtggtttaccgagttcgtagtggtgtctcacttctgcctttgggattggtgtgcctttaatcaactgagccctagttagcccggtgtcagaaatgaattcttttattccaatttcttgcccgatcaccaatagctcgacctcctggtttggttgctctccaagctgagggacttgtttgtactttccataatatgctttcttaagtgttcgctcatagtccgttagctttatggcctccttgactggtgccgacatactcctgaagaacttcttggcactcgggtccacaggaatcttcttttctggactccgaggcttcaattgcctcttcacttctgctgccacgtaagcgtcaagctcctcttgcgtgcaatcgtacggtggctccttgttcttagcggcatcaactttcgccttcttcgttgcccttgtgcgggcaaacggtggagcttggtgagttcttgacttggaaggtgttgtaacaccctgaaaatttcgaatctgaaatacggagttaaaaattcggaataatcaaaaatctttttaaacctttttgcatgctaggatttattatgcaattgtgtgtatttaggttgtgtgctaaagatctcgattaaatcttatctcctaaagggacgccctcagtccaatgtcttctcctttccttatctttacggtctgatttattaagtgcttcggtactaaataaatcacagaccttaatatataacccaaaaatcttttcttatgtcgcaatgcgacatatctttctcaattcttgccctccggttatttaaagccgttatgttaattcaactcaataaatcctatgtctacaatcgatcggcgcatttacttatcatacatccattcaaacatatccgattctattcctatcatgacgagtggattagtatgccacgcgtcatccctaaattcacttcttcgtttccgtcgttcgttcgtgcggacgcccttaaaataatcctacgacgatcgacgagttcgcttatcaggcgttaagcctaaactcctatttggcaccacggtgcatccatccaaacaaatcaaatctcatattgcaatccctttattctgtcccggtgcatgctcgaaatatatttacagtccaagtatatttctagtccaaacacagagccaaaatcaatatccatattctacagtccaaatgcacagcacattattcagtccggttacaaatacactgccaatttacaagtccaaatgtacatgttgtttccccccacccaaatccccttgcaaattcctaaactacaaatctcagaataatacaaaagttcctattacagtggaccgccttttagcccaagcccactgtcagcccaactcatctcacaacaagtctgttttttctccctaatctcagaattgcagcctaccaagcaaccttctcagccaaagtctgctctccctccccagccgatcatatgcatgcacagaacctgttcgacgaattgcctacaagccacaacagggttttacacccacttttgccgaaccacaacagtcttttgcaccaaattatgcggccattcaataccaggggcccttcccaaacaacaatccatacaccatacacccaatccacaaaaccatccacaaaatactccccaaacacgtgcagcatagtgggaagagttcacaccgatcaaacacaccgagttcacagagcagccaacaaacttaccttgccccctgtgttccaacagcttcccatgcaccagcagccggcaacatatataaaccatcgccaaaacgcggcctcacttgcacctctccatttcttcacctcctccctgctcgagctctactacagccactcctctgtccagcgcactggctgcctcctctccgcttgctccgccgcggccggctccgactgggcctcagttgagcaagaggacaggaagaccgccgcgccattgatcacctgagaacgactaactttgaacgattaacccctaacatctaacccttttgttgttctgttgcactgactcactaacccgctgactctttactttcggttgcactaacctctgactcactgactcactgacctttccatttttgtttcgctaacccgctgactcctttactttcgtttcgctaacttctaactcgctaacaccctgactcctaactcttacctcgcacctaacccgctgacgttgccccttcgcattgcgtgttcctttgttgacaacgatcgaacacgtggtgacgcgccactgtcgtgaccttaggacacggacaaatttggggataggcgggaaaatacaatttcccgcctatcctggcgctttttatcttaattcccctctcccttgctacagggtttcggttggcttttatagtgctcaaccataatctcaagatttacaagtttgccacctagggttgacatgaagttaccgaattgcccctagtaacctatgtctcataggggtatattggtgcattttgtggtccccaactgacattcagcgccagctggtgagagtggttgaagtggtccccatgcatggtatttccttgaaatgggccaattgctcgatggtactttccttcaatctttagcattcgaattgatctggccacaccaggagtcgaacacacactcccgttttctcagctccttggccacttcataagatcctgctcaaacacaacttcattaggaaaattatgtcgaccaatactactggaacgaattgtcctgttttgggtaaacacaaattcctagacgagagcaaacctcaaaagtggagaattacttcgagcatttttattcgactaaaaggaagaacttctaaaagcatgtttttcagccaaacttgggggatggtgttttaccccttgctacaacaagcccctcacgaataagggcgaagtgttttcggccgaaatcgtgctcgaaataaagatgtaagggataaaccgccgtcccttgtttgggcgaaaacatcttcgagttttcaacttggcgatcgttttaaaattccttaatttgttttaggcaaattaattaagtgattagtgagaggaaaagttttagccacccgtacaggattgaatgattagctaaacgattaattaaacaacacgtacaggttgtctttgatttgattgattgattggttaattttaaataatatttttattattattattattattttatttatttatttattattattatttttaatagaacgtgtaaagttttatgccatgtgtcgcttggttataggggtaatattggccagaacagccaagtctcttcggctatcacgcccttccccctcctgcagctatatatatggagccatgggtcactatccgatgattgctttcttttgtttcttcgagttcttttttccgataagtcaaaagcatttgcccatcatgggcaagtctgtaaagaaatccgtaaaaaagccaaagaccaaaaaagcttcttctggacttggtccttccattttttcggagaagaggctgaggaaattgcttaaaaaaggcgctattgcagatgccaaattagttatccgtcctgttgatgaatcgggtccttctcctcatcctgggtacactcttgtttttgaggatttctttgaggctggttttaggtttccttgcagttcttttgttgtcgaggttcttggtctttatgggattgagttccctcaacttactccgaatgcggtcgtccgtcttggagtgttcgagtggattatccggagttgtggtggcacgccgcatggctcagatttcgcttattttcatactatccggcgatacacaaagcaaaatacccaatttgggtgtgttagcttcacgccgcgctcgaatcgtggttgtccttggccacttgtctctaccatgcgaaccaagtggggatcaaaatggcaatctaaatggatctaccacaaaatcccagccgatttaaaagctatggagaaatgtcctttcgttttttcttgcaaggatccagaggttatttcagagcctgctgtcaatttgtcgaagaacttttcctccatccgatctcggattgaagagcttgtctccaagtttagcgttcgagatttagttgaagagttcatttgtataggaatt

SEQ ID NO: 69019 - DNA, 13390 bp, Oryza sativa
agatgctcaggccgtccctctctaccatcaccaccgcggaatcaacgtaatgtctccgttataagtttcaatatatatcattagatgaccatctcgatattctatttttctcttttagattatgcacggcagacgcacacacccacatacatcactagctacacacgcaatactgtactcacaccaccttgcaaatgcgcctcctaacacacgcttaaagagacagaaaccaacggcatatccctaaaatcacagaaaccaatggtcaattgaaagtccttctgctgtcttgtatgtgtgtaatatttgtgggtaccaggatttgaatcctgatgagtgaagtcatgcactgcatccacgacttcaccatcacaccacgggtgcttccccgccatctcgatattatattgcactttagttattgttatgcaattctactttgttttgttcaaattgcacattggatgatcagttggttgatttatagggtcgtcatcgtgtcgccgggcgattcggtgctgacggcaacgcagaagatggtggaggtgcacgcgagctcggccgtcgtcgccgtcgggaacaaggctcagggaatcctcacgtatgtgactgatcacaatcttgcttgcttactttgctttggtcatccacaaagttctctctaaaattgatgtgtgtggtgcaaattaaattaacggatttttgttgatgtgcagctcaagggacatcttgatgaggatgattgccaagaatctccctgcggattcgacgccggttgagaaggtaggacaggattgataaactgataattgatgaatcacttgctcttaataccttccaagaaccataaaacatctcaaaaaacatatattatgcacgaatttgatatgtatatacgttttatttactaggtgatgacactggatcccgaatgcgcgacagtggacatgccaatactcgatgctctccggatcatgcaagagaggaaattcttgcatctccctgtcatggacagaggtaggtaaaatgtagactagtaaatgaaattgtttggtatatatatgatgtgatgattgatctgcgggttttgccgttgtcggtttcgcaacagatggatccatagtctccatcctagacgtgatcgacatcacacatgcagcattctccattgtaagttcttgattggccatgtatgattgaagaaaaatgttcaggtttgtaatttgttgagatgtctctccactgattgcaaatgagtgggtgggtaggttgaaggcaacggcgatggtgccgtgaacgatgacgcggcaatctccatggtccagaggttttgggactctgcaatggccttgggacccctagacgatgagattgaatcacaatcccagataaggttgctgtcgtcatcctgaaattctcgtttccgcaaatgtacactggcatttccagtatgtgtgaccttgctcattctccatcttcccaatcggccagcgaggcatcgaggtcgcagatgatgtcggacatccacaacgagcagtcgttctcgttcaagctccaggacaggcgaggacggatgcaccggttcagctgtggtactacactagtactcgaaccgtgccggtttttgtacagtgttttcatttctggctagcaggtattgttgcactgtagctcatccgacaaaccaaaacacattttcgattttcttgcagaggtgcagagcctgacgccgttgatcacctgcatcctccagcggctcggccccgacctcgaccgcgaccacctcctcaaatccttgtaagcaatgtcaatccagtcccaccattgcccagaaaaaaaaaaagcttgaaaatgcaaacaaaagctgcaagcaagtcgttaactgaacaactggtgctgcgtgtgttgcagtacgaagacgaagaccgtgacaaggtggtgctggcgtccgacgacgacctcacggcggcggtggaccacgccaggctcgctggctggaaggcatgcacgaactagacagctgatcgatctctgaatgttcctgaatcctgatcatcgatcatcaccgtcctttgattcttgtacctgtgcttgtggatctttaattgcagggcctgaagctgtacctggactactccggtagctccggcgtccgtaggaagagcgtggttcccagcgtcggggtcgggggcggcggcggcggccgcagcagtggcggcagcacggcggtgatggacctgtcgagccgggacgcgtgggcggcggcatacagcggtgtggccgccggcgccgccctggtcaccggcctcggcctgatggcctatctccggagagctagctgagttccaagagttgaaggtttacaaagtgatctttcagaaagcttagacgggccgggctggaaaaaaaagctgtatggtcatgaaggctgggctgagctgggccaaaagcccaagatgtatgatgaatatccttagatgggcttgggctaggcccatcagaaaggggtggaaatgaaaccattgtgtatagatgaaagtggtttgatgaaagatgaaagggttaattggatccatgccactgcaaatagagaaaatctactccccggtatcccgtggtgtcgggatagctcttcaaccttatccatccgaccacccgcatcctcatccacccgacgcaatccccatctcactctcacctcactcccctcctctctctctctctctgaagaaggccgagcggagacgaagccggccgggaggaaggggtcgtcgtcgtcgtctccggcggccgaggaggacgacaatggcactgtgccggcgaagtcggccaaccctcagcggggtcgccctcgagctcgccttcccttgctgcgccgctttggctcaccgccctcgtcggtcggatgtgcgccggggagtcgtcgccccggggagggcagaagcgggagctcccctcgtcctcgccctcggcctcggcgtcaccgtcgtccccgctgcggcctgccgctttgcgcctccgggatgaaggctggcagtgtgcgtcgacttgcaacaggtatggccgtcaacctcctcctcagctcctcctcgagacttctcatactctctggctcgggcctcgaccctcaactcgccgtgcctcctcggcgctatcctccgccgttgcggccctccctcccccacatctcctcctcgttttgacggtaccctctgataccccacaagtatcagcctggtacctaggtaccacccggtaccttggcacgggtatcaggtatcagtcgatacctagtcggtaccaaaggtactaggtaccaggtaccaaccggtacctaagataccaggtatcaggtatcggtcgatacctagtcggtaccaaaggtaccaggtaccaggtaccaggtaacaaccggtacctaaggtaccaggtatcaggtaccagggagcacacgtggacagagaaaaggaaaagggagagtcacttaaaatatcccattgtaacagtatcccgttgtgtagctgccctcttgcaaatatgccaaattaaaaaaataccactacttttcgcgatattgactagatgccactaaaactttgtaaaattggaaccgtgccactccgtcgcgtttttcatccacttttccgttatccccgttaatttctaattttctatccttgccagctaactccggcggcgagcggtggtgttggaagcggcggaaggaagcggagaggcgggaagggagagacgccgccgaaggccgagtgccaccttccccgcgttcttcttcagccagcttgactggaagatgatctccacgatgttcatgctcgtgtcatcctgcccgagctccgaaagatcgaaactacaatcgaaatcgaatcaagggagtcgggcttgacgaagacctcgtcgcagtcggagcaggagaagacggtggcggcggcggcggcgagggtgcgcgggtcgagcaccgagtggcagtggaggtagaaatcggagagattcctgatctgcattgccctaaatgagccaccgatggatgacaacgacgaggacagtgccgatggcggcgaggtcgtcgtcatcgtcgacgatgtgctaattaccgacgacgcggagatggcggccgcggcagcggagtcgccgtggtactcgggaccacccatcagcgacctgctcgacgtgcgtgctgcctccgccaccatcgccgccgacgttccggcgccggcggcctctccccctgctcgccaccgagctctccttggttctgcagatcgatcggcacacgtgatgctcacctccgccgctgtcattcttgccttctgctgctgtagctgcagccattggttggcttctgctagcccctaggctgaggaggacgaagacaacgacgactagaacacaaccgataaaattaaagggggcggcagaaaagtggatggaaaatgtgacagagttgcacggttctaattttataaaatttaagtggcacccagtcgatatcgtaaatagtagtggtattttttaaatttggtatatttgtagtagcatggatccaattaacctatgatgaaattaggggaacaacacttcttgcagatcgaggagatggaacagtgtggatttggcataacaaccttttaagttgtatgtgaacagtaaacgttttggcccttcccctttttaaccttatggtttgctaggtagttctccaaacagaaactggagttgaagttgattgtttgataagttacggaatgacattgccacctaatttgttcttcaacttttacgagaacatctttttttttaacatcagattccaaattttctacaaatacatcagtataagaaattgacaattgaatgcccgaatataacaaggtgcattctagtataagaatttgataatttagtattttagagtagcaacttggctaagcatgtgttgttttggttaacgagtactaggtaagtttttttcacgatgtcaatatgtgtcatcacatagcaatcctacaaatattactttataatattaaatttaatctttaagaattacattattgcgcatccaatttgccacaggtatggatttttttctacaccttctcaatctcaactgaaatataatattttctgcaaagtaaagtttaattaaatttcagattttagaatgaaaatttaaatatgcttatacaaatccatgctagtatattgtcaaaattaaaaataatatgtataagaaaatattctcgaaacaattaagttgccatatcacttcttaacctattgtaacaaatttgcacccatcttgcaagttgttacactcatatgctcacttataaatttcctacactaaattgcacccaattaccaagttattatattaggatgctcatttcccaagttgttatattaggagacttccttctattctcgaggaagttgagaatgatgttttatatctgctaattgatggctcaggagatgtgtcttacaaggagctaatggctgttgtcttgtgatatattgttaaatttttagaaaatggatctaaatctggtctctacatccaaactagatacacaaccaacataatacaagattacatgccttgcaaaaggacttctcaaaccaagaagattaaaatagaacttagactcaacctgctaacaagaaaaacaatacaaccacttaatcgacaagcaacataaagggacaactagccaaagtgagatagcttccatcttttcttcatattccagccaacctttgagagaacttccaacgttgtagcttccaacaagatgcagccttcgttcaccttatttctaccgtcctctttaagcaacaaagaccactgttatacagtacactcctttgatgattatttgaaaaaggagttagttttggagccattagaggctgcattattcctaaaaacatactgctaacataaagatgccaactaccaaaatgattagcaacactagtacatggtttaatcccaaaggttataaacatgacattccacataaatattgcaatttggcaatcaaataagagaagttgtattgtttcattagaactataagaacaatacgtagtactaccctcccatctccatttcacctaataatcattggtcaaaatgaccccattttagataccataggaaaggaattctaagttttcaaataaaagatttcctttgtagtacatccccttacatatgagagctctatacttcgcgttgatagaaaagactccatttttgtgttctttccaaataaaagcatgatcttgttatgatagtgtaatacatgtcacttctgacattaggttgtaccaatctattatctaataccaaatccctcctaaaggagacaactaaaggcacccatcttaaaacatccaccactttagcatttttaatactagttatataatataatgagagataaagcttgtcaaaagaataattttccatccaacaatcctccccaaatctcaaatgttggccttgtcaaatgtggaaatgttaaaaatatattagttggtttttttcatgtgaaagacaatttatgttcctcttcccttcaaaagaaactatctatgcacctcaagtctactattgacattttatttgcggagcataagttaagtctggggcaagtgagaatggtgcaaacaatatgagaggtgagttcaatggttttctctcaccaattatgagagaaaatacattggcatattatgtttcatttgccttgctcagcttcttgaattaatagttttggccattattgtaaagaagcatgtaaaaaggaattgaggaattctttgatatgatttacatatgttctattaaatgtgattggtggatcttccaagtgaagggatacggtttgattcatcaacatgtggcacataagcaatagaatacaacaatttataatagagtttgcaaaatttcataggtgtcgtgtgataccatgaaacatccttggatccgtccttattctgctaccaatagagttaggatggggaaacattaaggattaactacaagacatgacacttgagaggttatacttttatggtctaaaatttggtacatctcaatacgttagtacaaggaagtacaaaatttaacccgacaacatttttaagggtcatgtcaggaactcttgctattcactaaaggagggtgagagcatcccatccctggtcggtcatacagctcaatggcttgccttgccaactgagcatgcgctcgtccgcttttaccctacaacttaaggagcttaactgaataagcaaatccagaaggatattattaagaaatcttatctttgtgctagtttagaaatccttttgatttgctattcggatatcatatcttatctttgtgcttaataaacacttcctccttcgtcatccaaatgtggctataaaagaagccgttgtgttgatttctctttctcacacacaccatcactgatatcatcaaatacaccaagaaaaagagctagctaagtatgttgtcaatcccattactaggtttgtgctggaaacgatgctggatggtgagaaggtcatccttgagcagaagatcgccgccgccacggcgaggatgaatgagctgcgacgcaccaaccgtgagatggaggtaaagctcgtcatctatgacgccattgccggcagccgcaagaaccttgatgacttgtctccgaacttcatcgacgacctccagaaggaggttgcaaagcgccgcgaggaggtacagaagcgcatgcaggaacttttttccatggattcctccaaacccacctgaagggattggtgcatgtgtaattacatggtgctttgagtggatgcaccctgcttgcatgtttgcacatgtatcatttgcttttggcttaatttgctttgaaattaattctcatcagcagtcctagttggagtcaagtcacaccatcaccaccatatctgttttcttttaaagttgcaaaggcatgtgtttagaaagctcggcttttatggatcatttgctagtaacccgtaaatagtatgggctattattattaatattataaatgctaatttttttatatatcttgacatgttagtatcactactgtaagtcacgccccaaacccccaccaatcactatgggtaggcgattggttgtcttgatcgagattctgatctgggtaattcgatcttttgaaaatgacaaccaaacttggtacaaacaatttaacaaccaacatatacattttattttcaatcttcggccctagcaaagtgaccaagctagatgtgagcgtagaactaggagcgcatgggatggggatggccggaagggagtagatcctgggcgggcagtagcaatgggccagccatatagagagctaggagacccactattttgtggataactaagggcagatgaaatccagagagctgtgctcctagtgatggaatctgagccaggatgagaagggagattgaatctgagccaggacgagagggagatagaatctgacgagggaggagaggggtcttctatatggcaaaaagggtgggctggatgaaggaccagtagactagcaacggttttggtgaatgagagatcgaaggtaacggttgactggataaggataatgttcacatatcgggtagttcgggtacctaatacagtagaccaaaagacctaacaatgaactgatgacaacatcttggtcttggtttcttttgcccacctatacccaatgctcccacgcgtgccctcatctctcataaccaaatgtggcaattttcggtctcagtttattttgtccacccattctcagtgttctaatgtgcctagttctcttacacaaaatatggtaaatttccatgtgccacccagtcagcctgtttataagatatctaccaacataaccaaccatatccttacatccacgttatccactcatgtttcttcagatctagaggtcgaataggggaaacagcagtggcgatgggatatgttctccagaacaaatcaggatgccatgccaccggcccaaacccgcccacccagtgctagggggtggctattcagtctagaccaagatttcggtccaggtaatctcgtctttttaaaatgacaaccgagccttgcacaagatatttagcaagcgacaaactaggtaaacgatatttcattctcggtctttggtcacaatgaagtgaccacgttggatggcgagcatggcacctagagcgcatgggatggggatggctggataggagaggtgctaggtggggagttctctatgggacactcttaggttgtgttcttcgcccttctttctcaaatcatctctctcgttttccatgcacacgcttttaaaattgctaaacagtgtgttttttttcaaaaaagtttatataggaaagtttatttaaaaaaaatcatattaatctatttttcattattttaggttaatacttaattaatctcactctaatcgtttgctttgttttccgtatcaggaggcgaacacagccgactgagttcttttccaagctttcccagctcatctcactcttttttcgcgcgcacgttttttaaactactaaatggtgtattttttttaaaaaaatattagaatgtttctttaaaaatcatattaatccatttttttaaaaaaaatagctactccctccgtcctagaatataagaagttttagggttggatacggttattaagaaagtaggtagaagtgagtggtggagggttgtgattggatgaatagtggaggtaggtgggaaaagtgaatggtggagggttgtgattggttggaaagagaatttggtggagaagttattatattttaggacaaatcctaatggctaaaatttgttactccttccattccaaattaatctacatatagtttttttaggttattcttaaatgatctacatatttgtgttcattcattaagtctattcgttatttgtgcattggagtaaatggacattgatgcatacatccatgcacacaagtatttataacccacatgcaatattttgatttgctattggctaggaaatagtggggatggtgcatgcatcaattctgttgctagagtaaatataatataagagagttattagattttcttggtcttgttgtacctatataaaatatgtagatcaatttggaatagagggagtatattttgggacagagagagtaatactgaattaatcatatgctattcgaccgctccgttttacgtgcgtatgagatttgttcccaactaccaggaacgaacaagcttcacatgaattttttatacgatctacaatcttgataatacaattggctataatcagctgccgcattgtgttggttagcttgagagcatccatagaatatcaaagttgtgttaataggagatttgctccggtccaacaaaaaaatatcttgagctaccggtaactcacgataccaaatcgttggatctaacaacgtccatcctgcccagctaaatcctcgatcggaaacaatttagtaccgtgaggtaccggtacctcgaaatatttttttgctggaccagagcaaatctcaaaatagttactccctccgtttctaaatatttgacgccgttaacttttttttatatgtttgacagttcattttattcaaaaaaattcaagtaattattaattttttttcatatcatttgattaattgttaaatatacttataggtatacatatagttttacatatttcataaaagtttttaaataagacgaacagtcaaacatatgttaaaaagtcaacggtgtcaaatatttagaaacggatggagtaataaagttgggggctactataccacatcatcccatccgaacgtgatgatacctggtatcacaatctttagtttggaataacaatggcaaaatcacaaagctgaaaaatgcaagggtagcaaaatcacaatactaatggggacaaaaacgtaatttgtcccatcatctgttttcaaaacattggtccaaaccaatgtgcatatcattaggtaccccacttcgtaaatcgatcttgtactcgtactacgaatgaagtacaagcacagtacttcttgcagtagtttcttgccggtctccttccccgacatggcattgggattttctcgtgaaacgggacggacgagagttaattaactactccagttgcccttgaccgtagcactacatagatacgactcgtagctagtaagatatactcctatatcagtaaaaatcgaatcattttaattaactactagtaagttgaccagatcatcatctatttcgagttttgttttcacgtgacctgataataacaatgtgggtacaagctgatcaagtcgtctgtcaggacgatctgttattaatgatgttcagaaggagatcgatctggttccttgtgccactttggggagtgatcaccgaaatctcatatcgttaattatgacattttcccatgtattattatccaattccttaagaatagatctcgtccaactgttcacaatcaattttgttgagaaaaaacttagtttgatgtactaaattcgatcatatatacttatatatattctcgaaatatgttccctcagtattatgattttcgttgagttttgcagatatatcaaaatagttattcttgaaagaagatgcctgatatgaccaaaaagaaaattgcagggagtacgttgacatagattagttagttagtttttcttaagcacgaatggattcttttcgattgtgggatttgactgattcaacagcaaagctagcaaaatattagtggcatatcctaatgtctttctcgatatgcatgagaaacgacggctcaagctattgtattaggaaccaattgtaaattataatactcctacggtttttaatacatgatgacgatattgatttttttatgtttaactattcatcttactaaaaatatgtgtaattagcatttgttttttctctgctactctcaataacatttatttaattaacatttattttatcattagatatacttatgcatgatttatatttttaaattttaaaaaataataagatgatatcttaaaaattaatggcgttataaattaaaatcagaggatgtagtaattttttacctgattggtacgaagttgtcggatcctctctagattggaggggcgatctacgatccgtggacaagcagttcagaagattgaaagttcgtctattttaataccataaaaatgtacgagggaggtgaactaaattgagtctcatgggcaagtatatattgtacaaaagattacaagacttgtgtttaaggaatcttagagaagtaagatgaaaactatatctatatattaccataacaacttgaatcctccctgtaatccttcctattcctatccctatactacctatactcttaacaatgattatatgattccctcccttccatttgtagtgctggggtcttttaaaaattaacctccatcaacctcttcattgttttttttcatagaagaaccttcttctctaataatgaaagctgtccatttgtgtcaacgctcatggctttgttaaatgttaataaactttggtcgactgtacttcagctgtcccggccatgcatcagagctcatgaccaaacagccatgccgcaaatgcagatctcccattacagacgacgggttccaatggcgctcactaccaaataaaatcgattccccacattattatctttatctatatactgcaaatgccttccttttctagtgtgatttgcttccactcgtggtattcaaaagcctagttttgatgctagacttctcccaggtatggagtcaacggtattgagaaacccgaacgattaatagtgtttttcggtagtagaccaatttttttttacgttgatggttatatcctgagaggctgccggacctgcccggagatggctctggcactgccttctccatccaagaactaaaatcgtcagtttttttttttgccaataatatattatggtcatgcattgtaacaaaaacatcatatatttgattttttcccccaaaaaatctcagttgtcacgtgtttaggctagtggatcaaaatccaaccatcgctggtcctttttcttctactccaattgaagagcaaattaaggcctggcaaccgagctgtcatcctccccttctagcgatgacggtggtgacaagcccgtcaagttaggatgttcacgctgttggaattgtgtgtgaacaaaagaccccatgtgaagaataattcttagaaaattctcaaaagacccacaatatga

SEQ ID NO: 69020 - DNA, 1695 bp, Oryza sativa
cgttccaggcttcatcgcaaccatagcaaggaagtcattgtatgaagaaaggcagacgtgcggcatgctaaactgacgcgcggtggacaagagtgaccggtctgtgactggtctgacgccggtcacgtcataggcagacaaccgtgctcccacgttgcatctgcttccggcggagtggaggtaggtatgacccatcccatcggagggtcattcggacagcggccattgcaaatctccacccattaatgaaggaatgacagggttatcccctgtgtcaggcgagtgacggcactgggcctcactcaaggacaagctgtgatttagcttccaggcgaaggtgcgagccaagtttgggtcaagatagggtgagtccccacccaaaagaagagtaggtagaagtggtgcatgtggtatccccttgagatataaaaggaggaccttgcccaccgaagtaaaggacggagagaaaaaaaagagaaaggggggacgactcggagaatacctgagctcatagaggagagaaagaggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaagggggacctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgtccccctctcgccgaagtcttgggcgggaggaggcgctcgaggaggtcgaaagatccgcgacttcgccgcccgcgggcgatggagaaggacggcgagacggggagcgtcgcctcctcgtctacggcgatggcagcacgccccagggcgcgctccaggctgcgggcgcgctcctgcgtcacccgcccgtcgtccccgatccagagactccagcccgacgttggctggatgacgtggccgacttggtcatgacggcgcagcagcgcctaggcgccggcgggcggtcctccgccaccaaggcctctggcgctgctaccgccggctccgtgtcgtcgaggcggagggcgcggcgagcggcggccgttacccgccgttcgtccgccattccctcgtcaacgcctccgacccaagaagatgtgcgtggggggccggatgcccgccttagtatcgagcgccggcgcaatggtcgtcgtgctgcccacgcaacggagggcgcttcctcgtccggagcgccacttcggttcgggcacaggggccagccccccgtgtccccggttggcggtgccggctgtcgagcctttgtggcgagccttcggaacgtccgttggcccccaaggttcggcccccatcaccgaaaaatacgacggaagcgtcaaccccgccgagtttctccagatctacatgactgggatcgaggccgccgggggtgacgacagggtcatggcgaatttcttt

SEQ ID NO: 69021 - DNA, 7928 bp, Oryza sativa
ggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacagccgggcgggaggaggacgatgacccgcctgacgcgcgggccccacgcggccggacgcgcggtcagcgcacgctcggtgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccgcgggccgaggggagagaaggaggactttgggccagacttggcctaaagggggggagagagattatttttaggtttttctttttaataaactctaataattgtttttgttgcttaataattatttccggtgctctgaaaattcaagtaaaatttgagggctccttttagaccaaggagaatttaacaaaaattccccgggccacattcgaatttttcttgtacgcattttagtgtttgccaatttcttttcgaattttaattaattctattattccttttagaaaataatttttattttgggatgaatttatcaggacgtgacagcacggcaccctccgggcgcctgctgccggcacgcaccgccccgccccctcggggaggagatggggaaggggtaccctcctgcttcctcttcccccgggcgtcggcaaggcggctgccccccgggcccccgtcgcggggcccagaagcacgaccccctcccggggtagattgttcccccctacggctcccgcccgcgccatcgtggcctcgaggagcccgctcccccgacgccccgaccgcctgcatgtggtcaggatgttggcgcgctctgaatcgcagcagagggggaggacaccttgggggatgagggatgcctccacggagctgagattcagcacccgttggaccaccatcttgaagtcttcagggacccagtcccacttgcgcccctgatgggtcctcatgtagtcctcgggcccggtgtactgccaggcgccccgggcgcgccgctggagcggcgcgatccggcgacgaaggtagtcgccgaacaccatggcccccgtgagtccctgggatcgcagacccgccaggcggtcaaggacggcgtcgtagccgtctcccagatctaccgccgctcgccagctggaggcctgcgccgggggctggctcggaagtcggaggcgcgcttcgtcggcgaagggggtgtagaaccaatcgcttttccagtcgtcccactttttgcggaggacgcagggaatgtagcggttcagcacctgcccccgcggctggaagtagcagccaccgactaccgacggcggcgacaccggctgtacggtgaagaaccaccggaacagccggagagatgggcgcaccccgatgaacatctcgcacaggtgcgcgaagatggccaacatcattaccgcgttgggggtgaggtgcgccatctggagatcataaaactccagaatatccatgaaaaaagaagagaatggcgggaccagccctgccattgcgaaagagaggaagaagacggaccgccccaggtagtgtggcgtcgggcgtccctcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgatgccggcggaggaggagcttgagagcgagtgagtgcggcaagggtagggcacaggaaacgaagagttagagctcaagtggagaaggcaaggggaagaatggcgagaggaaggaaacgaatctcttcctcggcgtctttatacccttgccaacgctattcccggctcctcgtttcccgcgcccactacctcgccccctcgtttctcgcgcccacgcctccactaacccaactcgctcgtttgcggcgcacgaggcagatgtgcggccgtagcagttgagatgggacagatcgtgcgcgcattaaccacgctcgccaaacgcgaaaagcgccatcatcacgtctccaggcgaaacgaaccggctcgtcccgattcgcgcgctgctcgagtgatgtagcggtcttaaagaggccgctcattattgtcggtcggttttcccttgccgatgcgcgcgacttgcgaccgatgggttcctacccgcctgtagggaccggccccacctgtcaccgggcctaaggagtggcgtcacgcccgagcgcttcccacgaaggggcaatcgccctggcgtaacgccgggggctactgtcggtgacatggggccgagggtatcgtgactagaggcttgggtagccgcggtcacccacgtggcctgaccccctcgggggggtcgggcccgagggtgatgtggcctcccctccctctgtctccccgaggggtcgggcagctcccgtttcggccccgagggctggggcgccccgaccccctgtagttttggcgccacgtgtgtgggttaggtaaacacagcggcgcccacctaaccggatttatagcgggttggacgagcgcgccacgccgcatttaaaggggggcctgcgtggtctcccggtgaggggccccacgctccgtcacttcggtagcctcttttctggcatcctcaagtagaagtgccttgttgatcatatgctgaaaagtggggaagtcatgagcaagcaactggagtctcattccaactgcaattcccttcaagaacttcctgatcttcttcttgtctgtgtccacttcctcaggggcgtaccgagccaacttgttgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattttcccaccaatctgcagcaggtcctcttagctggtgagaggcgtagagtgtcttctcaacaggagtacactgtactaagttaagttttctatcaacatccttcagccaatcgtcagcctcgacgggctcgacggtctgagagaactctggcggacgagacctcagaaagtttgtcagcttggatctattgttgctcatgtgagggtggccatttccatgcgcattatgctgataaccagctacggctgcggctaatccttgcaagatttgtgtctgaactgccattaagtgctgcatgttattttccacatgaggtggggaagggaggcgttcttctccagaattgtgactggcggtgtggtgagagcggtgggactgttccatctctgcattacgggaagctgtgtgatgcgagcggttgctgcggcggggttgctcaacttctgcgttgcgggaagcagttcggtgcgaacggttgctgtggtgagactgctcattagctgactcatgatttgcttctgtcacaactctaccttcttcaaaaccgaagcgggctggcgcacgggctgcacggcgggggcggctagccatctaaactcccagaagagggcgaggtaagaatcaggtaagcacttaggagggcaaggagtaaagtaaatagcaactcagatagcacacactaggcataaactgaatttttcaaatcataaaatcacctagtacaacaggtgtggacaagtcacagagctacgccgagcttgactgtgcgcacaccacctaggagaaccagactaccaaacaacacccacaacaaacacacgcacgcactacctcgccatgactccgaaagagttggcggcggaacaaaagggcctaacacacggacagctgctgaagactgcctcctctactcctcgtcggcctggctgcctcctgtagtcggctcctcagacgaagaaacgtcaatcggctgacgcgaagggaccggcggaacctgtcgagggccgacagcagcacgggccgctggcggtgggggagctgggtaatcgaatcggaacacggtggaagaaccaacaacacgcttccgcgcggtgtggataaagcgtgggccacggtgggaggaagcaactggggtgtgtccgggggtgtaggaggggctaactgggtgtgggtagggggagtacactggtaagtacggcgcacgcgagctgggggagcgcgggccactgggagtgcgggcagagccgcgggagctgtgggaggacaggtggctggcgtggcagaggcggcctgagtcccaggagacagtgtcaactgaggtgacaccctcctcggccagacgggcctccagagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccggaaggctgagcccccgagacggtggctgtagtcgtgggccaagcgacgaagcgcagtccaggagaggtcctggtacgcgatctggagagtgggcctggccacagtgaagtggtgtgggcgaaggccaactccgtgtatacctccacgagggtaaaggtacacagagagctcacagtgagggggaacacggtccacggagtaccccgtgtactcggggcacgagaagccaaggaagcgggcgaggtcacgaagctgagcgacgtggtgaccctcaccaaaaccgtgggaactgaagcaaactattgaaagagggagccatctacaattttgaaagagggagaaaagatcagtaaccattttagaaacaaactattgaaaataaggaaaccaaaagaagccttagcttttcgcaagtagttttgaacttagtatccttagggtcgtcctaaatgtcgggtttcgccctagggccaagcctgtgctcttataccatctcttgtcacgccccgaactagtaccgaccggaactagcccgtgacgctctaaattaacctgttaatcgataccagtcccaggaaacggtgctggtatcacaggaagacggattatcacagcaacagaggtctctttattatagagtagaggtacagtcatgttgggctgtggacagatcccgagctcacaactgcattacaaaagggaagcggaagccaagacatggaccaaacaacacaggcgcgacttgggaactaggccgaaaccctaaaactcatcgtagccggcttgctcctggaagaactcctcatcagcaggatccgctttatcttcttcagcaactgggggggattatttatatagagcaagggtgagtacgggagtactcagcaagccatgggaaataagtgtttaatgcaggcttcaaggaaaggctgttgtttttgcaattgattttatttgaactcttttctaaaaacgactaagtgagtgcttctcaaacgacacggatgagacagtgcatctcgtccggtcggagtatgtgcaatgcatcagtctttagaattgaaacaaggttggcacccggccaacaacttttcaacggccacccgggccaacaacttttcaaacggccacccgggcctagctgatcccatcagctacagatttttcaaacatcgaaccccttttcacaacagcaatttcacaagcagtagtcaaacaaaactacggtagaaatcacctcacatccgcccatgaccgtgggcacgactgttcgaacagtttgttaacctctgcagagggggtacactttaccctcacgacattactaacccggatcaccagcccgtggggatcagccacgtcgggagacctccaagctttcatgacaaggcatttcgaaagccgacacaggtttaccatatgccgacgagaggggtcccagaccaacaacaggtttggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatcaaattccaaggaaacggtccttaagtgcaagagcgggaaactgtacacccggtacattccccggtccgcggttttggaaattcatttagttcgcaagcaccgacccaggtgtcgggttttccaagtcttttgtaaaacccaagttttacccaagatgtttatcatattttaagtttgaaggcgaccgtcgatactcgcacagagtgcacgaataccgaggcgcaactgggtggttacaagggaacatggtgtaacgattaacaaaggaaggatcaaatgcaacaagttaggtatgcccactaatctgcctcgcaggcggggcaaacatattacgtgcaatcctatcaatgcatgatattttgcaagcaatataattaagttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaagaataaagccctattaatgacctctaagcatgccattagatagatctcgagatttgaggaattttggaagttgaacggagtcaaacggatttacggttgggaagatattgaatttctaagattattggatttttggtctaaaggaaaaaggatttaattaaatcctttttggaaaagaaaagaaaagaaaagaaaagagggagggaatatagacttttcctcgggcggctagggcgcggcccgagagaaacggagcggtccggctgagctaaatgggccggccggcctaaggcggcccaagcgcgcgcgcgggaggggaggagagagagggccggtggaccgggctcaccacgcgtggtcccgggtgggacccgcttgtcagcggctcggctcaccgtgcggagggagcacgcggcgcggcgctagggtgggggagggacgcggtgcacgcgcgcggttcgcggtggatgcggatgcggcgggcccacgcgcagcctcacggctcgcggtggaacgcgcgcacggggaggggctgaccggggtcggctcgacccggccttggccgagctggcgctgacgtggtgcctacgtggcgcctacgtggctgccacgcgggccggcgggaggtagacgacgacgccggccggaacggacggcggacgacagcggcgagcgacggagcaaaccacggcgatacaggcgagagcgagcacaccaggtggttgcacaggacaaggggagacgagccaacggctcggattcgccggagggagtgcgtcggcggcggattgcggcggtggcaaccggcggcgagggaagggggaaacggcgacgaggtcacgaggggccaattcccggcggcgagagcatctacgtggctataggaatccattgctagcgtcggattgggcggagctatgccgagcaaggccggcgacgagcggtgcttccgagctcgggcggcgacggcggcgagcacacggcgagcgacggcaacggccagggcggcgccggctagctacggggaggctactcgtgctactacccgagtctaaggggaggagatggagcgaggagggagaacggggagatgctcta

SEQ ID NO: 69022 - DNA, 9949 bp, Oryza sativa
atcccgtcagaagtgtgaggatctggcgtagtgtattaattaggctcaatagattcgtctcgcgaattaatccagggttatggaatatgttttgtcattagtccgcgtttaatacttgtcattagtatcacaacatttgatgtgacggggactaaaatttaaatccctggatccaaacaggtagtattgggcctagagtggttcatgacgaaaaaaaatggaaggatggcccttacatattgctactagctccgtccagaaaacatatgtacataaacagttcaaatgaagtagcccgagcctggagataaagcatattttaaggtctgttcggtaaaactctaactcttaaatttagatttaggagttgggtttggaatggagttgtggggcagactaaactcaactctatccctctagtttattttgtgagaacgctccacacagatccgctcctattttaggtggagctgaaactgtttggctagtctccaactctaggagaggtagagctggagtttagacggagatattagtactataaggacgtataagttgtagtttagttcttggagaaattcacatctattcaaggtattttatttcatggaatagaggaatttcagtgactatgaattaatttttgtgaaattttccaaagagaatcaccgatctatttacccaattatatggcttttataaacagaagaaatacgatgtactggcacaaaggataacccttttttagtggaaggataaccggaattttgggtaagatttttatactactgctctggatggtgtgcaagtatatatattggcacgtgacagtgatagggcgccctcagtttcaaattacggcatgtactttactctaacatctaaaatttgtgacaaaaaacttgtagtactactacataatggctaatcggtgccggttttcctaaccgccaccacggaggtagcactgatgacatgtttaaggatagctagtgtattttactctaatataaaacaaagataaaacaaagagaataataatttatcgtttactattacaaaccgtgcggaaaaaaaatgaggatgcacattggaataaatacaataaggaccattctacccctaagataaaattgatatttttttggcacaaacccatggcacattaaatatttctactttttatcaatgcgaaaaaattatcaaatcatgccatgagtacacatttaatttcttccatagtggtaaaattaatggcatagatggaagaaaacattaattcaaagttagcatggcatttgagaaatctaaacataaaaagaattatccctaaaacaactcataattgttttgtaacacatagtaatacaaattgacaagcaaaattgaatcggggtgagaaataatgaatatttactttctaagcttcaatcttcaaaaaaaaaaaggagcaaaactgccccctcctcgagctgatcgggcaagaacgagaggcgccgctctattcttgctcgatcagatcaagtgggatggttgcttatatgtgctcggctaataggtgccggttgtggacaaaacaaagacataggtaccggttttttgtgtgggctccatcaactcctagttatatgaaaggtgccggttttgaatgagaaccagcacatatttttttccacaaagatgccggttctagggttggctccgcgccaactactccgttgggataggtatataatctcttacaggggtaattaaaaggtgtcggtttttaaacaaatgataaaggtgctggttcttgcggtttgggcaggctaacggcgcgtgggcaggaaaggcactataggtgccagttttaccacttccggcacatatagtgccgacttatattagctactatgtagtagtgagtcagtggcgcaggattttgagactaggtatttacttggaatttgctaagtatattgtcctttatgtttggtgaaataggatttaatgctctaatcctattccaccaagtcatattaatctattttttaagtttttatatctagtacttaattaatcatttgttaatctatcactttgttttgcatatgaaggtgaggagttcccaacccctctaaaacaacacagtctaaaacgggtagagtttcacaatgagctgcagtttatgttgtgtatcctctaatctacttcggatgatgaaaaataatctagtacgatgaatttgataggtgtagattatgagagataatctagtacgatgaatttgatagacatagattatattttatcacattttagagagtgttattatgggacgaatgaaagaagatgtactactacacacgcgtacttacgtttcactccgacgagacggggggcaggagccaaagggttggatttcagggggagattcgtcccctgaaaatgggggcgtgtcacgcactgtgtcagcaacggcatcatgggaccatggaaaccacatccatcgaccgatgcagcagcgcgctgccatccatatgatccacgacgcagctgcctgttttctggttccatatgcattccgtgcgggctgtgtatctcatggaaggacggcacgatcgatctagggcaggtcgacgcagacgtcggcagtagaagagcctctggcagtctgcctctgcctctggccggcgaagtgacacatcgcgtcagttcaatcgtcgtctccgccccctgctcagcgcagcagcagcagctttctcgatgggtcgcagctctctctctctctctctgcctgcaatggatgactaccgagggatgcagtactccttttgtttgtcactcgtgcggtgtgcacaaaataaatttcttggccagctgccgcagtagagcaagttttactgtgaacaagttactgccgcaggtggtgtttggttcaatgactaaatcctatcaaatcggatgtttaaacattaattagaactattaaatgtaaattaataataaaactaattgtataaatgagagttaatttattagacaattttttttaaacctaattaatccataattagtatatgtttactatagcatcacataggctaatcatggaccgctcgtgatgctactgttggaattaatagatgggctaaggcccattcgaagattaattctttggaaaatcacaaaagcccaactcatgggatggcatgcatgtggagtttagtaccaccttacttattctaggagagggagacctccttaaaagggaggatgtcctcctagccacttgaagcatgtggggtggagagaagagggggaacacatgcttgcgcagatgcagtctccttttgcagttttgttttgctgcaggaaaattcggatttgttttgttgttggaaacattccgaaaaatccggtgcgtgaaaacggcgtggagtccggataagttacgcacgacttatccggatcggttacgcagagtgatgatcgtgcgagcgccctgatcaagcgacctatctctatataaaccgtgcctccgccttcacgcaacacacgcgaaatcaatctagggtttgcctcctcctctgtgttgcgctgtcgctcgtggactactccatcccgctcgccagcgtgcaccggcgatcggaagagcaggtctccggaacctctgccttcgacgtcctgcactgggagaaggcggcaataaggtttttgggaagcgcttcgcgcgactgctccctgttcgtccgcgacggctcgccttcctctccactcgcgtgctgcgcgccttcgtcgacgctcgcaaccgcgagtagttcttgctgagcaaccggtctttccgccacctcggtacttgttcgacatgttgcgcatatttgatctggtcatgttttactgtttagtttacatgtgtagatctaataatgcgttaatactagtatacatctgtaatgtcatgatttatttatggaatatattaaatcattatatgcctatattctcaacaatccaaaaaccttattataggcgctgtgattttactatggctggttttgccgatacactgaggccagataaattcaccggtgtgcactttaagagatggcagatcagggtcactctgtggctgacagctatgaaatgcttctgggtgagtactcgcaaacctgaaggaattcttactgctcctcagcagaagcaattcgaggaagccactactctctttgtgggatgcattcttagcgttcttggcgatcgtctggtcgaggtgtatatgcatatgaccgatgctaaggagttgtgggatgcactgaatactaaattcggtgctactgacgctagcaatgatctgtatatcatggagcagtttcatgactacaagatggctgaaaccgttctgtagtcgaacaggctcatgagatataaaccatggctaagaaactcgaactccttaagtgtgtcttacccgacaaatttgtggccgggtgcattattgcgaaactacctccatcatggagaagtttcggtactgcactcaaacacaagagataggaatactccgttgaggggttgatagcgtctctttatgttgaggagaaagctcgggaaaaagacgccgcgtctaagggcgatggtgggcagtccagtgccaatgttgtgcacaaggcctataacaagagcaagggaaaatacaaagctcaacagaccaccaacttcaagaaacagaagaagaacaacaacaatcctaatcaggatgagaggacttgctttgtgtgtgggcaacctggtcatctggctaagaagtgtccacagcgcaaggggatgaaggcacctgcagggcagacttctaagtctgctaatgtgaccattagcaacactggagatggaagcgggtatggtaatttacctactgttttttcagttaatcagtctactaattggtgggttgatactggggccaatgtacatgtttgtgctgacatctcattgttttcttcttatcaggtcgcatggggttccaccgtcctaatggggaatgggtcacatgcttctgttcatggtgttggcacggtagatctgaagtttactttgggaaagatcatgtaggtgaagaacgtgcagcatgtcccttctatcgacaggaatcttgttagtggctcctgtctgactagagacggatttaagttggtttttgagtctaataaagtagtcgtgtctaaacatggatattttattggtaaagattatgagtgcggaggcctgttccgcttttccctttctgatttctgcaataagcctgtgaaccatatttgtggcagtgtggatgatgaggctaatgtttggcactcacgtttatgtcatattaattttggcttgatgtctcggctttccagcatgcgtttaattcctaagttttccattgtcaaatgttctaagtgccatagttgtgtgcaaccgaagcaacctcgcaagcctcacaaggctgccgaggagagaaacttggcacaactagaactcctacattcagatctttgtgaaatgaatggggtattgacgaagggtggaaaacgatatttcatgacgttgattgatgatgctactagattttgctatgtgtacttgttgaaaacgaaagacgaggctctagactattttaaaatttataaggcagaagatgaaaatcaacttgacagaaagataaaaagacttaggtctgatcgtggtggagagttcttctcaaacgagtttgacttattctgtgaggaacatggcatcatacatgagaggacgcctccctattctcccgaatctaatgggattgctgaaaagaagaaccgcacactgactgacttggtgaatgccatgttggacaccgcgggactacctaaggcatggtggggggaggcattgttgatctcgaatcatgtgttaaacagagttcctaacagaaataaggacaaaacaccatatgagatatggattgggagaaaaccatcactttcttatttgcgcacatgggggtgcttggcgaaagtcaatgtaccaataacgaagaagcgtaaacttggacctaagactgtggaccgtgtctttctgggatatgctcatcacagcattgcctatagatttttaatagttaaatccgaggtacctgacatgcatattggtacaattatggagtctcgtgatgctacctactttgaaagctttttcccaatgaaggatacatatagtggttcgagccaaccctctgaaataattcccagttcaatcacaccaccagaacaaactgaacatttatatgaacatgtcactaaggaggatgtcagtgaagctcctcgaaggagtaagagacaaaggacggctaagtcctttggtgatgattttactgtgtacctcgtggatgacactcctaagtcaatttcagaagcatatgcatctcctgatgcagactactggaaggaggttgtccgtagtgaaatggattccattatcgctaacaggacttgggaggtgacagagcgaccctatgggtgtaaacctgtggagtgcaagtgggtgttcaagaagaagtttaggcctgacggtactattgaaaagtacaaggctcagcttgttgctaagggatatactcagaaagaaggcgaagatttctttgacacttactcacctattgctagattgaccacaattcgtgtgctactttccctagcagcctcaaatggtcttctcgttcatcaaatggacgttaagacaacgtttcttaatagagagttggatgaggagatctatatggatcaacctgatgggtttgtagttgaaggtcaagaaggcaaagtgtgcaaattgttgaagtctttgtatggtctgaaacaagcttctaagcaatggcatgagaaatttgacaaaacattgacatctgcaggctttgcagtaaatgaggcagataaatgtgtgcactatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcttaaacattaagctaattaaaggtgagaatgggattacacttttgcagtcccattatatggagaagatcttgaatagctttggctacattgatagtaaggcttctccaacaccttatgatactagcttgttgcttcgcaagaacaagagaattgctaggaataaactggaatactcccaaatcattggctcgctgatttacctggctagtgcaactaggcctgatatctcctttgctgtcagcatggtgagccggtttacctctaatccgggagatgatcactggcgtgcgcttgagcgagtaatgcgctatctgaaaggtactatggaattagggcttcactattctgggtatcctgcggtactggagggatatagtgattctaactggatctctgatgtggatgagatcaaagccactagtggatatgtcttcacactgggtggtggtgctgtttcgtggaggtcttgcaaacagactattttgacgaggtcaaccatggaagcagaactgacggcactggatactgctactattgaggcagaatggctgcgtgatctattaatggatctacctattgttgaaaaaccggtgccggctatccttatgaactgtgacaatcaaacggtaattgtcaaagtggatagttctaaggataatatgaaatcgtctagacatgtgaaaaaacgattgaagtctgtcaggaaattgagaaactccggagttataacgttggattacatccaaacagctagaaacctggcagatcccttcacgaagggactatcacgaaatgtgatagataatgcatcgaaggagatgggtttgagtcccatgtgagttatactacggtggtaacccagtctatatgatcggagatcccgtgaattagaacctgggaagaacaaaccattagtaaactagaggagagtaccaatctataccctctctaagtgaagatgcatgtactctcgtgagctgcaaggcaggttggctatgccttaatgagttctgttggttttaattagcaaagatgctgtcctgcagagcattcttgaaagaactcacctttgtaagcttgactgttggtcacaatctatgaagattttgggtgaatcttctaggaagcttactaaagacctaggagtatgacttatacgctccacccgaggggtagtgtacagacggtctagtaccagataagactctgagtgaaacttgttggcacaagacttgcaattcaaggcgtagtccattgttcaagttgtgagtaagtgtagcttggagttctaggtggatgttcaaccttaatcggtctccatcgaaccgctggtatataaacagtacattgaaaaaggcaaatcacagtgggaattttgagatttggtgggggattgttggaattaatagatgggctaaggcccattcgaagattaattctttggaaaatcacaaaagcccaccccataggatggcatgcatgtggagtttagtaccaccttgcttattttaggagagggggacctccttaaaagggagtatgccctcctagctacttgaagcatgtgtggtggagagaagagggggaacactcgctcgcctcgcctggcagggcagggcaggcggcgcgcgtgcacgacatacgcgtcgaatggtccgaaaaattagctcctcacccttgcacagatgcagcctctttttgcagttttgttttgctgcaagaaaattcggatttgttttgttgttggaaacattccaaaaaatccggtgcgtgaaaacggcgtggagtccggataagttacgcgcgacttatccggctcggttacgcagagtggagatcgtgcaggcgccctgatcacggtgtggagtccggataagttacgcgcgacttatctggctcggttacgcagagtggagatcgtgcgggcgccctgatcaagcgacttatctctataaaaaccgtgccgccgccttcacgcaacacacgtgaaatcaatctagggtttgcctcctcctctgtgttgcgccgtcgctcgtggactactccatcccgctcgccagcgtgcaccggcgatcgggagagcaggtctccggaatctctgccttcgacgtcctacagcgggagaaggcggcaataaggtttttgggaagcgcttcgcgcgactgctccctattcgtccgcgacggttcgccttccactccgctcgcatgctgcgcgccttcgtcgacgctcacaaccgcggtagttcctgccgagcaaccagcctttccgccacctcggtacgtgttcgacatgttacgcatatttgatctgttcatgttttactgcttagtttgtgtagatctaatgatgcgttaatactagtatacatctgtaatgtcatgatttatttatggaatatattaaatcattatatgcctatattctcaacagctatgacaacgagccgcgactccgacgatgatagcctcggtgggatccccatccgtactcctccttcgtgatgctgacacccacatcatgtggtcttatgcaccacacacaacgtctgctcctgcatcaccgacgcattccatggacgaatttcgaactcgacgtcaagatgggggaaggattgatttgttttgaagccaaaacttgccataccaaaatattgacattttgagcagtatttttggcaatgtttggtttaataccaatactcgccaaaaccacatgaatattaccaaaatattagcattggcaaaaacttgcccataatttagcatttccaatttttttttggcatggttgcaaaccaaataagccattcttttttttgtgcacgcgggggggggggggggggggggg

SEQ ID NO: 69023 - DNA, 709 bp, Oryza sativa
  unsure (1)..(709): unsure at all n locations
tagttctgaatcttaactcttgaacggtgatcatgtaccagtcctggttgctgtatattctgtaccactctagtggcaatatattttgcatgttatttctttgattggtaaataagcaaatcctgttcttcccatgttcaggcatagctaacttcccgttcactatatccagcattacatgtctgttttctgcagcatgacctgcatcgaagatcaagagacatttgtttaacaaaataatgatcaggtctcaagatacttgtgataaggagctagcaatttactgcctaacctttttttcctattgaattcattataatcatattngtggctagcaacttcactctcacttatctgaaactgatttctgacaatgctagttaaggctgtgggcatatcttgctctgtgagtttcacgcatcatcaattgttctattgataacaaattcttcaggtggaggcagaaaatcctgttgaattggttcttgttatgacagttgaacctggctttggtggtcagaagtttatgccagaaatgatggaaaaggtattattactgcatcaagtgccatttagtattcctgattgtttatagtttatactgtatttttgtgtatctatgttttacaactattctgatcattttgaaacatgggcgttaggtgcgtgccctgagaaagaagtacccatcccttgacatcgaggtaca

SEQ ID NO: 69024 - DNA, 2950 bp, Oryza sativa
ctctcccaccagcatggatagaggaggacagaataggaaaggtgcaagccacgtacgaaggggatatggcagttttggacctggataacagcttttaacaagatctgaagcttggatctatattttgtaagtttgggagagaggcggggggtggggggaggggggtggggacgataagtttagggaccgcttgtgcacttcactcaaagatatgaataacaaaatttgtctactctatgaatttgatgtctgatgaaaagagttatatacaggggttcgaaagaacgcgtaccattagtcaaacgaaatgctttgtcctgacatcatactaacgtcaacttgtaacctagttaatactacacatgatatccagatgtataaggttctgataaataagataccacgctaaggtcaacacaataccttagatattagcactaggaaaaagtatgaattaccctccgaactatcgcggttgaccgaattactcccctgaactacaaagccagacattactcaccctggactttcaataccggatgaattatccccttgacctaattcagagcggttttgtcctacgtggcgtacgcgtggcaatccagtcagcattttctttttaaaaaatagtgggacccacatgtcatacctacccttcccctcttcccctctctctctctcttcactcactctctctcacggagtcacggggcagcgtagggggcaggcgcgagaagcggctgggtggcgagcggcggcgcgaggcgaggcggctgcgcaaaacgaggaggcagtggcgctaggtggcgattcgttccccctccaccgtgcccacgaacccattccattccattctccatcccccacccatgtcacttccgcgctcctcggctttcatctctcttacttcccggtctccctctcctcggtcgctctctctctctctcccatgcatgtgctcgggcaggcggatgcggacgggcggtgggcagcggcgcgggggacgcgcggtgggcagagtcgcagggggacgggcggggagatgggcgcccgccggtacccgggcatcctccacgccacccgctgctgactgggggttccaccgtcgtcggcgcccacactggagctcctccccgccgctcgtgccctccagggactcctccatggatgccatccagtcgcgcccgctgctgtcgctcgccacccagtcgttgcttgcgctgccgcccacctcccgcccctgtaacaccccgtgagacacataagagagaatagagagagaggaagagggaataggaggtatggcaggtgggtcccacaattttttaaataagaaaatgctgactggtttgccacgcgtacactacgtaggataaacccgctctagattgagtccagggaggtaatttgtccggtattgaaagtttagggtgagcaatgtctggttttcgggttcagggggtaattcggtcgatcgtgattgttcatggggtattttgtacttatagtactattacccgagtcttacacgacacccataagtatcagagtctagtacctagctatcatgttgatgttaggcatataattaaacaattccattccaagtatatatatgttaactgtaatatttctgtatacttatgactacacaccataccatctgtacatatgcctgagtactacaaaacttctgcacatgacacgcgcacggtgatacactatcagtacggatacataagagtagacactaactgaaatacttagcatggcatttgtctattctttctaagtcacaactcaaatgttactacacgtagtacgctagcacgtctacagggtgcaagcaatcaccttatatactgctgcctgcgtcctcatcaaagctcgccattatcagctagcttagctcaaacacttgtagcttaactaaccatcaagaatccaagctcgatcaatggcggccaccatgcgtggtggcaacgtagcactcgcgatcatcttcctgtgcttcacctgtagcaacaatgtcttcctcctccgttcgtcgtcggcgtcgtcccccatcgacgacttcctccggtgcctctccgcaagattcccgcggagcaagtgttcacgcagagctcgagcgggttcatggcggagctcacctcgtccgtgcagaaccccagttcgtgacgaacgccacggtgcggcccgcctgcatcgtggcggcgtccgacgcgtcccacgtccaggccgccgtgcggtgcggccaccggagcggcgtccgcctccgcgtgcgcagcggcgggcacgactacgagggcctctcgtaccgcgccgtgcgcgccgagacgttcgccgtgctcgacctcgccgggctccgcgccgtgcgcgtccgcgccggcgacgctacggcgtgggtggactccggcgccacgctcggggagctctactacgccgtcgggacggccaaccccgggttcgcgttccccggcggggcctgctcgacggtcggcgtcggcggctacctcagcggcggcgggatcgggctcatgatgcgcaagttcgggatcggcgccgacaacgtgctcgacgccatgatcgtgaacgccgacggcgagctcctcgacaggggacgcatgggggaggacctcttctgggcgatccgcggcggcggcggcgagagcttcggggtggtggtgtcgtggcggctgaagctctcgatggtcccgcccacggtggcggtgttcaccatcgccaagaccgccggcgacggcggcgtcggcgacgccgccgccctgctcgccaagtgggagacactcatcctccagccgttcctcccggatctcaccatccgcgtcgtcctccagggccggacggcgctgttccagtgcctctacctcggcagcggcggctgcgcccgcctcgccgccaccatgcgcgcctacttcccggagctcgg

SEQ ID NO: 69025 - DNA, 5028 bp, Oryza sativa
atcacctcctcctcgcccgaatttcgccggaacaccgtcgcccgcgccggcttctccttcctcctcggcggcatctcctccggctgcccctttcgccatgcccgtgcgtcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcgcccgtgcaccggtcggccacacctccaccacctccggcatcgcagcggcaaggtcgtcctcggcatcgtttcccctccatccaaacccctccgcggtccatcagcgtcgtctccgatcgttctcgtcgtcgacgtcccatcggtcgcccggctcgtcgtctcgcggcgccgcctccgtcgtcggcatcgcagcggcgtggtccgcgccatcctcgcctccgtgcagccgctgccggcagccctcatcgcctcctcgccggccccggtcgtcgtcgtcgtcgtcgtcctctcgtcgttcccggtcgtcgtggcgttcgtccctccgtcaggccgttctcgtccgtctcgtccgcgtccgtcaagtgtgccgctgcagccccgtcatcgtcttcgtcctcggctccgcgtcgtcaagcctcgtgccggccgcgtctcgccttcgtccaaggatggctgccgaagccgtcccctcgccgttcgtctccgttgtgcccgtctgtctccgccgcgcccgttcgtcgttgtcgttcccacgcctcgtcgcgtggtggtaaggttccctctccctcgctgccccgtcctcgtcctttcggtgtcccccgtacccgttgtgcggttgtcgaccccggtacccgtgtaccggtgtcggtagtcgttcgcttgtacgtgtggtgaccgtgttagtgtgcccgctcggtagccgcgtggtttccacgtgtgcagcccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacctgttttatagttgcaaaacctaattacaataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttttaggcttgtagctttgcttgtgtgcttcgcgtagtcttcgtcgttccggaggttcccgaagcgtggttcgcggccgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttaagaccttattattgctattgttattattaccttgttcaccctaggaaaacaaaaccccaactagtgggtactctattcatggttccactagtatgaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggtcgtaggtggggttgggtcggtactcttgtttatggctaggatgggttgggaactatgtcacgtcttccgtccgtataccgtggtggtatgtggcacgtggttacacgtgaggaaaatgtgtcttgtgggtaaagatgtacacctctgatcagagtaaaacctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgttgtttactgcaaaacttaacccctattattatccccttgtacccccttgcattaatcatgcatctgccggtgtgacttgctgagtactgtggttgtactcatccttgctcaatctttcccccccttcagtaagagaagctttggagaagaagtcttaggtggagtcctggcttataccccagttgagcgcctgtgaagatggagccgtaggcccgctagtccgctgctgtttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacacgtgccgacatcgcagcccgagggggagcgagagaagaaacggctccgcaagatggggggaccgagccatgccgggggaacctcatctcgcccccgaggtggtcgtttagccgacctcctcgcaggttcgtccccgagcacaccgcggccgtattcattctcccatctcccaaggcgagtttccactcacccgcttctttttgtcttctggtttttcttctgcctcagcgagatcccgtcgcgccccccccccccccccccgccattccaagtccggccggtctgaggccgaggagacggcgaccgcggaggcccggaggcgggaagctgaccgacgagaagccgcggaccgcctccgggaagccgaggaagctgcccaggaggccgtccgggttcgccaggctgaggaagccgctcgggaggaggccagactccgccgggccgaggagtccgtccgggaggcggaggcggcgcacgcacgccaggcagcctgccaagcccccgactcgactccgcccgaggcgacgacgacttccgaggccacccacgacgaggccacgggcgcaccgctcgggcccgacccctcgggcaacgctcaggacgagccagcttcgggggacgcccccgagtccggcacgtcgatcggcgggccgagccgtgcggcatcctcactgaggcggctctcccctctgccttccgctgccccaccaagcgtggagcccctcctgcaggccttggccgccgcgaacaccacggtgttggacgggttaagtgcccagatggaggtcctgcaggcagagcgggcggagctcgacgcggcgtgggcgcgcgtcgaagaggggcggcgctcggtggaggccatggtggaggcgggccgcaaggcacaccgccggcacacctcagagctcgaggcccgtcgtagggacctggcggaggtcgccagggaggtggaggaggagcgggagactgccctcatcgccaccgccgtgttcaacgcggcgcgggacgacctctgcctccaatacgggagccgggcggcggagctagagaagaagctcgacgccgcccggggagtccttgatgctgccgttgcccgggaacggcgggcggcggagatcgaggcggcgtcccggcagcgcgaagaggcccttgaggctcgcgccacggtgctggaggagcgcgcccgcgcgaaggagagggacctggcggaccgcgaggccgccgtcgccatccgggaggcaacactggcggcgcacgaggccgcctgcgctgaagaggagtccgcactccgcctccgcgaggacgcgctcaccgagcgggaacgagctctcgaggaggccgaggccgcggcgcagcggctggcggacagcctgttcctccgcgaggcagcgcgggaggagcaggcgcgccgcaatctggaaggcgcccgcgccgagagggccgcacaggatcagcgggccgctgagctcgaggcgcgggcgaaggagctggacgcgagagcgcatagcggcggggcggccgcgggcgacggcgacctagccgctcgcctcgcagccgccgaacacaccatcgccgagctgcagggcgcgctggactcgtccgccggggaggtcgaggccctccgcctggcgggcgaggtagggcccggcatgcttcgggacgccgtctcccatctagaccgcgccgggcggcaagcgggcctctgggcgggcggaccgcgaaatacgccgccaaccaggggggcctcgcccagcgcctctcagagatggccgggaccctccagcggctccccgaggagctcgaggagacgatcaagtcatcctcgagggaccttgcccgaggggcggtggagctcgtactggcaagctaccaggccaaggaccctgacttctccccgtgggcagcgctggaagagttccctccaggaaccgaggacagcgcacgcgcgcaggtccgggacgccgccgaccacatcgtccacaacttcgagggtacgtgtcacgtcctgataaattcatcccgaaataa

SEQ ID NO: 69026 - DNA, 8903 bp, Oryza sativa
aaccgggactaaaggtcatcaggacggttagtctcagttgattccatgtcaggccgtgtcagggccctaggatctttagtcccggttagtaacaccaaccgggactaaaaacctaaatttagtcctggttgatgttactaaccgggaataaaaatcaaaactcactatataatccatagtacttatcctcttttcctatccacacaacaaactcctccctctatctctttttttctctctaactccttacctctttccttcctctaagccttctctttcctttttttccttcacagtgaagaagaagcggtggagcggcacgaggaggaggccgggcggcggccggcgcggggggccacgcggcggcgggtggtagtgcggagggccgcgtggcggcggccggccggcacggaggggaggaggggaggcggcagtggccggctgacaattttttttttagattttgtgatttattgcatgatcctgtgatgtatttgatttgcatgtgctatgaatatgtgatgtatttgtgatgaattttttagaaattgtgatgtaatttttttaagagtttgtgatgtatttggagatggtctatttgaggatttggagatattctgtgatctgtgatgatttggatttgggatttcttgagtatgatttggagatggggtgaaatcaatattcaatgttaaaaacaatgaaaaagagaaaaaaagaaaaaagatctttagtcccggatggtaacatcaaccgggacaaaagatggctccatctttaatccaggttggtgttatcaacagggactaaagatcgatctttagtcccggatatttgaaccgggagtaaagatcgttatctttagtgatctttagtcccagattcgtagtcccggttggaaaaccgggtctataggggattaccaaccgggactacaaagcatttctccaccagtggcaccttcggtgggtcgaggaacaccagtgtgttgaggcagcataggaagactggcggtgacggtaggcagcaccacacgacgcagaggaggtcgtcgaggatgaagaaccatggccaatctaaggatgcttggtgccacctcgccacttgccgccgcccgccgcaactactgcctcccctcccgccgaacagggccggtcctgggtttttgggccccagggcaaaaacttatatggaggcccctatatatatatatatatacataaactaatatatatatttatatagtcatataaacccacaacatttaatattcgatgtgataaaattatctatatataacattttaaaacttcaaagagaaataaatagcagtagcgagcagagaaggtgatcgacggacgatcgacatgagcgtggctactggcgagccatgatttgccgacttgctgtttccgtttgcgagaagtcaagaagtcgctgagagcgcaggagcagtgagcgacgtgacgtgatcgaggcggcatgacacgagtggcgtgatgtgatcgaggcgaagcgaagggatgtagtcagatgaagatcgcttcggcttcgttgaaacaggcctgacgatggactaaaaattcattttctatattggactatttagctgtctaacttaatatagacccatggcacatgaactaaaattatacaatacgtagtatatatactatatgtgtatatagggggcccctagattttgggggcctcgggtagccgcacggcctgaccccccctagggctggccctgccgccggatctagtgaaggggaaggcgctgccgttgccgccaccgcctccctcccgtagacgcacaccgctaccaccgcctcccctcctgtcggaggggagggctctgccgctatgccgtcgatgccgagtcagggggtgagagaaccgagagagagagagaggagagtgcagtggaggagaaaggaggagaggataaggagagagattaggaggagaggataaggacaagaggccaccggttcggctcaactcgattttaggggtgcccttttttttgaaaaaaccaacacctatagtatattgtaggtgctagtttttcattaactgattcctataagaggagtaaagtacaccgtggatccttaaacttgtttgatcttctcatccctgtccctaatctctgaaactgcagatttggatccttaaacttgctaaatgtatcacacaaggtccaaatttgacacggctgcaaaaaggatccgacttgtcttccacgtgtacggccacatttcaggggctccttggccaggcgctctatacaatttgcagaaaaaccctcagacttaactaatatttattccattcaggccaccacgttatcgtctccaatcttctccactcaactgtttgctctgccaccgcgccgcgccgttgcctggcattctccgcaggtgtcggcactgttcctagccattctccacggtagccaccgaaccatcgtcgtcgtcggcaccgtttcctgccgttctcgaagatgccaccacaccagttgccgctgtccccgtcccccaaatatagcgtgggaaaataccccgctgtcagcacaattggcagaattggtgaatggcgattatgaaaaaacggacagatacttgattaataggcttttttttgtttatgatgtgcagccttagggatgtagcttggatggtgaagttaatggcagaagtagttctggtggttgcggcctaaactagttgagaagcagtgtgttgattctgtactttcaatgtttcagagttaatttgcgtgtagctttggattgcgaaaaattgtgcaatgatgatcatcagaatatgcagtatatagatatgtacaggtgttgttcatcagaatttatgcaatcacaacaattcagcaaactcttcatgttctgcagaatttagtcagatcatcgaatttatacagtggcaataatgttcatcagaatatgcagtacatagaaattatgttttgttgcatcagaattaccaacggcagaaccttgtcatgctaaaaaataaaggaacatctgcacatttccaaacgtcatacgatgggtttaaaatataatcagatcattgtccatgcattgccaaagcaaaatataatgagattgccaaatgttttgggggaaaaaaagcagagtaaacacaggttcattacaaaagggtgctttaactgatgcttgatggcatgaaaccgacctaatagcactgtttatacatgaaatcatctaataattaagcatcactagtttttctttgctgcagccttctttctagaagacttatttccatcaggcttctttgcaccaagagatgagccagcagccttctttgcaccaaagccacctttcttcccagtaccaccactagcagctgtagctcttccttccttggttgctgtggttagtggggctagtctagctgaaggttggttggacaagatatatgcactatcaggtaaaggttctgcctgcaaagctcttttactaggttgtgatgattctacagccatttgtgatagcattgtattggttggataaggctgaatacttggacatggctgcatcacatcctgtattaatagaacaagattatttgtgacgaacagaattaatatatataattgatgtttgtagaacctatattctgtacatacctgagtaacaacaggctctagatcagcttctgcttcatcatcaaccagtggcgtgatctttctctttggttgttgtttaggccttaatcctgtctttctcaattgacgccccttcttgttatggccaagttgttgacaatcggagcaatgcatctcaactccatgcttagacatttttggtccatttttgccctgaacttcttgtggctgctttctcctacatttctttggcctgccaactttcttatcataaactggaggttttacttcaagtccatctacttccactttgttttgtttgaacatggccaaatatggtagccataagcattcaggtaagcctctgttgtgtaacaagcagctaaaactgactcagcagggatcctttcattcctcaagcatgaaattgcatggcaacatggtattcctgtcagatcccatcttctgcagtcataatgcctagtttgaatgtccacaatgtaactaaaatgcttgtgttgcacataaaaaattcctttaccagctgggagtatgaaacaattgttggccatatctgcattctttgaaacttttttcctaatcttgggacatattggtccttgccacttctcctccatctccttctgcttattgtagtacctagtcattagccgccccttgatcctctccaacatacttaacacaggtaactctctagcttctaaaatgtacttgttaaatacttcacagttgttgttcaacaggatgtcacacttggggaagtcactaaagaaagctctaatccatgtattaggcgacatgttactcaaccaatcatatgcctcctggtttaaattcctcatttcttccatgttgacattccactcatctatacaactagacctagcacatgctcatagccggttcttcaaattctcacctttgaaatggacttgaaagttagaataaagatgcctaacacaaaatctatgttcagaatcagggaaaacctgttggactgctagtataaggccctacacaagtaaaatagcagaattaacagttgtcataagaatttacatgttaaattgaacaattcaaaagaatacaacttgcacttataccttctgcatgtctgtcattacagtccatggatatgtattgtcaatgccaagatctcaagaaaccacctccatgaagacaatgactccacctccaccacagccattgcaattggatatatgcagtcattaggatcaattccaacagcagttaatagttggccaccaaatttagtcttgatatgacatccatccaagcaaatcagtggtctacacccactaagaaaaccccttttacatgcatcaagggacatgtacagagtgttgaaacaaccatcattcaaattcaaataaaaggtactcccaggattggacctccttaactctgaaccataatcccatagttggttgtactgctcaacctcatcaccatatatagccctcaatgccaaccttctagctctagaaagtttgctcctagaaggtgtcaagttccactctctctatactgtccttgcaaagctgccaagagtcatcttctcatctgttctgaatgtatcaacatatatctctgcaagccactttcaagtgcatcttttaagaatccattccttttggcattcatgctctccaacataagaatccattccttttggcattcatgctctccaacataggtcttcaccatgaaagtttttgtccttctatcaaatgaagcatatagattccaaggacatccctctgcacaatgtgccctgatccttgtcctatcatttcttggcatcttgatctccactctttgtttcagactatattcagttattgcttttctcaatacctcaactgattggaataccatgccaactttgaaaattggattgctcgtgtcctatgacctaaacgatttgaacttcaatctcactagaccatcttcatcgccatcatagtctggaagttgtagttgttcctcatcaaaacctacatcatcagcagactgaacatccatggtttttgccttattttcactgattgttcccttcttcccttcttactcttctttttcactataccattaggtgatacatcatcatctacattatcctcaaataagtcatcatccccatcatctatttcatagtcactatccataaagtcactatcatcactatcactttcactatctctgtccccctcaaccaattctatggaattggctttgtttgaataaaactcaggaagcctttcaccctctttgttctcaacatctgttacctttcttgggctaagtaccttaggcaaaatctccaaagtgtcatcccagttattgttcccatatgtctccccatgatcaaagtacacaacaaaattcttcacagtattcacaaatgacttcattgcagcagtatctatctctcgtgtaatcaacctcagtctatctgcaagtctctttcctcgtagcaaccaataagtcttcacgctatcttcatagccaagcattgcaatgaattcacctatcgaaagcatattccaactttgggcctcacagtgatcaaaccaggtcaccttctcatctacgtaagaccgattctggccatgcccgagaaaaaaaccaccatgatgcacctcaagagtaaatgtatctgaatcagttcctacattgcacaatccatcaaccaaaaataagaaaacccgacaaaacctccactaaatttcaccaagcaaaaccctaaatttcactcaaccaaaaattgaacatttactaaaccaaaccacaaggacatcgatcaccaagtaccatgcaccaatcagtttacagattataggagaattaaaagagctcaccatagtagggcattggttccacttcttcgcgcaactgaagaaccatcgttggacttttttgtggatgcaatcaaatccacaagctagacatgcaggggatcaatcctctcatttgccggtttcaacatgaggaaaccgtcgccgatcagcaccggccactgccctagcaagccctggtcgctgccgcctctgtacgtgggatgaaaacatgaacagatggtatggtattgaaaggatacaatttggaggggtcttttgtaagttgtatagagcacatggggaacccatgcaaatgtggctgtacacatagaagacacgttggatctgctttgcagccgtgtcaaatttggaccttatgtgatacatttagcaagtttaaggatccaaatctgtagtttcagagattagggaccgggatgagaagatcaaacaagtttaaggacccacagtgtactttactcttcctataatatatttaaacgtttcggttttttaataaaatcgacatctatactatacatgtaggtttttctttagaactggctcttatagttgcttataggtgtcggtttttgtgtttttagcccacagagatggtaaatatgtactggttttagcacttctgacacctatagtgccgaccactatgtgcctttttgtagtagtgtacaaaatttcttgcctctatcacggtaaaaagtttacgtcctgttctctccatctccacctagtgattcagtcaactagtaatgtttctaccattatatatttttcatgatgttctctccatctccacctagttattcagtcaagtagtaatgtttgtaccatttaatattttcatggttgtcgtgatgttcaacggcgacggtggcctacgcccctcagcaccgcaggctccggcagcatggcggtgctcgccccacggcagcatggatccggcgatggggccgctggttgttggtgcgacgtggatcaggaggcacagcaaggatcgctagggtggaggtggggtcgccggctggaggtgcgacggcgtcgactgtttttcttgattgttgatgtttattgatgtttgattgtctcggatttgatctagatgtgttgtttttcttgggattattgattatagttatgtgttcatggatttgaggcatcattttgggatcatgtgcgcctcaaaggtgctggttctggaatcggtaattttgactagggtcatcagtgccgccttcttggttctagttggaaaatctggcacctatggcggtttcccaaccaacactaacgatgttttctgtagtagtggttactagcgagtgtgcgatggagaaggggtattctagcatccatatcattggtacagagttgccaaagaggctagattcgatgccttccagggtcatgtggctagatatggtagtacctggcttggcatgatcaagtttggtctctagggcattggtgacttggtgaattatgggtttcaagcaaagaggtagcgagctggagttgacataggttcctggctagggaagtcgacaaaagtggaggaggtaaggacgcatcattgttggagacaggccatggctagcatcggcaacccaaatctgggggtggtgatgaccatgaaaaaataggagcgatgaagccaacaactatatggaggagtgtccagagccgagtcttgtgggtgttgacatgcccgacgaggcggttggatcaagtggccaccaagtaagattgaaaagatcccacaaggagattctctggcagtgacacatggagagctcagagctatgttggtgcatcagaaccaatgccctccctattcacatcgctagatccagttggccaaagacacatagtgttatcgtgaacgaggtgggccctaggggtggtaacagatggaccagctagcgacacggcctgtacatatccgctccaaaggggtggtaaggaggaatggcacaatgtaggtgtctagtggtggtgactgaaggcctggccggcggcatggcttgtctcatgatgtgcttcggagaacatatcctatagccagcgctgcttcacctattcgatctatagatttgaataaacatgactggatgatgtggatgaatggagatggttggttacgttggtagataacacaaatgagcggattgatttagtttacaagaatttaccacatttgtgtagaagagttggtggacgcgtgtgagtgctgggtatgggtgggcaaaaaaaaaatcgagaccgaaaatttccacgtttggttaggaaagctggggtatgcatgggagcattgggtagggagtggcaaaagaaacccaaaccaga

SEQ ID NO: 69027 - DNA, 2800 bp, Oryza sativa
taacaatcttacaatagtaagtgattctgatactcttgcatgtctactattaatgtgttataattaaatctcttacttattacaatacggtaaaaaatcttcacaaattttagccatcttcacctccactcccaatggaagcttggtgcacaaagctataataattagttgatcataggtgttgagttgaagttgacattggtttctggatagggaggccgacaaaaagtggaggagataaggacgcaatggtgttggacataggccacagctagggttgacaacccaaatatggggttggtgacaaccatgagaaataggaacgatgaagccagcaccaatatggaggagtgtgcggagatgagccatgtgggtggtgacatgcctgatgggcaggtggatcaatggggcaccgagcaagatggagtgatcccacaaggagactcttaggcagcggcacacggagagctcagggctgtgttggtgcttcacaaccattgcctcttcatcagagccgcatcactatatccagttggccaaagacacattgtgtttccatgaatgtggtgagccccagggaccataatagatgggccgtccagcaaaatggcctgtagatttgctccggaggagggcagccgtgatgtaggggcccattagtggtgatgaggtgcgcgtggtggagctaggtattggtgcgcaaaagaaaccgagacttgaaattgccatatttgttagaatagttggggtacgcgtaggagcattgggtaaggggtggcaaaataaaccgagactggaccccaaaaataccaaatgtgatcatcagttcctagcacggtcttaggtttgagaagatagatcccttgttcggtctttttgtttactacaccgggtgtctgaactaccaacattatacttatctcctctttattttgttccttatctagtcataccattctcttcgatctctcattcgccagcgccgtttgtagtctccgggtctttcatccagccgcaccctatctgctatatatatagaagacccctcttctccctcgttatcttccatctcccatctcctcccgcctcagattgccgttgcttgttcaccaaacagcactcccctagctctctgtatggctggcccatggccgccgcctgcctggcgcttactctaggttggtccgtccattcctatcacatgtgctccgggttccacgcatatcgtccagcgtggtcactttcactatggccgaagaaggagaatgaaagatatcaattttttttatcaagtttgattgtcattttcgaaggattgaattacccggatcaatatctcagtcatgactgaatgcccaccactagcgctgcgtgggggtttgggggcgtgccatatagtagtcatactaataagatagtaactataatcaaaatttgacatttatagcccgtacatatgggttattgtctaatgatccataaaagccaagctttcaaaggtacaagcccttacaaaagtttaaaagaaactggtggtggtgatggtgtgatcgactttatgacaagcaatgtcgaaggaaattaaaccaaagcaaatgatacatgtgtagacatgcatggagggcgcatccacaccaagcactacgcaatcacgcatggattgatcccttcaggtgttcttggaggaatccatggaacgaagctcccggatacgtttccgtatccccaggcggtacttcacgatagccatctggacatcctggaggatgtccacggtcaggtcatccacgttgttgcgacggcctgacataaggtcgcagacgatgagcttgatctccaattcacggttcttgcgtcgcagttcctctagcctcgctgttgcggcggcgatctgctgctcgaggatggtcttctcgtcgtccagcatcgttgcctgcacaaaacaagtaatgggatcgatcgacctctaactacctctatgtttggtgtatttgatggagtgatgttgtgagaagaaaaagcaactaaggcgctacttttatagccatatctgggtgacacaaagaaggaagttattaagtgcaaagatttgatatcatatccaaattaaatgcaaataaaagtataatgagtatatacttaaaatactacgtacacccgttgttttttaatttttatcaattttaactggcattgtattacattcacaagtattaagaggtcaactttttcgggctgtaaatatttgacagtgataacgatatttgagagggagcacaaatcgggtgtacggcgctgtttcacggcttatatgaaaatgtgcacttctagataaaaaaatgttgcaaatgattaaaatggtgaaacatagttgcataaagattaaacatttcactcatgcactagaaacatcaggattcaactgttgaaacatcaacagatgcacaagtatcggagtaaaaaaaatgaaagaccataagaatctctactaaaacattccgatcaatcacaaagaaacatataaaacatgtgagctgaaacatcgaaaaatcacaaaatgtaccaatgtagatctctccttggtcgcctgatcagagcttctattgatgaacatgtcagctatgatgtggagacccggtgctccataccttggatgaccataccttccttgtcgttggagtcaacggcaatgaccatctccttctctgtcgcttctttgacatggtggtgccgtcccctcctcctctctgctggtggcctcccagatgtcatggcttccttggcaaatcattgcgcctca

SEQ ID NO: 69028 - DNA, 12949 bp, Oryza sativa
gctttggtggggagggggagtggggattcatttgaggaggaggaggaagggcgtgggtggagggtggggcccgcatgtcagtggggggacacgtggcggtcaaggggagcgggccgtgccgcgaggggagcgggtgcgggcgtgtggctgggggggaggtgggttgggttcgggggggacacgtggaggggttttagtgggtgggaatggtgtttgctgtgtgtggacggtgtgggtatgataaagataggtttaggttttttttttttttgcgctctttggtgatttggggtttttgctatctctctttttttaaaaaaaagataatattgtagttctggttagctggaagtctgtttttagattttcatttagtgcaaatgtatatgtatattttttaaaaagttgttttataacactacaattataacaacttttatgttggtggagttgtaatttatgttgtgattgtcttaaaacgccattgcaatattggccataaactttatattatgtatagtaggatgttttcttcatgcgtgcttgtaatatactccatccgtttcacaatgtaaggctttctagcattgcccatatacatataggtgttaatgaatctagacacatacatgtgtctaaatgaatgtgagcaatgctagaaagtcttacattgtgaaatggaggaagtagtaaggctctcctattatttttgctccttttatcgttagattggcttatggcttcttccttgcttgttaattttccataacctcaagtagactgggttatttatttatatctaccactaagaggaggaggcagggcgaggagaaagatgtgttggccgtaaggaagagggagtaaaaggtgaagtagtctatcgtccttggaggcagtgccgtggacagcgtgatgacgataagatgaggcggtttgcagcttttttgttttcacaacaggggcgtgggagagtaggagcccaggcctatttgtgaaagaaggtttgcaacatctccataaaaatggaatggctcatgcatatttgtttcatgacgtgacacgataattttgcaagaaactttagtgattcagtgttctagataagatagctaaaactaagccaactattgttttatagcgtccgtgtaaaacaatcttctcacctctaaaatcagatatccaacacccctaagctattcaaactattcaatttaccccatgtttaaagtagctgtgtttgcctatatatcattgacgtggtgaaaaagtctaccacatcggctaacatcaatgtttggcgatgccacaaacaaagttatgagatagtaagaagtaaagaatgtcatatttgaaaacaaaaatgaaagaatatgctatatggaccgcaccataaaaacacagttctgagtttgtactcttcatatatcttttactaaaggacacaagctgacttttataacagaatttttactaggatgaatgagccaaagtggacacaagatcttgcctgccatccacatgaaaaacaaaactattcctcttcttcttcttggattaaaagatgatggatgggcccaggaaagaaacctggcctagaaagggccggccgggaccggagcatccgatctcctgtcaaaaccgacgcccatcatgatccatgaacaatgctaccctaatcaatcaacatgcatatgcaagcatggctaatggtcccacggagagatcgatcaccaacccgaccggctgaccccacatccatgcatgcaatgatgcaaatcagcatatacatgaatacatccgtccatgcggttgagctaacaaaatgatgaaacgagatgatcgccagattaatccattgtttacatgcagccaaagtacaatgacagttgacaaccttcaatctgcaggcaataatttacacttttcttttaaataaaccttttttttcctcttagaaattaaaccgaagctgtgagcaagagcacatcatggtcagttcttggaagtcttttgtttgacacacacttgaattgctcccattttttcccaaccaatttgccacctaccatgcctatctgcacgcacccgtcgcgcggtttattagcctcttttctcctgcgaatcacggcgagctgatcagcgattaggcgaagcaaacgtaccaaattataatgggtgacgcccagcggcggcagcttctcctcgtcgccctcatgctcgccgccgccgcagaccactcgctggccggcttcttcggcggcgcgccgccggcgtctggtcccgccgccgccgccgccgacaacgacgaggtacgttagagagacatagtatcgttaattactggaaaggttaaagccggcgatttcgttggtcgatcgttctggctaattctgatgttcttttcttgtttcttttggctgatcgatgatgcagaagtgcagccggacgtgcgagtcggagcactgcctgggcacgtatgcacgtacgtacgtatatatataccactctccctggccgatcgataattataatttgtcagtttctcttgctgtaatttgtgttgtgagcaagtgttaattgttgtgaaatttgcgtgttgcgtgtgcagaggcgccgttgatgcggtacggcaagtactgcggcgtgtcgtacaccgggtgccccggcgaggccccctgcgacgccctcgacgcctgctgcatgctccacgacgcatgtgtccaggccaccgacagtacgtatccacaccaggtttaatgtttggtgtgctcgtttgtatcggggtggccgaaatactgaaattttgaaaattttggttcgaaattttatgaatttttgaataaaatttgacaaattttgaacataatattatcaaattcaaaaataaaaataaaaatttcggccgaaataatatcgtatcaggggttccgatagaaccgaaattttgaaccctgaattccacaccaatctttttcacttatcattttgatcattttgaacatctacacattgggacaaattcaaatccaatataagattagagagagggagcttgtctcctcctttctccctcagcttcctattgtttctccctccctcttttcttctatcaacggtgatccaatagaatagagccggaaaactcgatcgagttctcctgcactcatgttggatccgcacctatcgacatacggtgtaggggtgaaaacggtcacggaaattcccgatcgaccgggcgccgtttccgtttaaggggtaccgtttctaaccgtatcgtttttgactattttttaattttgttttttctaatttcttttcgcatcgtattaatatcgatactaagtagtttaaatgataaatatggtcaattaccggctgatcgagcatcgtttcagaagagatgctaccgattccgaccgtttccgatcgttttcacaccctaatacggtgtacactgataacgggatgtgtctgtcgaaattaatgcatgtgtgcagatgactacctcaacatgctgtgcaaccagagcctgctggactgcgtggcggcggtgaggtcgccggcggcgaggatcaggacgttcgaggggaaccagtgcaacgtgacggacgtcgccgacgagatcacgtcgctcgtcgaggccgccgtcttcgccaagaggatcctgcataggccgtagctttaattagctagcttgtagccgccacatgtaattaattgttgtttttgctaattaagctgctactgtgcatgttgtctggcatcatagatcgatgcacattgattaattaattccagtcgtctccggatgctacaaaaatcgaagctagagagtacacgtaagtgtagttggagttggtgatctccctacacgtgtctagtttgcgtaagcaaggcttttttgttttctcttctttttttttttgtcatatcctcgatcgtcaacttgttcatgcacatcaatctcagatgtgctcgcagttagcacgtgcgtccgaatcatgattctgctcggaattcatttttgtgaaggcccatgagaacggtatttacaagctagtatattttcaaataaaccttttgtctttcgtgtttacaccaagctagcttgcgtgtaaacaagcgtagcatagcaccatgcgtacgtttgattcgaaaaagaagccaaaagtaaaaatggttaattaaatccatataattatagatttgctcgttttgaaaaaataatattactagtcatctatttgaaataatgccatatattacaatcttatatatattcaagatatatcccctcttgcgaagtgagtatacctcaactgattaggttattgtggtgaaaccagcccactcaagtttaaatcagtcgcacctaacggtgcttgtgctagatccgtcaagcccagggcaagttggtcatgctcaacagtaacaccgttgctgctagatcctcaagaacatgcctcgttggttggattattgcgtggtcgtggaatcgttgtcgattgccagcagtgggagatagagaggagagaggggcatggaagaaataagaataaggtaatttcattaaaaaaatttttgataaacacatcaaaaggataataagtagtgacatataactaataggtgtgaaatcatgacgaaatggctccaaatagataaagaataataatatattttttttaaatgtaggaaacttataatgacacttctccaatgaatgtaggaaattttatgttctccatccttggaacaatgtaatagtcaaatgtaatcaacccatgtctgaatcacaaccaagcaaacaaaaaccatctcaaatctgacatatataaatcgatggatatagtgatatggttcaacatctatgctgattaatattatagggataaagtaacatttggtagattattatgtaagttacaatctgcacatcaaactctttaaaccaaaactacatcgaatcaagcattaaattaccataattgtatattaatttattccatccactcctaaggaatactacttcctccatcccttaaaaaaccaacctaggataagatggaatgtttcccatctgaagttagcttttttttttttgacgaagtattgactagtagaaaattataacccattggactatgcaagtcaaaatcaaatcagaatccattggatttctataaatcaaagatcaaatcatacatggttacaagtattaactactgcaataacattcatatcaaaacttcactttgtagcatcaatgcgaaggcattcaaatccaagtcaaaaattaataggggtgtataaccccctgaaaacagtggtagaggtaggaggacgaccagtagcctcgtctcctccaacagttcctttttttatataatcctctaattaattagataattaacctaagcaatgatatattaagctttatctaagacttttaacaaagtattatccatcaaatccttctcaatcctagctccgcctccgcctaaaacgagaactatagcaacatctaaaaacactgtagcaagtactcgtactatagcatccttaataactgacaacgaaccctctgcaacttgcacgtctcagctctcaaccggacaacccccgatccatcaagtacaccgacgaatgcctacgtgcgcagcacggggaaacagtccggttgaacgtgcatgagtgcatcacctcgccccataggtagggcccgtttagttcctgaaaagaaaagtttttttttttgtcacatcggacgtttgaccggatgtcggaaggggttttcggacacgaataaaaaaactaatttcataactcgtatgaaaaccgtgagacgaatcttttaagcctaattaatccgtcattagcaaatgtgggttattgtagcacttatggctaatcatagactaattagactcaaaagattcgtctcacgatttcccctctaactgtgcaattagttttttaatttatctatatttaatactccatacatacgtccaaagattcgatgtgatatttttggcaaaaagtttttgggaaataaatagggccgtagtaggccgggtgaaaacagtcgtgaaaatttccgatcgaccgagagccgtttttaataggaggtaccgttctcaaccatatcatttttagctattgataaattttatgttttttaattttctttttcatcgtattaatattgatgtagattagtttaaatgatatatataatcaattaccaaccgatcaaacatcgttttcgaagagattgtaccgattccgaaccgttttcacccagccgcatcactgcatccgcagttcaccggccaaacccaaccggctgtgttcgttcagtggagttggtaacacattctctccacacgaaaaacagagcgacgtattttcttatgattaattaagtattattattttttaaaaaagataaattaatatgatttttaaagcaactaggaaggtagcccgcgcatatgcgcgggcatgtgcgtgaaatttactgtgaatgttcatgtgtgggtggtttctataaaaaatattcttttgctttatcataaactaaaaatgaacttatttaacatgctttgagcactggtagtttttaaattgtgaactaaaattactttaaaccgtgtagtttttaatttatgagtgggacatcgaaaaaattagtaattagctgttcaatatctgtgatattattttataatatcaaaaggaattggacagaaaaacaatcacaaaagtatgatttttcccctccctaccaagtctgcctcacattcacctccaacgctgccaccgcacccgcagccggtgaggtggctctctgggggcggggtatcgaggagggcccgtgcgcctaggcccatgggtccgtattgttcccaaactcgtcgccgctgcagcgcgaaggccatgccggcgccgatgctccgccacacaccgcagttaaggggagcacaacgtgggccaccgcctggttcatgttgagcagggcgccgcagagcacatgctattgcagtcggtctcgcagtggcgtgctgtgctaccgtaccctccgctgccgatgtcgtggcgtcgacggcgtcagagctatatgcgagccgcacatggcagaaaggggcaaaatcatactttcgcaattgtttctatctccttttcctttggataacaaaataatatcgtgggtatacaggcagcttattaccattttttgcagtgtcttgtggcagatatacattcttgtagtgtctcccagctaatcacacgtttttttaatgtcccgtagaaatttttgcctttattaagtggaggcctcaatatgcatgtgggtccataatgtaattttttgttagcaattaaatatagtcaatatgggtattaagttattgatttgacttaaaaaaaaaagttggctagacctaataggtggagatttgtttgtggtcttttctttgcccataaaaataattttaattttaattatcatagagataggaaaaacaaagaaaagtaaggaaaaatagagagggtttggatgttttctttattaaaaaaagagtgatctgatgacctaaaataatgtgttaatgtttaagtaaaaaaaaccgatggttggaatttttttttaatttaagtgagacaagtaacagcttagcaaaacgttcatgtactttaatgcccatagggatgagaggaagggaatatggtttgggatgatttttttttaaaaaaagatcgaataacgatgtaaaataatgtgtctattgatttaagtgaaaaccaatggatgaatgtttctctaatttaagagtgtcacacaatagtttagaaatgtttataagatgtttaaaggactttaatgcctatttgtgatttttttccataaagacaattttaattttaattgtgatagggatataaaaagagaaaggaacagaaggagcgtacaaattgatcagtatgtgcgtggtgcacgatatgcggacgtgggaggtttttgtttttaagatatatctaacgatctagatccaccgatttaaataaaaatcgaatgtaagatttttttttattttattagggttccatgtggcgacttgggattacttgtattttggggggtgtttttacgagcaatacttacgagaatgggagattaaaagaagggagttttttaaatagatataatctaccagttgaaaataacgggtatgtgaaaatcaagactacatgttttgcttttatcttagaatttataggaatttcttttatttattatagtgccacatgacggcttaatagtatttgtagaaagtttaattaacttttagtatataatagataatatatagattttatatacaagatatagtttaactgcatatatttatagagtactatattttatttttaaatagtagaaaatcctattttaaagcccatcgattttttttcaatgacactacgatgtatgctttttgtttctttactttatcgcttttatcgtataagtccgtacataggtttttcttgaacgtattattcatcgtttttcctttagatgtatgtagaacagttttttttcctaattccggcccacaggaggtgacggagcgtggggctcctcaccgggagaccgcccaggccccctttgccggttcggccgggggcgctaagtgaggttcttcaccctcgatctgtggaatgttcgcgagagagcaaatgcacaagacacgggcgatgtagacaggttcgggccgctgagaagcgtaataccctactcctgtattctggtggatctgtgtgtgaaggagttacagagagccggagagcaagagagttcaggctctagaacccctcttcctctttctctcctctatgagctcaggtattctccgagtcgtcccccctttctcttctccgtcctttacttcggtgggcaaggtcctccttttatatctcaaggggataccacatgcaccacttctacctactcttcttttgggtggggactcaccctatcttgacccaaacttggctcgcgccttcgcctggaagctaaatcacagctagtccttgagtaaggcccagtgccgtcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgcctatgacgtgaccggcgtcagaccagtcacagaccggtcactcttgtccaccgcgcgtcagtttagcatgccgcacgtctgcctttcttcatacaatgacttccttgctatggttgcgatgaagcctggaacgaatctggccgggactgacataccaactccaggagttagcacgccggctccggctagggacgagtgcctggaggctctcatcaatccgacgggacggggcgaggcgtgtgacaggccgcctgttgccacctaacccgcgatctgaccggtctgtgaccggtcacacactgcgaccggtcacggaccggataagcgtgcgctacgcggcattaaatgcggcgtggcgcgctcgtccaacccgcaataaatgcggttaggtgagcccctctgtgctcacctaacccatacacgtggcgccaaaatcacagggggtcggggcgccctagccctcggggccgaaacaggggcggcccgacccctcggggagacagagggaggggtggccacatcatcctcgggcccgacccccccgagggggtcaggccacgtgggtgaccgcggctacccaaacctctagtcacgataccctcggccccatgtcaccgacaatagcccccggcgttacgccagggcgattgcccccttcgagggaagcgctcgggcgtgacgccactccttaggcccggtgacaggtggggccggtccctacaggcaggcaggaacccatcggtcgcaagtcgcgcgcatcggcaagggaaaaccgaccgacaataatgagcggcctctttaagaccgctacatcactcgagcagcgcgcgaatcgggacgagccggttcgtttcgcctggagacgtgatgatggcgcttttcgcgtttggcgagcgtggttaatgcgcgcacgatctgtcccatctcaactgctacggccgcacatctgcctcgtgcgccgcaaacgagcgagttgggttagtggaggcgtgggcgcgagaaacgagggggcgaggtagtgggcgcgggaaacgaggagccgggaatagcgttggcaagggtataaagacgccgaggaagagattcgtttccttcctctcgccattcttccccttgccttctccacttgagctctaactcttcgtttcctgtgccctacccttgccgcactcactcgctctcaagctcctcctccgccggcatcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggacgcccgacgccacactacctggggcggtccgtcttcttcctctctttcgcaatggcagggctggtcccgccattctcttcttttttcatggatattctggagttttatgatctccagatggcgcacctcacccccaacgcggtaatgacgttggccatcttcgcgcacctgtgcgagatgttcatcggggtgcgcccatctctctggctgttccggtggttcttcaccgtacagccggtgtcgccgccgtcggtagttggtggctgctacttccagccgcgggggcaggtgctgcaccgctacattccctgcgtcctccgcaagaagtgggacgactggaagagcgattggttctacacccccctcgccgacgaagcgcgcctccgacttccgagccagcccccggcgcaggcctccagctggcgggcgacggtagatctgggaaacggctacgacgccgttcttgaccgcctggcgggtctgcgatcccaggggcttacggggccatggtgttcggcgactaccttcgtcgccggatcgcgccgctccaacggcgcgcccggggcgcctgggagtacaccgggcccgaggactccatgaggacccaccaggggcgcacatgggactgggaccctgaggacttcaggatggtggtccaacgggtgctgaatctcagctccgtggaggcatccctcatcccccaaggagtcctccccctctgctgcgatccagagcgcgccaacatcctgaccatcatgctggcggtcggggcgtcgggggagcgggccctccgaggccacgatggcgcgggcgggagccgcaggggggaacaatctaccccgggagggggtcgtgcttctgggccccgcgacgggggcccggggggcagctgccctgccgacgcccgggggaagaggaagcaggagtgtaccccttccccatctcctccctgagggggcggggcggtgcgtgccagcagcaggcgcccggagggtgccgtgccgacgtcgcagcccgagggggagcgaaagaagaaacggctccgcaagatgggggggaccgagccatgccgggggaacctcatctcgcccccgaggtggtcgtttagccgacctcctcgcaggttcgtccctgcacccaccgcggccgtattcattctcccatctcccaaggcgagttttcactcacccgtttctttttgtcttctggttttttttttctgcctcagcgagatcccgtcgcgccccctccgccattcccagtccggccggtctgaggccgaggagacggcgaccgcagaggcccggaggcgggaagctgaccggcgagaagccgcggaccgcctccgggaagccgaggaagccgcccaggaggccgtccaggttcgccaggctgaggaagccgctcgggaggaggccagactccgccgggccgaggagtcagtccgggaggcggaggcggcgcacgcacgccaggcggcctgccaagcccccgacccgactccgcccgaggcgacgacgacttccgaggccacccacgacgaggccgcgggcgcaccgctcgggcccgacccctcgggcgacgctcaggacgagccagcttcgggggacgcccccgagtccggcacgtcgatcggcgggccgagccgtgcggcaccctcaccgaggcggccctcccctctgccttccgctaccccaccgagcgcggagcccctcctgcaggccttggccgccgcaaacaccacggtgttggacgggttaagtgcccagatggaggtcctgcaggcggagcgggcggagctcgacgcggcgtgggcacgcgtcgaagaggggcggcgctcggtggaggccatggtggaggcgggccgcaaggcacaccgccggcacgcctcagagctcgaggcccgtcgtagggacctggcggagatcgccagggaggtggaggagcgggagactgccctcatcgtcaccgccgtgctcaacgaggcgcgggacgacctccgcctccaatacggaagccgggcggcggagctagagaagaagctcgacgccgcccggggagtccttgatgctgccgctacccgggaacggcgggcggcggagatcgaggcggcctcccggcagcgcgaagaggcccttgaggctcgcgccacggtgctggaggagcgcgcccgcgcgaaggagagggacctggcggaccgcgaggccaccgtcgccatccgggaggcaacactggcggcgcacgaggccgcctgcgctgaagaggagtccgcactccgcctccgcgaggacgcgctcaccgagcgggaacgagctctcgaggaggccgaggc

SEQ ID NO: 69029 - DNA, 6174 bp, Oryza sativa
catatggtatattttccggttggtgtgtgcatggaaagatgccatgcccaacatgtatggaggcactccaaggaaaaatgttgaagtttggtggaaagtactcattctttgattgtcatcgccagttcctcccaattgatcatagttttagaagtgattcacattcttttctatcaaacactacagttagcaatgaaccacctcttcgtctcttaggtcaagagatccgtgcccggttagataaccttgtccctgctgctaatggagataagtttgtaggctatggcaaggatcaccattggacacatatatctagtttgtggagactcccgtactttcataaactagtacttcctcataacatcaatgtcatgcacaatgagaagaatgttgctgaggcaattttcaatacttgctttgacattccagaccaaacgaaggacaatatcaaggctcgccttgatcaagcagcactttgtaacagacctgaattgaacctcatccaaaaacatgcatctagtcagtgggtaaagccaagagctgacttttgcttgaatagagctcagaagaaggaagtattagaatggtttcaaacattgaaattccttgatggctatgggtcgaacctaaggagaggagtgaatttgaaaaccatgcggatcaatgggttaaaaagccatgattaccacgtaatgatggaacgtatctttccagtcaagttccgtggatacttgccaactcatgtgtgggaagtgctagcagaggtgagcttcttttatcgcaaactttgcgcaaaacagtttgatcctatagagatggcaaacatgcagtctcaagtaattgttttggtttgcaaattagaaaagatctttccacctggattttttaatccaatgcaacacttaatgattcacttaccatatgaagctagcatgggtggacctgtgcaatttagatggaattaccccgttgaaagaggccaaaagtatcttaagagcaaggttagaaaccgagcacgtgttgaagcttccatagcagaggcttacatactagatgaaatctcaaacttcacatccatatactttgctgatcaagtgcagacaattcacaatcctgttcctcgatacaatgttgctactcagtctactgattgttccctaagtctattctctattaggggggattctactagccgtggagtccctcgacacctaactcgtgaagagtggaatgctgccatattgtatgtgcttacaaaccttactgaagtggatgactacattgggtattaactatgaaattgatatgagttacttctagttcatagctgcatataattttactttaaatcattgtgtgcatttttatcttgcaggaaattcatagatgaggaatggactagatgaggtgtcccaacaaggcaacaacaagagaatatcttacggaatggtgatgggagagatcgtcctaatttcgtatcttggttctatcaacaagtaatttctttagcccagactttacttatattatacgcgtagcaatgcatatcctttcagatcagattaggaaatctagctagcttacttcgatgtaatatcttgcatgtgtatacatactttcctaactgttgaacattaagttctttcatgaatgttcctgcaactaacctaggtaatccccatcaaaccaataaagtattactgctaaaactctaaatttggtgacttcttatatcaatgctataaatttggtcctacaatagtaaagcacatttggattagtgcaagttcctagtatgcatatggctttttcatagtacaatctgagttaattttttttcatgcattatgaaaatagtattgaacatgtatgtacatgtcattaatatggagacacttctcaattgatcatctgttaggtcggaaatctggaaagaataaaatccttgccaatttctaataacaaaaagaacctagccaattaataacttgataacttcagttttgcaattcaagacctcaataattaatagtgccttcttccattttctttctgttttcattagtttgcagtttaacgcctcttaattgcatttgtgtcaataacctaataatacttatgtttttctataacataaccttcaatattgccataatagaacattatgccacaatttattgacacattatttcctttcatttcactgctagagtatgttagacgaaactatgagtgatgatttgaggcaagtagctaaaggatgccacactcgagtcttgctatataatatgtatgatgtgaatgggtatcgattccgaacacacaaatatgaacatgagaggccaaatgcaactacaataaatagtggtttggtgactataggacagggagaaaatagtgacacaactgagtattatggttacatcaaagaaatagtagaaatcagctttgatggcagaaaacctctcacacttgtgctcttcaattgccattggtttgacccaagcaaagtgaggtatacaccaagatatggtctggttgaggttgctcatgcgtcaatccttccaaaattcgaaccatttgttttgtctcatcaagcgacacaggtgtattacatgccgtacccatgtaaatcgtgcaagacctcactaattggtgggttgtgtataaggtgcagccaattggtagactacaagtacccaatgatcaagattacaattatgttcctaatagcaatgttgtccactatttccaagaagatggtctatccggcagttttgtaatcgatcttggtcaagaactcaataatgatcctgagcaagttgccattagcagggatactgaagatatttgcaatgacaaggacttgaagcttctcaatggatcatctattcaagatgaagatgatgatgacgaggatgatgaatcttattgcacttcctcatctgctgaagatgatgaggttcccactagtagggatatcttatttgacgagtatttctaaggtacattgttcatttttttgatggagactataatgccaattttttatatcctgtgcctccccaaatgaatatttcctttgtcaactatgcacaagaattaacctttcataaactggttgcgtgctgtaataatatttggcagtcatcttactttcgtaaaatttcaggcatacaattggatcattgcaaaggattgcagttgattggtgctgtcaatacacaaatttggagttggttactcactagcctctaacatttctctattgcctccctgggagaggttctaagaactcagactcaccttgttactattgcattatagccacttcagacagccatttatattgtgttcttgtatcattgtattaaaaaaatcatactgggataatatacagctaatgttcacctgacatttgtgtggttccatatgtgatgcttgtctgtcatgtttggatgatatgtatatgcatacatgttagttgcctgcctactgtatcagtgcagtacaatcgtgaatgtgtgaaaccctgtacaatgagctacataatcttaccgtgtattcatctcaaatgtcaccgtgtgctaaatcttacgggaagaatttcaaccttcccgggtcactaaaaactctcggtaaggtgtttcatgttcccgtgttttatggatttcttcccgtgagttccaaccaccccgtttcactccgttccgtgcatgacatgccgttaactggaaagttaccggcagggtgttttcacatggtaagctttcagcacatcctgagttcgcaagcagtttctcacgggaagagtgacacggtaaaggtgaaaggctgccgagtacaccttcccgagagtttgctcacaggaacgacgttaccgtgagttttagccctgttaccgagttgtttaggcacacggtagacttccattccctggtagtgagtatttattataccaactaggaagctagctcgcgcgaatacgcaggcatgtattttagggttgttttttttacacacgtttgatcattcatcttatttaacatttttatataaaactgtgaaaatataagatatgtgcaaattacctttaatgataaacctagtcacaacaaaataaataattattattacctttttaatagaactaaatggtcgaatgttcgtaaagaattgaacaacgtcatctattaaggatattataatttcttcaaaattattctttagtgtcattgcttatttttaaatctatttgttagatatgcatgtttatagatcaatcctcactctgtcccaaaacataggtatctttggattttgggacggtctttaggatgctactttgacaaataatatgtatatttataaaaataaattattatatataaaagagttacttgtatttaatatcaattttacgggattgatattttatttattttcagtataaatagtaaaagtaaaatgtttgacttggcagtattctgaatatgcttatattttaggatggagtaaatgtatggtaccgtaatcaacatgttaattgtttgtagcttgcaatggtaaagaaatacatgtgccatatatttcttacaatataactcttatttttgggcttgattaataataataataataaatattttttatatatttagttgttagctagaaaataggagatgagatgggaggggagagttggagagggcgggagtatacatacgtgcgctaattaggaggaagggcagtacgctactttttttttctaagaaacagttcgctacatttttccccactaaaacataatagatctaataactaatttaattagtgggtccatctttaagtgccacgtggcattttaagaacatttataggagttctatgtggcggcttgagagcgtttataggaagtttaatttaatggacttttagtatataatagatggagtagatagatagatagatagatagatagatagagtactagttggatgtacttatattataaagagggtcccatgtcgactagaatgacgtgaccgtggacgtcgttgattaggccagttgtattatgacaattgtagattatattacaaatctatatatgctatatagttagcaccaaaagtttaatatgtattgggccacatcacttacaaaattagagtcattggattatttcattcttcatcacaatcatccaatatatatttaaatatttacatttattcctcgttagttcctagataacttaatattcattaatccacttagtatagttattattactcaaaagaaggcatccaaatggtcatgccatttgtcatcttatcgtttgatggtgtttttacggttcagatcaactaacaatctattttataatatattgcatacatcactattgcaccacaacttgtggagtttcatctagtttatattaaataacatatgccattgttgccgctgccttgcgcctctctccccctatactcatacttgcttcatggtaccgctactatataaatcttaatcttaattggtgatggttggaaaccccacaaagttgtcagatttcccaaccagcaactataaggccaaggcggcactgatatagaggggaaataggtgctggtttagaactaacacctttaatttgaggttccacaaataaaaaaagcggctcgatgcaccggctcgaatcaagcagctccccttcacccgatcaatcaaagaacatccaagaacactaagaacactaagaatggcccgacatcgtggagggcaccactgccgcagccatcgggggtcggtagcctgccaccgcacgccgccgccgctgcctcccttcctgtcggatctggcggaggggaggtcgccgctgccacgaaaggcatgttcttgttgtgcaccatctcccacaggtcagtgtccatgtcgaaggcgcaggtgcccttgtcttcttgctactgctgcggctgcaccgatgccaacaagaggatgtaggagctgacaagggcatacggcgtgacgtgcacactattggagaaaccatctttggtcgatcgacccaaatccacaatagtcccggttccattaaaaactgagactaaaaacgatttttactaccgatttataagaggaacaagactagttgatttttagtcccgg

SEQ ID NO: 69030 - DNA, 5723 bp, Oryza sativa
  unsure (1)..(5723): unsure at all n locations
cctcctttttccctctcgccggcgtcacctcttgtcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgtcgtcaccgttcgtcgttgcgcgtgtcagaggagccggcacgagcaaagacgcaaaaggggactccgggcgcgccctctccttcctcttccccagcccgaggccggagagattactcccgcgccgtcggcctctcgtcactgcgcccgccagcacggtagagcatctccccgttctccctcctcgctccatctcctccccttagactcgggtagtagcacgagtagcctccccgtagctagccggcgccgccctggccgttgccgtcgctcgccgtgtgctcgccgccgtcgccgcccgagctcggaagcaccgctcgtcgccggccttgctcggcatagctccgcccaatccgacgctagcaatggattcctatagccacgtagatgctctcgccgccgggaattggcccctcgtgacctcgtcgccgtttcccccttccctcgccgccggttgccaccgccgcaatccgccgccgacgcactccctccggcgaatccgagccgttggctcgtctccccttgtcctgtgcaaccacctggtgtgctcgctctcgcctgtatcgccgtggtttgctccgtcgctcgccgctgtcgtccgccgtccgttccggccggcgtcgtcgtctacctcccgccggcccgcgtggcagccacgtaggcgccacgtaggcaccacgtcagcgccagctcggccaaggccgggtcgagccgaccccggtcagcccctccccgtgcgcgcgttccaccgcgagccgtgaggctgcgcgtgggcccgccgcatccgcatccaccgcgaaccgcgcgcgtgcaccgcgtccctcccccaccctagcgccgcgccgcgtgctccctccgcacggtgagccgagccgctgacaagcgggtcccacccgggaccacgcgtggtgagcccggtccaccggccctctctctcctcccctcccgcgcgcgcgcttgggccgccttaggccggccggcccatttagctcggccggaccgctccgtttctctcgggccgcgccctagccgcccgaggaaaagtctatattccctccctcttttcttttcttttcttttcttttccaaaaaggatttaattaaatcctttttcctttagaccaaaaatccaataatcttagaaattcaatatcttcccaaccgtaaatccgtttgactccgttcaacttccaaaattcctcgaatctcgagatctatctaatggcacgcttagaggtcattaatagggctttattattcgccgtttgttgagttgtcccgtttcgcgtgtagtttcggagcccgaagacccacagtgcgaggatttcgaggatcaagctccagatctcgagcaaggcaagccacctttgaacatcttgagcctatatttgaacttaattatattgcttgcaaaatatcatgcattgataggattgcacgtaatatgtttgccccgtctgcgaggcagattagtgggcatacctaacttgttgcatttgatccttcctttgttaatcgttacaccatgttcccttgtaaccacccagttgcgccttggtattcgtgcactctgtgcgagtatcgatggtcgccttcaaacttaaaatatgataaacatcttgggtaaaacttgggttttacaaaagacttggaaaacccgacacctgggtcggtgcttgcgaactaaatgaatttccaaaaccgcggaccggggaacgtaccgggtgtacagtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggtgatccgggttagtaatgtcgtgagggtaaagtgtaccccctctgcagaggttaacaaactgttcgaacagtcgtgcccacggtcatgggcggatgtgaggtgatttctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgttgaaaagttgttggccgggtgccaaccttgtttcaattctaaagactgatgcattgcacatactccgaccggacgagatgcactgtctcatccgtgtcgtttgagaagcactcacttagtcgtttttagaaaagagttcaaataaaatcaattgcaaaaacaacagcctttccttgaagcctgcattaaacacttatttcccatggcttgctgagtactcccgtactcacccttgctctatataaataatccccccccagttgctgaagaagataaagcggatcctgctgatgaggagttcttccaggagcaagccggctacgatgagttttagggtttcggcctagttcccaagtcgcgcctgtgttgtttggtccaagtcttggcttccgcttcccttttgtaatgcagttgtgagctcgggatctgtccgcagcccaacatgactgtacctctactctataataaagagacctctgttgctgtgataatccgtcttcctgtgataccagcactgtttcctgggactggtatcgattaacaggttaatttggagcgtcacgggctagttccggtcggtactagttcgggacgtgacaataaacatactaattctagtctagaaaattaaaaaaataagcaaactaaaaattaagttgtacttaggtagtttctatattgtataagtttagtatatagctcgtgcaagattaggtgactgatgatggataagatacaaaactaggcaactgataaatagaaaagttattttgagtttgtgttgtaatagcatccacaatgtatgttttacagggattaagagttttttttttcctttcaactagcactgtacactgtgcattggtcttcaggtctccactggcactatcctgatacagcaacatgaaccccttccagtgcttaactgatcggtggtgtttagggttttagtgttatcagaagcgaattgagcgtcctctctcctctgatttcccttatatatatagcactgtggggctcgggagcttttctccaattaggattcaaaatggagttttaccgaacacaaaaccaatctatctcttattttgttttcttgttagaatcgggctgtgggatttatccttttctaacttaccggacttagccaataaatcaaccaacattctccccttaattaagactaactgacaaatatactaagtaaacatagctccccaaaacaatctatcacaacaacattaagccttattgagacgacaagatttatagtttactgtagtacttaaataaacttaactttacttaatgggtgttgattgatgcttatcctctctatttctaggatattaatcaaaggcagtgacttaatcctatgccgactacatgttatttgaataagttgggaggtaaggcccggtttagtgtccaattttttttcccaaagatatcacatcgaatctttggatacatgcatagagcattaaatatagataaaaataaaaactaattgcataattagaggggaatcgcgagataaatcttttgagcctaattagtccatgattagccataagtgctgcagtaacccacatgtgctaatgacgggtttattaggctaaaaagattcgtctcgcggtttctaggcgagttatgaaattagttttttcattcgtatccgaaaaccccttccgacatccggttaaacatccgatgtgacactcaaaaattttcttttcgcgaactaaacaaggcctaagtctttggttaatggatccacgagcattaatttagtactaatgtactcaactttattttttttatcctggactctatctttcacaacatgaaatttaatgccaatgtgtttaaccgcttcacttgacttcaacctcattattgtagtatattactaattgtttggttatgctatcaaccactcttaatttcaggataaaattcttaagccatacagcttgccctgttgcatgattgcatgacacaaattccgtttgcattgttgacgatgcaatgagcatcggttttgagcttttccatgaaataactccctccacgagagtgaaaatataacccaaagtggatttcttagtgtctaagcaccctgcaaagtcagcgtctgaataacctacgacctcaagtttatctgaccttttatatatgtgagcatgtaatgcttagttccttgcaaataacgtaatactttcataattactttctagtggtccatacctagattagatagaaatataccaagcatcccaataacaaataccaaatttgattgcgtgaagacttgtgcatacattaagccctccctgcgcagccatcgccctccggcgccacctccgtagatccggtcccctcttcctctccctctctgtcggccagatctagggagggggtggtcggggtggtgggttggcggcgacgtgcggtggctttggccaatggaggcggcaggtggcctccgcacgggcgaccttttcctctccctctccgtcggcctccaaccggtggcgcgcaaatccggtcggggtgagttggcggcggtggccaagggaggcagcggcgggcggccaagggtttccggcggcgacatcaccgataagttcgtgcacggattgttcctactcgtgtagttcttgatggattgtttattcctgatggatctatgatggattgttgttgttgacctgtgattggtctacgttgatttgtgattgttgttgaccacggaatgggttgaatgggttggctcgaaagcatcggctcgacttggagacggcttctctttttttttagcacaacaccaatgacaaattggtgccggctggaaaaccggcacaacgggatccatagctcctgcccgattttcacgaggtcagggttggagatgttgctcacggcggcgatctcctggtaggtcaccaagttatcaaactgcacggtgatagaagtcatgttgtcatttggttgaatgatgtgtaagggctggctctctagccggttggcaccggtgacgtaggagcagtggaacaggatggtgacgatgacggtgtcggtgatggccgtgtgggacggggtgctcaacggaaggccgttggcatcgaagaggtcgggaaggagctcctctaacttaaagttagaggagcnccttcccgacctcttcgatgccaacggccttccgttgagctccccgtcccacacggccatcaccg

SEQ ID NO: 69031 - DNA, 5440 bp, Oryza sativa
cggtaaaaatatatttgatttttataatagtagagatagagatatctcactaaatttaaattgaaaataagtacgtttaatattagttggcaacttggcatcaaaatacgaagtaaacttaccttggtaaagataaagaaagaaaaaatcttagccgttattcctttcgcgaggcggcaacagggagcacgcactctaccgtcgatcttgactggtcagcggaagcgaaccgacctatccaacggtcggtgggagatgtagccgccagtttgaccggtcgctgaccccggccaaactcacacgcaaccttcgcgccaaattttcttgccctccaagaacttttcgcgccataataagtacctcctcaagctgcttccatccattaacctccgtacaagtaatggcaatggcgaagcaccaggccgacctcgtgaggtgctcgcggcagccgggcgccgccgtcggccgcgtctgcgcggcgcacgacggccgctgcgtcgcctgcgactccatggtgcggcccgccgcgccggcccgcgtctgcgacggctgcagcggcggcggcggcgggcacggctcccgcagcgagaggtgcctggtgtgcggcgccggcgccggagaaggaggtgcggcggcggtggcggatgcgtactactgcaggtcgtgcgtgcagatggagaaggatcgcgacggctgccccgccgtcgtcaacgccggcacggccaggagggacgccgccgccttcttcttctccgcgaggagcaagcgtggtggcttcagatcaacaatggcgtgatcttgctctgccatggacgcacgtcttcccgactccacgaactcaaacagtttacggctggtgattttcatgtaacaattgaattatatttctgcaatatagcatatctccattaaatcgatcgacggttttactgggagtaatatgtattgacccagaaattattgggtcctatagtaacaattaattgcaagagtgagacacatgaatggaaatgatcagcagaatagctgctgaggaactcgtgtaacatctcacagaatataatagaaatccctagtgaacgtgtattttcatccctcgaggagatgcccctggttgcttctatgtcatccaaatagttattaaattttttttaaaaaaatgaaaacgtagattaatataaaatatatcactccacaaacatgtaagaccaaattcgatttctacaagtttcaacaaacttatgaaaaacaaatatattatcaaaatatatccaatattaaatttaatgaaactaatttgatgtttcagatataaatttgatcaaacataacataacaaagtttcactaataaaaaagtcttaaaacggagggagtcactaccagagagtgggagactaccgtgtacctcagttggttaccgagagtgttatatggaacacggtaacgtttaaagcataccgtgtgtgaacaaggaaaaactcgggaagtggctaaaaattccgtgtgacgaatcgagaaacacggtaagtgtgggacccacagtttctgccgttaagcgcgcggaatatttggtctgcgcgcgggatcgccgttggtgcaggcggatggcgcgccaagatttccgttggcgcggctggctggcgcgcctgattttcgttgccgcgcgagtaacaggagaatcccgcgcgagttacagccgaaggcccatatgtcagcccaaaatagagaccaacaaaaccctagcccttttaatcgatcccctcacttccccaccccctgccgcctcattctcctcgccacttttcccctttctgatttttcccctctcttcttcgcacatggcaggatagctgtgcgccccagcgtcagtccgccgcacggccaccgagcaacgctgtgcattcctggccgtacgcactccctgcatgtccacatccatctgctaggctctccttcgttgtccagcttgagcacacctcatcttccatccagctggtggtatgtatatgttgagtttttttcttgaatcgtatgtaaagttgggtcttggttctagaaaacccatccattttctcccaggaactagaaatagttcggtgtatgatttctaggaactgtatctcattttaatttcttgtaataccacaagtaccatatgaataagttgttgtgctttgtaaataaaaacaatattagactacagaatggtgtgggtgagagttcttgcactgtcagaataatgtgttttcatatttgtgtacttgttgatggatacatattggttaggcaaaacttgccctcttttcagaaaacataatggttagtatgagtgtttgccacggccctacttgtttagatcgatgttgaatggttgaattgggttggaatgacagcaccatgttgtgtgatgatctgcaatgctatggtgtactacatctttgtatcgacattttataataggcattattataccatgttgctactatgtagtttttgacctgtttaatataatactgcatatcttaattttgtagcaatatgtggcgattgagcttgggctgcagggaggattccaatccttcagatcaggctgtcagcgctgctaccttgccgagatgtagaacaaggtcctcaggttcccaacaacctgataattcttctaatttggatgagatattggctggcgaagaaacagatgaggaaatgttttttcgtggtcccacacggatgccaccgcgacctacccgagatgaggacaaacctgtgatgactccaaaaggagataggtaaataggctaattttggtatgtttcattagttgaaatatgaaggcttgatctgtttgttcattgatttgcacaggcaatggcaggctaatgattttgggggcaacattagggtccccactggcatcctgactgtgcttattaagcattttttccctggcattgtcaattttaaaggaagagatgagccagcatggagttggaaacattacaggattgcaccggatgatccagaaagcgctatactgaatcgcttgccaagccgtctccatcgtgttgaggaagatttctggatttgttttagagcattaccttctccaatatgaagtacactatgcattttattgtgtcttcagttttcatagtttatggccaatttgtactgtacaatagtaaagtatcttagtaccacacttttcaatgtcaagcaggctaactttctgtagttgcagctttacttcaggtgggcagagcgaacggaacaagctgctagaaaggttgtccgcaattgaatcaagcgccttttttcggacctgatttatgaaactcgtatcctggccgtgctcaattaccaaaggaagattttaaaggtagaaacttctcgggatattgcttgcaggacatacctaacagaggaagagtacctacaggtgctatggttgttcattgataatttgttgtgatctactgatcagattagtaattaataaatctgtgcttctcctataggtagaaccatggtggttcctaaaggcaaaaaatgcgtggcgggagttgatacgattgaagtggtgtaatcctgaatggcaggctagctcacatgctcataggatacggagggagaaaatgacatggccatctcaccgccaaggcagtgctaacttgagtcgtttccaaaaaaatttggtatgtgcatctatgttgaaacatgtagcagatcatggtataatatatatggtacccatgttctgttttgggagaagaagaaaaagcgggtagtgtcggtcgagtaccccatccaaacccacgacgtcgccccgcgcccatccatctagtgtcggtcgagtacgagaccccagcccgcacgtgcaccgccgtgctgacaccagtcgccacgcacggaagaggattggctgctcgtccagcaaccctccctaggactgattcgtctcaggtgttgttgtcttgctcctggaatcctcattcggccttcatgtttcatcatctttttgattagtgaccagttctagaatttactagtcaggttgcggttgtactaagggattgcagaactaggttgttatgccatgtgaaagtttgtgtgattgatgatctgaactaatgtttgatattttatttctcagtcatacaaactaaactaggcctttcttattcttgaacctttcatgaatagaaggacatttcctaacataattttattctatcactttgtcataactaggtacaatggaaactgatcgcagttggatgtacaagggccgtcgaaagcgtggcgaagttactgctgagtggatatcgaagactacagaatttcttgacaaggcattcagcagggagacaggacgtgctggtgtgttgtgtccttgtaactactgcaacaacacacgtcctcaaacaagagatatgatgatgaaacacctttgcaaatttggtttcagggcagcatatactgtgtgggtttatcatggtgagacatatcctgcacgtgaaagcgatatatgccaaagcattgaagatgaagatagggtggcagagattgatcggatggatgagatgatagatgatgtccatgatgcttatgtctcagttgaggaggaagatccggagcctacagcgcaagctttctttcaaatgctgtctgcagcaactcaacctctccacgaacacacacaggtatcacaacttgatgctatcacacgactactagctgtcaagtctcagtatgctatatcaattgctggatttgatgcacttttaaatgtgatatgtgctctcctcccacaaaggcacaaactaccagcaaacttgtatgaggcaaagaaagttcttagtgcattgaacatgccatatgagaagatagatgcatgccctaaaaattgcatgctctttaggaaagagaatgcgcagaagacgcactgtgataagtgtggagagagtatgtatgtggaggttgaagacagaaatggtcacaagaaacaattaactgttgtcaggaaggtacttcgttatcttccattcatcccaagaattcagcggctatacatgtctgaatcgcaggccaagcaaatgacatggcacaagaatggtcatcggtaccatcctgacaagattgtacacccagttgatggtgaggcctggaagaaatttgatagaaacttcacaggcttttcaatggaagcccgcaatgttagaatagcaatagcaacagatgggttctgtccatttggtatgggttcttcttcgtacacttgctggcctatgtttgtcattcctctaaaccttccacctggtgtttgcatgcggcagcacaacatgttccttaccttgataattcctgggccaaattatcctggcaaacacattagtgtattcatggtacccttagttgatgaacttatacatgcttggcag

SEQ ID NO: 69032 - DNA, 2901 bp, Oryza sativa
gtcaagagcaagtccgactaggtccgccgccccatgggcgccgccgcgtggtccgcccttttcgcggaccacctcgccagcaacaacgccggcgtcctcatcctcgagccccacggcggcgtggtcggcgccgtgatccctgacatggccacgccctacccgcaccgcgccggcgtgctgtacaacatccagtacggcgtgttctggtggggcgacgacgagggggagagctcagcggcggcgaggcggtggctggacgcgctgtacgcggcgatggaggcggcggtgagcggcaaccccagggaggcgttcgtgaactaccgtgaccttgacatcggcgagaacgcggtggtcggcggcgtgacggagtacgagagcgcgaggaggtggggggagagatatttcatggggaatttccggcggctggcggcggtgaaggggagggtggatcccggcgactacttccgcaacgagcagagcatcccgccacttctccagccctattaggcttagtagcctttttatttgtttgcacagtgcacgtgtgcattgcactgcaatttgagtccatgcaaaagttgcatatcgtcatcactcgatcgctatgtggagctgcacaaatgtatgcctagccaagaataaagacttgagtgacctctttgttttcttactagttaggccatgtacaatgtaccacagtggacagtggtctcaaccctccacgtcagatctgagcacccgtggcagtgtggagtgtggttccatgaactcttgccgtgcctgcagaggtcacagttgcctcgccgcggttcggcttgggaggtgcgaaatcactgctcagggctatgcgtttgggaaaaccgtagcctcgtgaagcgcttggggaaaaagagaggtcgaagagaacttgccgtggtggtcatcgccgctcgccgccgccactgaggtcgcgttgccgctccacgttgccaatgaggtcgcgtcaccgctccaagccgccgctgccaaggtctctgacgttcactggtgtcgtagatccaatgaggtcaagcatggattcagccagctcgtggctggatccgctactgccggtggcccctcgaccgccacgagaaggggatgggaggggagaagtcgacagacgcggccagatctgccgccgtcgcccaaagagaaggagagggggagagcagcgtggcggtggacagggagaagaggagagggggagagccaccctcgaagtttgatgtggtgaatggggaggaggagaatggtggtgggaaagtgcgacatggcagtggaatgggaggaggagaatggggagggggagaaatggggagaataatggcgcagtggtggatggggaggaggggggagagtcagcactgtgagcgtcagaagaagaggcagcgatttggtggcgaaagaggaggcggcaacggcgagatgtcgtggattagttttggtggccagtggggaatcgagagaagagagagagtggggtaggtgagaaaaaaagaaaaggtggagaggctgacagtggatccatgtgaagtttagtggtatctatctatttctttttgttattataaggtccaaaatataaaatttctaattgattcaataacttggtattgacacataaataaccaagggctgaaacaaaaactatactcaacggtggtcttcgtttgtagataaacggaaaatatactcaacggtgatctccgttgtagattgtgtgaattttatgtggtcttatcctatttagcatgttgagactactggtaccagtggcctcaattgtacacacccttaggtgtctgtgcgttgcaatgggaaaattgatatgtgttctagcacatcaacaatggaaattcgtaaaataaaaacatccacatatctgctttataatgtaattatgattttacccttttttttggaagggttttaatttactcctagtttggacatatgttatatgagcccaaaactaatgagttaaagaaaataagatatcattctaccttgggtaggtcaaccaactattccctgtgtggctatccactcgtgttccccgttccaaacccacttcttttgatttaatagcaagaatatactacacaagcagcaagtgtttggggaaaaaaaaagagaaaacaaaactattgaatagagtattccgggagcttctaaaactaagagagaatgctggaggtaggaggagagatagggaagagaaatcgacaagggtgccccacttgcctcctaggctgccgcatccccacagagagcttcagcccgcttcaattccctgcaacgttgttgctgcttttgttgcctctccaattaggttggcttgggccaatgcttgcgtgagaactggcccattatgaggcccatttgagttcctaacacgggtgttgcgcaggtccgaaccgcgagccgtgaatcatcagtacgtgttgtgcctattttgaggtttatgtttagtatatgattcgttggttgcattggtttgattttcgtcaatgtgaggtgaacttgctagtcccaatttcttgttgctatgagtaacaacatggtaactacctttgtattgctgcgcaaatgtgtgtggaagggagagatgaaatggggaggagctgatttatttcagtgcatcacctgagctacatgttctgtgtgtttgcttctggtggctgccagggcatatttgttttgttaccataggtttagcagagaaattacttaaaaatcctgattttatcaaagaaggactaaacaaagtataagaaaagcaatcaagtcattcttatatattactagaaaaaatgcccatatgctgcaacgggtgaagcttattttaaacttattatttttatatggtttagttaatat

SEQ ID NO: 69033 - DNA, 12536 bp, Oryza sativa
cagggggagatgggccgagagagattcggcccatcgaacccgggggaggcaaattagacttttgcggaggaattgatttgggaaggatttggattcgggattgaactcgacaatagatcggggatttgagatctgagatggcacggacactagacaacaagcgaagaaataaatttcgcaattagggtttttaagagatagttttcccgctaggcgccacgacggaacgggcgctacagaccaacccccctaacaagaatctcgacccccagatttagcacctaagggagcagctccgggaactcggcgcggagaagatcttctcgctcccaggttgcctcatcttcagaatggttgctccattggactttgtagaacttgatggtcttccttcgagtctgacgttctgcctcttcaagaaccttgatcagtctttccttgtaggtcagattcttttccagctcgatattacccagggaaacttgctcttctggaactcgaagacattttttcaactaagacacgtggaacacggtgtgcacatctgcgagaccttcaggtaactcaagctgataagccacttcgccacgtctggcggttatgaggtaggggccgatgtagcggggtgctaacttgccggacatcccaaacctcctcataccacggagaggtgatacccgcaggtacacatgatctccttttccgaactcaaggtcacgcctccgattgtcagcgtaattcttttggcggttctgtgctgtctttaaacgttctcggatcagcttaacttgttcttttgctgccttgagtatgtcaggaccgaataccagcgcttcgcctacctcattccagcacaagggggtgtggcactttcttccgaacattgcctcattcggcgacatctgaatactggcctggtaactgttgttgtatgagaactcagcatacggcaaacaacgatcccaagtgccttcgaaatccagggcacacgcacgtagcatgtcttctaggatttggtttactctttctgtctgaccatcggtctgcggatggtaagctgtactaaaatttagatcggttccgagagcttcatgcaactgtttccagaaccttgaggtgaactgagtgcctcggtctgacacgatcttcttgggacagccgaatctacatacgacatgggtcatgtagagttctgctagtttctttccatcaaaggtagttttcactgccacgaaatgagctgatttcgtgagtcgatccacgattacccagatggagtcgtacccgctaggggttcttggcaaaccggtgatgagatccattccgatttcttcccatttccactcgggaattggtaggggctgtagcagaccagctggcctctgatgctctgccttgactctttggcaaatgtcacacaaggctacgtattctgtgacatctcgcttcattccagcccaccagaagtatgccttgatatcttggtacatcttcgtacttcctggatgaatggagtaggcggactcatgagcttcctttaggatgagatctcttaattccttcttggccggtacacagatgcgtggaccgcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacgttggctttaccggggtgataatgaattccaagatcgtaatccttgattagttccaaccatcttctctgcctcatatttaactcagtctgagtgaagatgtacttaagacttttgtgatcggtgtatacttcacatctgttcccgattaaatagtgcctccagatcttaagagcatgaaccacggctgccaactcgagatcatgggtgggatagttgacttcatgaggcctgagctgcctggatgcataggccacaacctttcgttcttgcattaggacacatcctaagccttgtcttgatgcatcacagaagatctcaaaatcttttcggatatctggcaaggtgagaactggggcagtggtcaaccttttcttcatttcttgaaagctgccttcacatgctgcagaccattgaaatttcttttccttctttaatagctcggtcataggtctggctagcttagagaatccttcaatgaatcttcgataatatccagctaagccaaggaagctgcggatctctgacacattcttgggcgggttccaagcaagtacagccttaaccttgctgggatctacttcgacaccgttggaggagatcatgtgtccaagaaatgctactcggtctaaccagaattcgcattttgagaatttagcgagtagttgatgatccctgagcttttccattatcagcctcaggtgttcagcatgttcttcctcattcttggagtatatcaggatgtcatcgatgaacaccacgacaaattggtccaggtattccatgaagattttgttcattaagttcatgaagaatgctggagcattggtgagtccgaaggacatcactgtgaactcatatagaccataacgcgttgagaaagtggtcttcgggatatcttcagatctgatttccagttggtggtaacctaatctcaagtcaattttggagaaaactcttgctccttttagttgatcgaacaaatcgtcaatccgtggcaatgggtacttgttatttatagttacttcattcagggctctacagtcgattaccattctctcagagccatccttctttttaaccagaagcactggggctccccaaggggatgagctaggtcgcacataacctttactctccaattcttcgatttgtcttttgacctctgctaactcattagctgccatttggtagggtctttttgcaattggtgcggtgcctggtgccagttctatcgcgaactcaatctctcggtctggtggcatactcgttaattcttctgggaatacgtcgggatattcacagactacgggcaccgactccaaggaggtgacttgtaaacaggttaggatagaccgacttgcggtaggggtgttagaggtaaagcggacttgctttcctccaggtccttgcaaggtgatggacttttcggcacaatctatctgtcctttgtgcttagctaaccaatccatccctaggatgatgtccaagttttgcgagtctaggactatcggtttggctaggaagtcaacttcctcagttctaaggttaacttccgggcatatttgagttgcccttatattcctcccaggggaatgtactatcataggtacacgtaaattttgggttttccaaccatttcttttcacaaaagcttgtgatatgaaagaatgagaagctcctgaatcaaatagaactattgcgggtatggagttgacagagaacatacccatcacaatgtctggagcatcctgagcggtctcagcttgaatgtggttcactcggcctcgaccaaagctgttggaagcacgagaaccttgtccacttgcctgagagctaggacgagactgagctgccgctggagtaggagttctggcagtgctgccattagcatgcccggagttggtgttggtaggattctgagggcactctctggcatagtgacccatctggttgcaccggaaacactgaactgctgacggtccctgcggtgacttgaaagaggtaacactgtttggcgcagtagtgccactaggggcacgctgctgtggccgaggtgccggacggttcatctgaggacgaggggcgtagcctggctggcagttagcctgagtgaccgactggtggtattgcatgggttgaccgtagcgagggcgaggtgcgcctcgggaagaatttcattgatggttagacttgcgtttcttgtattcttcgtgtcggtgacatggggccgagggtatcgtgactagaggcttgggtagccgcggtcacccacgtggcctgaccccctcgggggggtcgggcccgagggtgacgtggcctcccctccctctgtctccccaaggggtcgggccgctcccgtttcggccccgagggctggggcgcctcgaccccctgtggttttggcgccacgtgtgtgggttaggtaagcacagcggcgcccacctaaccgcatttatagcgggttggacgagcgcgccacgccgcatttaatgcggcgcagcgcacgcttatccggtccgtgaccggtcgcagtgtgtgaccggtcacagaccggtcagatcgcgggttaggtggcaacaggcggcctgtcacacgcctcgccccgtcccgtcggaatgatgagagtctccaggcactcgtccctagccggagccggcgtgctaactcctggagttggtatgtcagtcccggccatattcattccaagcttcatcgcaaccatggcaaggaagtcattgtatgaagaagggcagatgtgcggcatgctaaactgacgcgtggtggacaagaatgaccggtctgtgactggtctgacgccggtcacgtcatcggcagacaaccgtgctcccacgttgcatctgcttccggcggagtggaggtaggtatgacccatcccatcggagggttattcggacagcggctattgcaaatcttcatccattaatgaaggaatgacaggggtatcccctgtgtcaggcgagtgacggcgctgggcctcactcaaggacaagctgtgatttagcttccaggcgaaggcgcgagccaagttttggtcaagatagggtgggtctccacccacaagaagagtaggtagaagtggtgcatgtggtatccccttgagatataaaaggaggaccttgcccaccgaagtaaggggactgagagaaaaaaaagaggactgggagacgactttgagaatacctgagctcgtagaggagagaaagaggaagaggggttctagagtttgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacacattgagggtgaagaacctcacttagcgcccccggccgaaccggcaaagggggacctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgccgagctcgtactccaccgtccccctctcgccgaagtcttgggcgggaggaggcgctcgaggaggtcgaaagatccgcgacttcgccgcccgcgggtgatggagaaggacggcgagacggggaacgtcgcctcctcgtctacggcgatggcagcacgccccagggcgcgctctaggctgcgggcgcgctcctgcgtcacccgcccgtcgtccccgatccagagactccagcccaacgttggctagacgacatgaccaacttggtcatgacggcgcagcagcgcctaggtgccggcgggcggtcctccgccaccaaggcctctagcgctgctaccgccggctccgtgtcgtcgaggcggagggcgcggcgagcggcggccgttacccgccgttcgtccgccattccctcgtcaacgcctccgacccaagaagatgtgcgtggggggccggatgcccgcctcaatatcgagcgccggcgcaatggtcgtcgtgctgcccacgcaacggaggacgcttcctcgtccggagcgccacttcggtccgggcacgggggccagccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgagaggtcaggcgcggggttggctaatgaacttgccacccgcgtcggtccactcttgggaggatttgtgccagcagttcaccatgaacttccagggcacatatccgcgcccaggtgaagaagcggacttgcatgcggtacagcgaagggacgatgagtctcttcgctcgtacattcagcggttctgtcaagtccgcaacaccataccatgcatccccgcacacgcggtgatctacgcgttcaggggggggcgtgcggcacaaccgcatgctcgagaagatcgcctccaaggagccccagaccaccgcggagctttttcagctcgcggaccgtgtggttcgcaaggaggaggcctggacctggaactcctccggttccggtgtggcagctttggccgcccccgggtctgccgctcggtcagggcggtgggacaggaggaggaagaagaggtcggcccattctgacgacgagggtcacgtcctcgccgtcgagggcggttcgcgggccacccgaaaggggaggcctgcgagcgacaaaaagaaggaggccggcgctcccagcagggagcgcccgaccggcaagtggtgttccgtgcacaacacctccctccacgacctcgcggactgccgcgcagtcaaaagtttggctgagcggacgaggaagtgggaggaggagaggaggcaggagcgccgtgagggcaaggccccggcggctcccgccggcaaccggcgaagtgaggccaagcagaaggcccccgccgatgacatcgatgatggcgacgatgacctggggttccaggagcctgaggccaccatcgccaccgtcgatgggggagcgtgcgctcacacttctcgccggagcctcaaggccatgaagcgagagcttctggccgcggcccctacccatgaggcgacgcggcgggcgcggtggtcgtaggttgccctcaccatcgaccagaccgaccacccgccgtgcattgcccggggaggacagatcgcgatggtggtttcccccaccgtttgcaatgtgaagttggggcgtgtcctcatagacgggggtgcagccctcaacatcctttcccccgcggcctttgacgccatcaaggccccggggatggtgctccggccgtcccagccgatcatcggtgtgacgccggggcacacttggccgctaggtcatatcgacctcccggtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgaagatgtcgggccccggtggccccatcaccgtccatggcgacctcaaagtcgcgcttgcttgtatggagcagcgcgcggaccacctcgccgcggcgtccaagtccgcgggtggcgacgagaggctcagcacctccgtcccagccgccccgaggcagcggatgatcacgtgcgacgaggtcccggtcaaggaggtcgccctgggcgacggcccgtccatgaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccatccggagtggctggcaaacccggtcgtcgttcccaaggcgaacggcaagcttcagatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccatatgaacttattgttatacgacaatgcctttcgggttaaagaatgcaggtcctacttttcaacgtactactcgaatttctttgggtagccaaataggacgtaatgttgaggcctatgttgacgacttggttgtgaagacgcgcaaccaagagaccttactctcggatctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccagcaagcttagggatgtgcaatgcgtcactggctgcatggccgccctaagtcggttcatatcgaggctgggagagaaggcgctacccctatttaagctcctcaaacgctccgggccgtttacctggacggaggaggctgagcgggccttcattcaattgaaggcgtacctcagttctcccccagtcctggtcgccccggagccagatgagccgttgctactctacctggcggcaaccccgcaggtggtcagctcggcgttggtcgtggagcgcgatgaggacaaccctcactccgcgcatccccaccctgtgtcgactcgacccgggagagagcagggaggagaggcccccgaaccgaacggtggcccaaggcccccgacggccggagctggccctccgcctgcttgtccgacggtgccaggcgcccccgacccccaggatggccccggggccactgcgggaaggccgcgcctgtcgccctctgaccccgaggttgtcggcgcagaagccgagggcgccccgcgtggcctctcggatgaagagcgccctggagatgcggcccctggcggagaggatcggccccgccgaaaggtgcagcggcccatctactttgttagcgaggccctccgggacgccaagacccgaaaccctcaggcccagaagatgctttacgctattctgatggcttcgaggaagttgcgccattatttccaggcgcatcgggtcacggtggttacgtcttaccccctcggccaatcttgcataaccgagagggtactggacgggtggtgaaatgggcaatcgaactctctgagttcgatttgcactttgaaccacgccacgcgatcaagagccaggccctcgccgactttgtggcagagtggaccccagctcccgagcccgtctccgtccccgaggccagctcgggcccctcgcagctgcctcacaccgcctattgggtgatgcagttcgacggctccctgtctcttcagggcgccggtgcgggggtcacgttgacctcgccgagcggagacgtcctcagatacctggttcgcctcgactttcgggcgaccaataatatggcggagtacgagggactccttgcgggactcagggtggcagctggactggggatccgccgcctcctggtgttaggcgtctcctagctggtcgttaaccaggtctgtaaggagtaccggtgctctgacccgcagatggacgcttacgtgcgccaggtgcggcgtatggagcgccatttcgacgggatagagcttcggcacgtgcctagacgggataacgcggtcgccgacgaactctcaaggctcgcttcctcgcgagcccagatcccaccgggcgcctttgaagaaaggcttgcccagccgtcggcgcgacccgaccccctaggggagacggacgcgcctgaacggcctccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccaacggctctcaacgatgcggtcgacctggtctggcggtgcagggcgtgccagttccacgccaggcaaacccatcaaccggcccaggccttgcagaccatacctctttcgtggccgtttgctgtctgggggctcgatatcctgggtccgtttaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaacgaagaccttcaacatcctcaagaagcacggcgactcgtggatcgaggagctgccagcggtgctctgggcgaaccgaaccatgctaagccgagcaaccggggaaacgcctttcttcctcgtctacggcgcggaggcggtcctcccatctgagctcaccctgaggtcccctcgggccaccatgtattgcgaggctgatcaagatcagcttcgcagagacgacctcgactacttggaagagcgaaggcggcgcgtggccctccgagcagtgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcaggtctcgggctcgggccaaccccgcaccaccccccgggcgtgcagggttggccgggggctaccacatgcatatacttatcttttttctcttccgtatttcaataaaagcattttcgatttcctaaggactgtgtctgtgccattgtttccttttgaagaatcttggcttgaattagcacgctcgtgctcgatcctgccctcggtggcccgggccggctaaaatcgccaaaaggggcccagaaccgagccgtgccccggggcgtagtgaactccgggggggaatcggcaaaggcccacaatcgggtcatccataaccctcggtcaccacgctcccggcctggccagtctcgacacgtggatctccccaggcactagccccgacccgcgccatttgaggctgagacctgggcacgagcccttgttcaagccaagacacagaaggaccgcggcacagaccatcctcgtctcatgcacacaacaaacagaattgacgcagaaatttcctctttatttgattgcagattaaattagtctatacaagaagggggcccgaaggcctcggaagaagaaggaaaagctattaagattggagggggcctgggggctcactccgacgcgcccgggtcgccagcctcgtcgtcgttgtcgtccgcaccgtcgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaactcgtccagcgctgcccacggggagaagtcagggtccctggcctggtagcttgccagtacgagctccaccgcccctcgggcaaggtccctcgaggatgacttgatcgtctcctcgagctcctcggggagccgctggagggtcccggccatctctgagaggcgctgggcgaggcccccctggttggcggcgtatttcgcggtccgcccgccccagaggcccgcctgccgcccggcgcggtctagacgggagagggcgtcccgaagcatgccgggccctacctcgcccgccaagcgaagggcctcgacctccccggcggacgagtccagcgcgccctgcagctcg

SEQ ID NO: 69034 - DNA, 30632 bp, Oryza sativa
ctccgcggctatcctcctcttgttctcctcgcgtcgttcgcatcagccactaacttcacctacatcgggccggccacgtgccaatccgccatcctctgcacacccccccccccgccgccaccgcctacatcgagcccctcaccagcttcgagaacaccaccctccacgacctcttcggatggggctcctctaactttaagttagaggagcctcatccgaagaggtcgtggagggtggtgttctcgaagctggtgaggggctcgatgtaggcggtggcggcgggggggggggtgtgcagaggatggcggattggcacgtggccggcccgatgtaggtgaagttagtggctgatgcgaacgacgcgaggaagaacaagaggaggatagccgcggaggagaatgatggcaccatgataacaatagctataggctatagatagccacgttgtgtttgagaggtgaggttgggaactcacctcacgcgcacgtaaaacgaagtatttacttatgattaattaagtatttacttttataaaaatgattaatatgattttttaaagtaactttcgtatattttttttcaaaaacatatcatttagaagtttgaaaagtgtgtatatgaaaaaggaaaactcacctccgtgcacgtaaaacggagtgacgtattttcttatgattaattaagtttttttaaaaaaatagattaatatgattttttaaagtaacttttatatttttgcaaaaaaaaaggtatcgtttatcagtttaaaagcgtgcacgtgaaaaacgagaggtgtttcgagaacacgctgaaaaaagaacacagcagaagtgtttgagatggccggagctagcgtacgtacgaacgtgtgcagaggtgagctagcacttcatgagagatgtttggttcttcaccggggacaccgcaacacgtcaaagtactactcctatagcgcaactgtacatgcgagtggggtggttgcggatggccagcaatagtgacgtgacggtgtcaaacaacacgtacgagtgctcagcggttgcacgatctgagctcagcctcagaagtcagaaaaatcgaggaaatttgtgatttgtacgatttttccgtcctctggtcgagtccactctgcgaagtctccgtccactagaggataatccttcgacctgacggatttccgaaaaattgtttcccagagtcactggtcaaactagctagtgtagcatggcaggaaattgaactgcctaggtgtgtttatagttatttgggtgtaaaatttttgaagtaaacatatacatatttaaagtattaaatatagactaataacaaaacaaattacagattccgtctgtaaactgtgagacaaatttattaagtctaattaatccattattagcaaatatttaatgtagtatcacattgtcaaatcatagcgtaattagtctcaaaagattcgtctcgcaatttacatgcaaactgtataattggtttttctttcaatatttaatgccccatacatgtgtctaaatatttgatataatatttttggctaaatttttttggaatctaaacaaggcttacaatatccattcatatgttggctagctattagttcactttggactctttttgagttgggtctatctatctgtcaagtggctgcagagcatcaccgcaaaggtgacgtactaccactgaaaatctagaaaattttaatgcaatgctgtgtattctagtgttttgaagtgagatttcaatgccacataagctcataatatctttcagatagcgtactttttttttctcgatcaggtccaactccaaattagaatgtcttctattatctttagtacatatggccataaggcccgaggcccgacgacccgacccatgcttggcacagtacgactggtttcgggcacgtgccggcctagcccgatagttgggtcgtgctaggccaatgccttggcacggtgagtcggcctcgcacgccatgatcaaaggaaaatagttgagggacccaaaatagacttgaatcggctatataaggcacggctcaaagagaacagggaagcaaaatagatttactccagccatatatgacatagcacaaagagatgagggaggataagtagacttattctatggagaagaacaaggaatatgtttactttagatccctcaatttgtcgtccaatctgaaattcgtccctgaaccacaataccagatatgatatatctctcaacttctaaaaccagcgcaaataaggtcccaagacggtttgggcagtagtttcggctgacgtggcgcctacgtgacattgacatagcacttaaagtcccgaaaaaggaataattaattatttttcattcttacgagtggtgctaaatgatttaccattggacccacacgtcatagacacatgagagcccatatatcataggcagcaagtggcaaataattaattgccacatcttaaaagtggctaaaagttaaatgtcctaaagaaaaaccatgaaaaccatatgtcagtgagtatccgattaaaataaaaaatacgcagtgggtcccacattctttccttctctttttctttctctttgctgcttcttctctttcccggcatccagcggccggccgccgccaggctagcgtccttctccgtgccaatgagccatggggtggtggagaggaggggaccttggtccgacgggagacgccgctgccgggaccttggccgctgatgctagggacctcggcggcgcagcagggttcactatatcgatttagggcttttgatcggaggtcaccgaaatcccgaaatttcgaaaatttcggtctaaaattttgaacaaaatttagttgaatttgaacaaatattaccaaatttatgaaaagattgaaaaattgaaaaattttgacagaagtaatatcatatcggaggggaccgaaatttccgaaattcctgcggcgcagtagctaccgtcgacggagacggactagctggcagtggacgcagtggtgccgggtgcgggcgtcgctgtcctgcgaggaccgcccggacatcgcccggacatttgctgcgcttcagctccacgcgcgccgggccgagatcaccacgctctttggccacgcctggagcgtgctcctcatcatcgccgacgagcagcagcgcaacgtacgacgacgtccaggcctcgtccatgccatcttcttcgctggatgcatgattggtcagtgctgtaattctcgtgcaaaataccttcgtttcctacagaaaattccatcgtgttaactcagacaaagtgacaaactaccgcaatgccatgatagtaggattatgataacaaccatgccttaggccttgtttctttcagcttgggattattataattagtttattataatctggagtccaacatattataatctgataagctcatttaggtaagctttttccagattattggatgaaaaattacccaccatgccaccccactccttttttagacatgcaaacccaataatctaggctctaataatctagaaaagaaacaactaaccacttattctaatacagattataacaatctagtttatagtaatctgactcaataatctgaattataataatcccaagctgaaagaaacagggccttaattatggcatcgacatgtagaattcggacctgagagagatagaggggggcagtacgtagtacgagactaatctctgtaacaaaatactccctccttccttaaatgtttgacaccgttgattttttaaaacatgtttgaccgttcgtcttattcaaaaactttagtgaaatatgtaaaattatatgcatacataaaagtatatttaacaataaatcaaatgataggaaaaaaattaataattacttaaattttttaaataagacataaggtcaaagatttttaaaaaaaagtcaacggcgttaaatattttgggatagagggagtagcattttcatattagatggacgatgcattgagaccggtgcgtcgaggttctactacgacagcagccggaagcgcctgaggccggcgcgccagaggcggcgagaggaagagaaggagaggatgaagaagatgataaatgcctctagcaaccacgccgaggagaccagcacaaagcgcccgcagctgccaccgcccgaacttcccacgcgtgccatgcactcgtgcctccgccctccggtgagacgtcacgcactcaccattgttgtagttgtcatcttgtcgatgcttttgcctgacggcggcgatgcccgatgcatcccatgaagaagatggcttggacgtcgtcttcgtgctgctgcttgtcggcggtgatgaggatcatgctccggatgcggcggccgatcgagcatggtgatctcggcccgacgcgcgcgaagccagagcgcggcgagcgctcgggcgatgtcctctcatccgggcggtcctcgcagcacagcgatgcccgcacaagagcatcccttccgcatccaccgccgtgtctactgccagttgtccgcctccatcggcagcagctgctacgcagccgaggtcccggcagtggcggctcccgtcggaccgaggtcccctcccctcccccaccccgtggctcgtcggacaccggcctagcggctggccgccggatgcctagaaggaggagaagcaaaaaagagaaggaaagaaggaaggtgggacccactacatattttttatttttaacttgataccgacttacatttgggtcccacagtttttccttgaatataagtaccacgtagatgttacgttagcttaaaccatcatccaaatcattttgggaccttatttatactggttttagaagtggttttagaagttgagggacgcatcatatgaaattttacactttacgacaatttgagggacttggagtgaacttattcctttttcgtgtggccttgttctgtcgaccagttggttgggttttaagcccactacatgaagctgacaaaagtttatttaacaacgccacgtcacaagcctcaaacctgaggccattgttttccaatttccaagacgcgagatcgagtgatcaaccgactggtctgtgcgctttttcatttttttttaattacacagtagacccacacctatacataatatcatactcataaacatgtcccataaaacatgctataagagataaaaaccaactgtaaatctctaatctcactaaaattatattgagagtttgtatatgcgtaatatttgtggacaccaaaattcatacacctaagaccactggttgttttgctttgcaccttttttttttgcgttagtaacaaaaatcagtgtgtatatgtatcgtatcttgcttctttctttgctgactatgtttggctacttttttcaatgtgctttcaggcacccacccattgttgcgcaagttcttgtcaaataaatttggaggctaaatattgttgttttgattttcaatgcaaccttctcagagttttgagtctctggaatcaagataggcaagtttttggggtttgagtactttttctttttcataatttaacgacaattctcaatgccgcaggaaaacgcatacagtaaagttatcgagggttctttgtaacatatgattcttaaaacataaaaatagtaaagttgtagggtttagggtaacccctgttaaaacgcaagaatcctagacctgctaaaccaaggaatgtaacccctgttttaatcattaataaagctctctctttcatgtaaaaaaaaaagaatgtctgaatcctaatgaacgaaaaatagtaggaaaaccgtttgaatggagtaatttcaaagaatcaaagggatctaatccttcgatccaaataatctcatatattcttttttattcttatgcgatctaaatccttagggcattcacaatgcgtcccaattttattctgtttctcgtgtgccacgtagacaaagaacctcataagcttctcaccacagtgcaagttaccttgtaatgggtctcactagtacctactttatcactttagcattttctttcctttcctctccctcctcttttcctttccccaacgcagagaaatcgccggagatggcgatggcgctgggccgagcggcgaaatctccggcggagcagcggcggggtgccggcgctcgccagcgcagcatcggcgaggtcggcggtgcgggagcggcggacgggcggcgacggcggtagggcggccagatccgcctccttcgagctccccccaagcggcgccggcgtcagcggtgtaggagcggcagacgggcggcgatgaccatgggacggccagatccaccctctccttcgagcggcggggcggcccgacggcgatggcggcgggcggcagggcgccacaaacgccgacggagctgggcagggggcgcgccacgagcaccgacggcagcaagcgacagggcggcggtgctgcccgacggcgacggcctctggcggcgggagcgagggagtgcgagctcggcggtcggcgcggaagcgggggacggcgggcggcgcggatcgacctgccccgtgacggctggttctctccccgcgtcggtggctctcgcctctcccttctccggcgcctcctctctccgacagcgttgggtggaggaagccggcgagattctccagccccatcgctttccccatcgacccgacgagcgtccggcagccctcctcccctggcggtccgacggcgacggcctctcggcggcgtggagcgcatagatggtcaagtgtggtctctctcctccctctccatgatagcgccgagcaggagtatgggccctggcgcctgcaaacttgacgaggaacgcgtagctcaaattggctccgcggacctgaggttgttgcgcggattgaggacgtgtcgtcgaatattcgttttctgggagcgaggctgaatgccacgtcctcccactgtgaatgcccttaaaagttctccggtttttctaccaaaggggcctgatcggcgaacggcgagcgcgagtgatgacgtggcgacgccgcagatcttttctcgcgcgccgcaagcccgcaactgaacagcgcgtgtgcgcgtggaggaggacggcagcggcgcacgatattattgttccccgtcacagcgcgtggactgatttgcccctgggttaggcgtcttatttacggacccctgccatcctggatattttgctgcctaaccagtacccactggcctttggaaggttctggtcactcgtccttctctttttctttttttttctttttttttcttttttttttttgcgtttcaggggtttggtgttgggcagcagacagctgcagccacgtgagatgccttttattagcaaaggttggcaggttgatggtacatgataataggaatagtttttgataattgatactttatgtgatgcttttcaaaagctacgtgaagaaattgttaggaattactatggatacattttggttccgtgtgatgtctaacatgtgttttttttgctatttttcttactataagatttgccgcggcgtgaaacttcgatatagttggaagtggtaaccagccaaatgttgtgttaatatctgttacattgccggaaaagttgttttatcaagcagccgcagaacagacggccgaacaggcccaatctagcaaagaatgaaatcttatacctagctttgggataattaactaggtgcataacctagcaaaagggagaaaattgtgaataaattttgatttgagcaggtgacaagctatgttgatatggagataccatgttttgctatgagctactactattctacaagactacaataaaggacaataaaagactatgaaagtgacgtagaatacattcttattagattagttgttaccgagagacaaatcacattgtactaggaagatattagatttatattcatgacgtgtgatatagcatataggtttatcatgtttgctaaggttttttaatattttgaattgcttacgacattgacttattaattaattttgttcatgttacttattttccttattatcagattatgacaagactctgcacctaacttgtatgttaagcatttttatatgatgcttgatatttatattactcaattgacaaacaacattacagtctaattataatacactgtattacctttaataactttacgcgatatatagtgatcacaacgacaacaacaaaaaaaaactttttaattaaaatttaaggtagccatccacatgtacataagatctggggtttggctgacctctcgttaggcgtttaggtgcacaagtggacgccacagaatgaatgatatataaatgatttctcccaacagtgactccgatgtagacttggaaatctaattgggaaaaaagagagagaggatattttggttgctgacaagactagcgctattggtacatgatattttccaaagtttggatgagtagctttcagattggatggctgagatattctgcattagttctggctggaatgcgtacagatgtatctgcatggaatcaggatcaaaatgttccatcttaaaagaaacatccacacaataaacttatattcgatgaatcaaactacgaaaataagtgtgcatgttataaacttaatatttaggtattgtgttgtattttcgatgctgaattagtcgtgtccaataaacgtcaatgagaatacttcttttatcacattttctctgcatgtgtaaaaaacataattgagattcaatcaagtggcatataaccgctagctacttctggaatctttggcttaaaccgttcaaattttcacttagattctaaaaatttgtagatattaaatcataagctaataaatctattttttaattctaactattagttatccaccatttgcttcgaaattgcttcccagaatttcgagcttcccaaacaaaccctaagtcttttatttagcgtacgcaattattagattctactatttttttgaggggtaattaaatgctctatgcagtactctagtacaagaagaaaccaaattttcactaatccctctagagcaagttcaatagtagactataaaccaactatatacttatgtaaaggagagagaacaagggaaacgatgagtcccagctcttatgcaagagataactatacacattctcgtaaacaaataaattaattacatatagagaggagaagaacataagatacaacctggtaactaacggtcccgtcatcgtttggcttttccactaataagccaaaacagtttattagagaataaaaataaatctgtagacaaaatttttatatatatgttttttctgacttaaaagccaatgctgaaaaagaaactacattgaaaatatctcaaaattaaatttaaaaatttaaattttgactttttcttgactaattaggccatccgatgggagcctaatatattatatatatgttaactcttagattaatttatagatagtggtttgctctacttttaggctccgttcggtagtataagttcccaactcctcctcgttttccacccgcacgcttttcaaactgctaaacggtgtatttttttgtagaaagtttttatacaaaagttgcttaaaaatcatattaatctatttttttaaaaaaaatagctaaaacttaattaatcacgcactaaaacgctgcttcgttcccaaccctcgcttccgatcagagcctaaacttgctcttagatttttacacccctaatatctggtcttttcctataaaaaaaagagagaggtggagagggaaagaacaaaaaaaataattacgctagtgaagctgacaatctgaagatactctcccttccactccacgtctccacctctctcacgagtggaaaaagcaaaacaaggtgcgccgttggatgcttccccctcccccccaagtggcccccatccgtgcgccgtccttttgccgcccgcgcgggccccacccccaccaccaccccccgcgagatattttggtggcagatcacgtaattaacccccaactccctgccccttctcccccacccaccccgcgcggatataaaccccgccgcgaaaatatctcccccaccgtctcatcccagctcagctcagctctgcctccgccatttcgaagcacatcgaggagagagaaagttctagagagagaggagagaggagagatgtttgatgcgggggatcgcggcggagccggcggggtggtggcggtgaagaggatgaaactgtgcgaggaggaggaggaggaggaggaggggatggaggtggatgaggaggaggaggaggtggggtgggtgtggaggccgccgggggggctagcgggggaggatgaggcggcggcgtgggaggggagggcggcggcgatcgtggtgtcggacgcggtggaggtggatttcccggtcatctacgtcaacgccgccttcgaggccgccacggggtaccgcgccgacgaggtcctcggccgcaactggtgagccctcgtgcgcgccctgctcttagctgttccccgatcgatgccgctctgctctgatctggtgtggttggatggggatggcgaaatgctgcttgttttttttttttggtgctctcgattcgattccagctcgatatgttggcgagattgatggtggttgtggatggctgtgttgttgaatttaatgagcttttgccgtgcagtcaaaccttgagattttaatgcgcatttgttagaattagggggttcctgtacaggcgtacggtgcagagtgcgcaccactctgtctctgccttaatgcttgcaattgcggcgatgatgcgtgattcctgactagttgctgtaaattttagcattttatcctcacttttgattggttgttttttttttttttgaaatttatagatgggtatcatgccagtatgagatttagccagaatttgaagtgtactgtttctgttagaccatctgtattttagagccaatctctgagtaatggtgacattgttgatttttaatctacacattaagcacagcacgagcaagccaacaatcgaagtaaattgtagataatgttgttcaagtacagtaaaagcctgaaaggtgcttacgcgatctagtttggatatattcatgttattgctaaatttatgaaatggcttttgaaacaaattttgtgtatggaagttctatatcgcatatttgcattggaccttagaggcgaacaacgaaatgttcatatattctttctggctctgggtcatttttgttttctggtgggaagaggctgggcaagcaagggtgatggctacccgttagatattttcccctgatatatcttctcttctcttgctctactaaagtagccacttgcacatagaaaaagggatgatggaagaataaactgtagcatatattgtgaatataaaatgagatgggtaggccattaattggaatatagcacagttgtctgtagcatgtgggtacaaaaatttacaacagggagcatcacggttttagccaggcctttttattttttaccaccgggctaccaattaatacttagtaactttagtcttccattggcatatatcatatttagtggtcgcctgctagtgctctaggaggatatattatactggattagtaagactttttcctcctctcttggatggtactggaaaataattaactatgaatgtattcacatgacaaattaacattgaatttggacaccaactgtgaaatttgatccgtattaacaatatggaaagctattattggtgacaaccttataagtgtactacagtactacacctgcaagggttttcagttgacaagtagctgattatggtcagtttcagaattcggaactcaattttgagcataaatggaagttctggatgtaatatgaagataaactttgagaaatttgacttgggttgtaaatgtttgaacttgattttcgtgctgtactgcttaaggctgtcttcaggaggcaaggtttacctcctgacacggaaaacaatgtaagcgattagagcgagattagttaagtactagcctaaaaaaaattaaaaaatggattaatatgattttttttaaagcaactttcctataggaaaattttgcaaagaacacaccgtttagcagtttgaaaagcgtgcgcgcagaaaacgagagatgtgagttgggaaagaaggggaaagtcttttagggactcattccgtaaatgtcgttttaccattttgtggtgatttgctctaatcgtccacgtcgaatggtaaatattcttgtgtgcagtctgcacaattagcctctcttttgtcagattatgaaaattcttgaaaaacaatttattgaattgcttacatgatgcaagaacttgtctcttatattacattttgacatatcatgccatcacaaacaattccaaacatattaattttatttccaaaagattcattggatgagtttagttaaacctgtgttccatcataagtactccctccttccctaaatgtttgacacggttgacttttttaaacatgtttgaccgttcgtcttattcaaaaacttttgtgaaatgtgtaaaactatatgtatacataaaagtatatttaacaataaatcaaatgataggaaaagaattaataattacttaaattttttgaataagacgaacggtcaaacatttttaaaaaagtcaacggcgtcaaacattttgggatggagggagtagtttggacattcagcaatcagcataagctctaggcattggctaacataattaagtattcaatgtagggttttttttttttttttgcatttcgactaaagtccaacaaagcataaaaaaaatagctggactagtttctgcctaatgtttagcaatgttagcaattagcactaggttaacagaatacatttgaaaccaaacaaaaagccacattcttcttcgttgtctgcgacaaagctaatagacaaatgcatgttctctatgcttgaattgctgttattctactatcatttttcatttatacgagttgttcaactgtatcatatttgcatcaagctaacagtgacataacttgacagagggcctagagaagcttctcacattactctgttgactcaaacttgtttcagccgattcttacaattccgggatccacgtgcccaaagacgacatccgcttgttgatcccatggttgtttcagagatccggcgatgcttgaatgagggaattgagttccaaggtgagctattgaattttcggaaggacggtgctccactgtacaacaggctaaggctcattccaatgcatggggatgatggttttgtgactcacgtcattggaatccagttgttctctgaagctaacattgatcttagcaatgtatcatatccagtgtataaacaacagtccaaccacagacccaacattcaagagatcaaccctgcttctcatgaacatattcctaagattcaaagttccgagtactgctgcatcctccagctctcagatgaagttctggcgcacaacatattgtctcgcttatcgccaagagatgttgcatccatcggatcagtctgcactagaatgcatgagttgaccaagaatgatcacctgagaaagatggtatgtcaaaacgcgtggggaagagacgtcactgtgaggcttgagatgagcaccaagatgttaggatggggtcgtcttgcaagagagcttacaacccttgaggcagcttcatggaggaagtttacagttggaggtcgtgttgagccttcccgttgcaacttcagtgcctgtgctgttggtaatcgccttgtcctgtttggaggtgaaggagtcaacatgcagccaatggatgatacctttgtgctcaacctggaatctgcaaagcctgaatggcgccgtgtcaaagtttcagcttctccacccggccggtgggggcacactctctcatggctgaatggctcatggctagtggtctttggaggctgtggacagcaaggtttgctcaatgatgtctttgtccttgaccttgatgccaagcagcccacctggagggaggttgcaagcgagggcccaccattgccgaggtcatggcacagttcatgtaccctggatggatcaaagcttgttgtctcaggggggtgcactgaatccggtgtgctcctcagtgacacattcctgcttgacctcaccaaggaaaaaccagcatggaaggagatcccaacatcctggtcaccaccatcccgcctcggccacaccttgtccgtctttggtaagaccaaactcttcatgtttggtgggttggcaaagagcggctctctccggctacgctcctgtgatgcctacactatggacgctggtgaagacagcccacaatggaggcaactggcgacaaccgggttcccgagcatcggtccacctccgaggctcgatcatgtcgcggtcagcctcccctgtggacggataatcatattcggtggctccatcgctgggctgcactcgccctcacagctgttcctcctcgacccagcggaggagaagccgacatggaggattttgaacgtccctggccagccacccaagttcgcctggggtcatagcacatgcgtggttggcggcaccagggttcttgtcctgggtggccacactggggaggagtggattctcaatgagctccatgagctgtgcctcgcgagcaggcccgacgaagatgagtgattcccaactccattgcttgttcttatttatttagatcctatgattattactgatatctgttgttgtcacaaccctatgtaatagtagtaaaaaagaaacaaaaagaggattactggtagttttcatccttagaagttaggaaaaagatctgaaaaaaaagttatgaaataaaggtttgttctagtttttttttttgttttcttcagtttgcgcatatctctgctccatatgttctgatgcaatttgtgtcaatgcatgtactacccattagtacatgttccattgttccaaagcacacatattcttggacggttatagataaaaataatctctcttcaagtacaagttagcgaggacttttgtaggacaaaacctgcttggagatatgccacacgtgtggtaatcttgttcttataaatcttaaggtttgtgtacactctgtgctgctacctgtagtaattaaacatctataccagcatctctgggcgcttgtcgaggcggcccgaaaagcaggtaccaaaggagaaggcagaggtatgaggtatccgatgtgcagattatatatttgcggcgtttgctatctcggtctccgattcaaatgcagcgaatcacggacaccagcgtgcggcgagcgaggtgccgcccccagattgtgggcatcagattctactgctaaacagaaggctgcatatgtgtgctgctttcaatggagagggacatctttttttgaccacaccccaccgacgtccagcttcatcagatcctgtgattctctctgagcaagaagaaaagaggagaaaatcagatcatgttatctcaagtctctgaaagaagaaaaagaagagagaatcggtgattcggtgcacaacgcgccccgagctttcctccgggtcatgatgctctttggtgttcaagggcttaacgatttgtaaatgttgttagggacaaaatcgaaagaattaactactataatttataaagttgataatcagatttaaaacagtatttaaaaatattatatataaagttcacgaaacgtgtcaacctgttcatccgttcatcagaaagctggcagacagcccagaactgggatcaccaccagaattcagaaagagtaggaaagattttgctacaaacaattccaggcttgtcaccatcgaaacaagctggcagatagcccactggtcaaattaacagaagcagcaatgtcatgagattacggtgaactcaagcatgtcaccatacagacaatatttttttgttctctaaaacgagttaagcaagccaggtgaataatgtcttggaccaaagaccctgagacaggttcaaccaaacacttccaagacggtcatacaaacatactgaaaatgtcttgtcaaacatggttaatataacagcattctaacagtgcagaatagtagggtttttcctgtggctggcatcgtggaacaagaaaaccaggatccagccatcatttatcaactgaacaaaagcgtgacccagaactacttaagtaatttaagaacatcatcgtctcctccgcgatggtgcgacgacagttcgtgtactagaagatagctactgaaagccgaagacatcaatgtccattgccccaacaacaacagatggtgcatcagactggcgtccgaattcatctcactgatccccaggctcttttggagctgcggcttccttgatttcgtcaccaccatcatcctgcagaaaagagaaaacaaaaaaactgatatcagaaccacgaagataggacagaaacgatcaaatggctcaggaaactcacattggcatctgaagtccacagagtcaagttgtcacgcaggagctgcatgatcaaagtgctgtccttgtaggattcttcaccaaggctgtccagttctgatatggcctcatcaaacgcctacaagaaacatggattcattcaaatcatatgttccgtgttctgatttttaagtgaatgtcaaataaaatatgatcacactattacttaagaacagaaacaaccttcgcatcttatatagctaattctacttatttgaagcaactagaaatgtatcagcacttagaacgagttagtcacaagaattctatcagcacacagaaatggcataattctcacttctttaccgttccaagctccaaaacaaaggtacactactttaaccatttggtttaagattgtgaaggttcaacatgatgcaaagtctaaatggaacatgcgaaatttctgtcaaaattataacatgggtatatggcaaatgaaaattatatagacacaaattacaagaaggaacatcaggagaatcaagaaaataaaaatatcaaccatttgatcaacatcaccttgaaagtttacagtcaaaatgtaacatataagttatacatcattcataaactgtatctcgtcatgaaaatcagccaaaaaatgcatccaacaggtgccaagggatttgaatagtacgttttgggatttcagctacagaaacaacctgattgcagcttaagtttctagtataaattaatttatcattcatgcactcacaaagtagcatatatcttcagaatgagcaacatggatgccttttcgataaaaagaaatgcaagtacaacttccactagaaaaagtcagctttcatgcttatcaaaagcaaagaaaaaaagctccattcatccaccatgatatctccagtataaccagtattccagtagaaagcaggtccttaatggtacaaaatcaatagtggataaatacttggcatgaaaatatatcatacaaagaaatgtacattgaagatgcatgatgcaactaacagaatagaaaattaaaggggaaaatggaagtggatgtagaagtagagtaagcagacctgcttcgcgaggttgcaggcacggtcaggggagttcaagatctcatagtagaacactgaaaagttgagtgcaagcccaagccttatggggtgggtcggagccaaatctgcgagagcaatgtcctgccaacacacgcaaaacaaaaaactaaattcaaaccacaagactaaccaattaaccattgcatccacatgtacaaaaaaaaaacatattatcacaaatccaacctgagcagccttgtatgcattcatggtgctctccgcagcctgcttcctctcgtcgccagacttaaactccgcaaggtaccttcacaaatcgtcaccaagagaaatcatacatccatcaagatgaaaaattttcacacctttaatcggtaccaaactcctaggcagcgccaagatccccaagaatatgaagaaaactagcattcaaccgctccattaacagacatcacatctaattctgactttttcaccgccaagaggaaatgttaacatcatatataaagaccacgacttaaacatagacctgtacagtaacaagggatctcatacacctatcaacccataaaaaaaactaccattagatcttaaatttggacctgcacaactcaaatcaaatcctaccgtacaaccttaattaacccagagaccaatcatataataaacaaaggaaaaaagaatatcctagaagttaatcacacccccaataactccctacatgttaccttcaccgacctaacaaatcctcctatctcgaattcttggtcgattcgccgcgcgcacatactagatcaaggccatcgaatcttacctgtggtagtcgcccttcatcttgaggtagaagaccttggactcggcggcgccggcggaggggacgaggtgggagtcgagcagggccaggatgccgtcgcagatgcgggcgagctcggcctcgatcttgcccctgtaggagcggatggtggcggcgtgggcgtccttcccgcggccctcctccttctgctcgacggacgagatgatccgccacgacgcgcggcgggcgccgatgacgttcttgtacgccacggacagcaggttccgctcctccaccgtgagctcctccccgccggaggcgccccccgccgcgcgcgccacgcgctccatgtactccaccatctcctcgtaccgctccgcctgctccgccagcttcgccttgtacacgctctcctccctcgtcggctcgccggcgacatggctaactgcctacctacctacctccctctcgccttccctctcctcctctcctcgtcggcgtcggcggcggcggctgcggctgcggcggcggatgcgaacgcggctttggtggggagggggaggtggggattcatttgaggaggaggaggaagggcgtgggtggagggtggggcccgcatgtcagtggggggacacgtggcggtcaaggggagcgggccgtgcgcgaggggagcgggtgcgggcgtgtggctgggggggaggtgggttgggttcgggggggacacgtggaggggttttagtgggtgggaatggtgtttgctgtgtgtggacggtgtgggtatgataaagataggtttaggttttttttttttttgcgctctttggtgatttggggtttttgctatctctctttttttaaaaaaaagataatattgtagttctggttagctggaagtctgtttttagattttcatttagtgcaaatgtatatgtatttttttaaaaagttgttttataacactacaattataacaacttttatgttggtggagttgtaatttatgttgtgattgtcttaaaacgccattgcaatattggccataaactttatattatgtatagtaggatgttttcttcatgcgtgcttgtaatatactccatccgtttcacaatgtaaggctttctagcattgcccatatacatataggtgttaatgaatctagacacatacatgtgtctaaatgaatgtgagcaatgctagaaagtcttacattgtgaaatggaggaagtagtaaggctctcctattatttttgctccttttatcgttagattggcttatggcttcttccttgcttgttaattttccataacctcaagtagactgggttatttatttatatctaccactaagaggaggaggcagggcgaggagaaagatgtgttggccgtaaggaagagggagtaaaaggtgaagtagtctatcgtccttggaggcagtgccgtggacagcgtgatgacgataagatgaggcggtttgcagcttttttgttttcacaacaggggcgtgggagagtaggagcccaggcctatttgtgaaagaaggtttgcaacatctccataaaaatggaatggctcatgcatatttgtttcatgacgtgacacgataattttgcaagaaactttagtgattcagtgttctagataagatagctaaaactaagccaactattgttttatagcgtccgtgtaaaacaatcttctcacctctaaaatcagatatccaacacccctaagctattcaaactattcaatttaccccatgtttaaagtagctgtgtttgcctatatatcattgacgtggtgaaaaagtctaccacatcggctaacatcaatgtttggcgatgccacaaacaaagttatgagatagtaagaagtaaagaatgtcatatttgaaaacaaaaatgaaagaatatgctatatggaccgcaccataaaaacacagttctgagtttgtactcttcatatatcttttactaaaggacacaagctgacttttataacagaatttttactaggatgaatgagccaaagtggacacaagatcttgcctgccatccacatgaaaaacaaaactattcctcttcttcttcttggattaaaagatgatggatgggcccaggaaagaaacctggcctagaaagggccggccgggaccggagcatccgatctcctgtcaaaaccgacgcccatcatgatccatgaacaatgctaccctaatcaatcaacatgcatatgcaagcatggctaatggtcccacggagagatcgatcaccaacccgaccggctgaccccacatccatgcatgcaatgatgcaaatcagcatatacatgaatacatccgtccatgcggttgagctaacaaaatgatgaaacgagatgatcgccagattaatccattgtttacatgcagccaaagtacaatgacagttgacaaccttcaatctgcaggcaataatttacacttttcttttaaataaaccttttttttcctcttagaaattaaaccgaagctgtgagcaagagcacatcatggtcagttcttggaagtcttttgtttgacacacacttgaattgctcccattttttcccaaccaatttgccacctaccatgcctatctgcacgcacccgtcgcgcggtttattagcctcttttctcctgcgaatcacggcgagctgatcagcgattaggcgaagcaaacgtaccaaattataatgggtgacgcccagcggcggcagcttctcctcgtcgccctcatgctcgccgccgccgcagaccactcgctggccggcttcttcggcggcgcgccgccggcgtctggtcccgccgccgccgccgccgacaacgacgaggtacgttagagagacatagtatcgttaattactggaaaggttaaagccggcgatttcgttggtcgatcgttctggctaattctgatgttcttttcttgtttcttttggctgatcgatgatgcagaagtgcagccggacgtgcgagtcggagcactgcctgggcacgtatgcacgtacgtacgtatatatataccactctccctggccgatcgataattataatttgtcagtttctcttgctgtaatttgtgttgtgagcaagtgttaattgttgtgaaatttgcgtgttgcgtgtgcagaggcgccgttgatgcggtacggcaagtactgcggcgtgtcgtacaccgggtgccccggcgaggccccctgcgacgccctcgacgcctgctgcatgctccacgacgcatgtgtccaggccaccgacagtacgtatccacaccaggtttaatgtttggtgtgctcgtttgtatcggggtggccgaaatactgaaattttgaaaattttggttcgaaattttatgaatttttgaataaaatttgacaaattttgaacataatattatcaaattcaaaaataaaaataaaaatttcggccgaaataatatcgtatcaggggttccgatagaaccgaaattttgaaccctgaattccacaccaatctttttcacttatcattttgatcattttgaacatctacacattgggacaaattcaaatccaatataagattagagagagggagcttgtctcctcctttctccctcagcttcctattgtttctccctccctcttttcttctatcaacggtgatccaatagaatagagccggaaaactcgatcgagttctcctgcactcatgttggatccgcacctatcgacatacggtgtaggggtgaaaacggtcacggaaattcccgatcgaccgggcgccgtttccgtttaaggggtaccgtttctaaccgtatcgtttttgactattttttaattttgttttttctaatttcttttcgcatcgtattaatatcgatactaagtagtttaaatgataaatatggtcaattaccggctgatcgagcatcgtttcagaagagatgctaccgattccgaccgtttccgatcgttttcacaccctaatacggtgtacactgataacgggatgtgtctgtcgaaattaatgcatgtgtgcagatgactacctcaacatgctgtgcaaccagagcctgctggactgcgtggcggcggtgaggtcgccggcggcgaggatcaggacgttcgaggggaaccagtgcaacgtgacggacgtcgccgacgagatcacgtcgctcgtcgaggccgccgtcttcgccaagaggatcctgcataggccgtagctttaattagctagcttgtagccgccacatgtaattaattgttgtttttgctaattaagctgctactgtgcatgttgtctggcatcatagatcgatgcacattgattaattaattccagtcgtctccggatgctacaaaaatcgaagctagagagtacagtaagtgtagttggagttggtgatctccctacacgtgtctagtttgcgtaagcaaggcttttttgttttctcttctttttttttttgtcatatcctcgatcgtcaacttgttcatgcacatcaatctcagatgtgctcgcagttagcacgtgcgtccgaatcatgattctgctcggaattcatttttgtgaaggcccatgagaacggtatttacaagctagtatattttcaaataaacctttgtctttcgtgtttacaccaagctagcttgcgtgtaaacaagcgtagcatagcaccatgcgtacgtttgattcgaaaaagaagccaaaagtaaaaatggttaattaaatccatataattatagatttgctcgttttgaaaaaataatattactagtcatctatttgaaataatgccatatattacaatcttatatatattcaagatatatcccctcttgcgaagtgagtatacctcaactgattaggttattgtggtgaaaccagcccactcaagtttaaatcagtcgcacctaacggtgcttgtgctagatccgtcaagcccagggcaagttggtcatgctcaacagtaacaccgttgctgctagatcctcaagaacatgcctcgttggttggattattgcgtggtcgtggaatcgttgtcgattgccagcagtgggagatagagaggagagaggggcatggaagaaataagaataaggtaatttcattaaaaaaatttttgataaacacatcaaaaggataataagtagtgacatataactaataggtgtgaaatcatgacgaaatggctccaaatagataaagaataataatatattttttttaaatgtaggaaacttataatgacacttctccaatgaatgtaggaaattttatgttctccatccttggaacaatgtaatagtcaaatgtaatcaacccatgtctgaatcacaaccaagcaaacaaaaaccatctcaaatctgacatatataaatcgatggatatagtgatatggttcaacatctatgctgattaatattatagggataaagtaacatttggtagattattatgtaagttacaatctgcacatcaaactctttaaaccaaaactacatcgaatcaagcattaaattaccataattgtatattaatttattccatccactcctaaggaatactacttcctccatcccttaaaaaaccaacctaggataagatggaatgtttcccatctgaagttagcttttttttttttgacgaagtattgactagtagaaaattataacccattggactatgcaagtcaaaatcaaatcagaatccattggatttctataaatcaaagatcaaatcatacatggttacaagtattaactactgcaataacattcatatcaaaacttcactttgtagcatcaatgcgaaggcattcaaatccaagtcaaaaattaataggggtgtataaccccctgaaaacagtggtagaggtaggaggacgaccagtagcctcgtctcctccaacagttcctttttttatataatcctctaattaattagataattaacctaagcaatgatatattaagctttatctaagacttttaacaaagtattatccatcaaatccttctcaatcctagctccgcctccgcctaaaacgagaactatagcaacatctaaaaacactgtagcaagtactcgtactatagcatccttaataactgacaacgaaccctctgcaacttgcacgtctcagctctcaaccggacaacccccgatccatcaagtacaccgacgaatgcctacgtgcgcagcacggggaaacagtccggttgaacgtgcatgagtgcatcacctcgccccataggtagggcccgtttagttcctgaaaagaaaagtttttttttttgtcacatcggacgtttgaccggatgtcggaaggggttttcggacacgaataaaaaaactaatttcataactcgtatgaaaaccgtgagacgaatcttttaagcctaattaatccgtcattagcaaatgtgggttattgtagcacttatggctaatcatagactaattagactcaaaagattcgtctcacgatttcccctctaactgtgcaattagttttttaatttatctatatttaatactccatacatacgtccaaagattcgatgtgatatttttggcaaaaagtttttgggaaataaatagggccgtagtaggccgggtgaaaacagtcgtgaaaatttccgatcgaccgagagccgtttttaataggaggtaccgttctcaaccatatcatttttagctattgataaattttatgttttttaattttctttttcatcgtattaatattgatgtagattagtttaaatgatatatataatcaattaccaaccgatcaaacatcgttttcgaagagattgtaccgattccgaaccgttttcacccagccgcatcactgcatccgcagttcaccggccaaacccaaccggctgtgttcgttcagtggagttggtaacacattctctccacacgaaaaacagagcgacgtattttcttatgattaattaagtattattattttttaaaaaagataaattaatatgatttttaaagcaactaggaaggtagcccgcgcatatgcgcgggcatgtgcgtgaaatttactgtgaatgttcatgtgtgggtggtttctataaaaaatattcttttgctttatcataaactaaaaatgaacttatttaacatgctttgagcactggtagtttttaaattgtgaactaaaattactttaaaccgtgtagtttttaatttatgagtgggacatcgaaaaaattagtaattagctgttcaatatctgtgatattattttataatatcaaaaggaattggacagaaaaacaatcacaaaagtatgatttttcccctccctaccaagtctgcctcacattcacctccaacgctgccaccgcacccgcagccggtgaggtggctctctgggggcggggtatcgaggagggcccgtgcgcctaggcccatgggtccgtattgttcccaaactcgtcgccgctgcagcgcgaaggccatgccggcgccgatgctccgccacacaccgcagttaaggggagcacaacgtgggccaccgcctggttcatgttgagcagggcgccgcagagcacatgctattgcagtcggtctcgcagtggcgtgctgtgctaccgtaccctccgctgccgatgtcgtggcgtcgacggcgtcagagctatatgcgagccgcacatggcagaaaggggcaaaatcatactttcgcaattgtttctatctccttttcctttggataacaaaataatatcgtgggtatacaggcagcttattaccattttttgcagtgtcttgtggcagatatacattcttgtagtgtctcccagctaatcacacgtttttttaatgtcccgtagaaatttttgcctttattaagtggaggcctcaatatgcatgtgggtccataatgtaattttttgttagcaattaaatatagtcaatatgggtattaagttattgatttgacttaaaaaaaaaagttggctagacctaataggtggagatttgtttgtggtcttttctttgcccataaaaataattttaattttaattatcatagagataggaaaaacaaagaaaagtaaggaaaaatagagagggtttggatgttttctttattaaaaaaagagtgatctgatgacctaaaataatgtgttaatgtttaagtaaaaaaaaccgatggttggaatttttttttaatttaagtgagacaagtaacagcttagcaaaacgttcatgtactttaatgcccatagggatgagaggaagggaatatggtttgggatgatttttttttaaaaaaagatcgaataacgatgtaaaataatgtgtctattgatttaagtgaaaaccaatggatgaatgtttctctaatttaagagtgtcacacaatagtttagaaatgtttataagatgtttaaaggactttaatgcctatttgtgatttttttccataaagacaattttaattttaattgtgatagggatataaaaagagaaaggaacagaaggagcgtacaaattgatcagtatgtgcgtggtgcacgatatgcggacgtgggaggtttttgtttttaagatatatctaacgatctagatccaccgatttaaataaaaatcgaatgtaagatttttttttattttattagggttccatgtggcgacttgggattacttgtattttggggggtgtttttacgagcaatacttacgagaatgggagattaaaagaagggagttttttaaatagatataatctaccagttgaaaataacgggtatgtgaaaatcaagactacatgttttgcttttatcttagaatttataggaatttcttttatttattatagtgccacatgacggcttaatagtatttgtagaaagtttaattaacttttagtatataatagataatatatagattttatatacaagatatagtttaactgcatatatttatagagtactatattttatttttaaatagtagaaaatcctattttaaagcccatcgattttttttcaatgacactacgatgtatgctttttgtttctttactttatcgcttttatcgtataagtccgtacataggtttttcttgaacgtattattcatcgtttttcctttagatgtatgtagaacagttttttttcctaattccggcccacaggaggtgacggagcgtggggctcctcaccgggagaccgcccaggccccctttgccggttcggccgggggcgctaagtgaggttcttcaccctcaatgtgtggaatgttcgcgagagagcaaatgcacaagacacgggcgatgtagacaggttcgggccgctgagaagcgtaataccctactcctgtgttctggtggatctgtgtgtgaaggagttacagagagccggagagcaagagagttcaaactctagaacccctcttcctctttctctcctctacgagctcaggtattctcaaagtcgtctcccagtcctcttttttttctctcagtccccttacttcggtgggcaaggtcctccttttatatctcaaggggataccacatgcaccacttctacctactcttcttgtgggtggagacccaccctatcttgaccaaaacttggctcgcgccttcgcctggaagctaaatcacagcttgtccttgagtgaggcccagcgccgtcactcgcctgacacaggggatacccctgtcattccttcattaatggatgaagatttgcaatagccgctgtccgaataaccctccgatgggatgggtcatacctacctccactccgccggaagcagatgcaacgtgggagcacggttgtctgccgatgacgtgaccggcgtcagaccagtcacagaccggtcattcttgtccaccacgcgtcagtttagcatgccgcacatctgcccttcttcatacaatgacttccttgccatggttgcgatgaagcttggaatgaatatggccgggactgacataccaactccaggagttagcacgccggctccggctagggacgagtgcctggagactctcatcattccgacgggacggggcgaggcgtgtgacaggccgcctgttgccacctaacccgcgatctgaccggtctgtgaccggtcacacactgcgaccggtcacggaccggataagcgtgcgctgcgccgcattaaatgcggcgtggcgcgctcgtccaacccgctataaatgcggttaggtgggcgccgctgtgcttacctaacccacacacgtggcgccaaaaccacagggggtcgaggcgccccagccctcggggccgaaacgggagcggcccgaccccttggggagacagagggaggggaggccacgtcaccctcgggcccgacccccccgagggggtcaggccacgtgggtgaccgcggctacccaagcctctagtcacgataccctcggccccatgtcaccgacacgaagaatacaagaaacgcaagtctaaccatcaatgaaattcttcccgaggcgcacctcgccctcgctacggtcaacccatgcaataccaccagtcggtcactcaggctaactgccagccaggctacgcccctcgtcctcagatgaaccgtccggcacctcggccacagcagcgtgcccctagtggcactactgcgccaaacagtgttacctctttcaagtcaccgcagggaccgtcagcagttcagtgtttccggtgcaaccagatgggtcactatgccagagagtgccctcagaatcctaccaacaccaactccgggcatgctaatggcagcactgccagaactcctactccagcggcagctcagtctcgtcctagctctcaggcaagtggacaaggttctcgtgcttccaacagctttggtcgaggccgagtgaaccacattcaagctgagaccgctcaggatgctccagacattgtgatgggtatgttctctgtcaactccatacccgcaatagttctatttgattcaggagcttctcattctttcatatcacaagcttttgtgaaaagaaatggttggaaaacccaaaatttacgtgtacctatgatagtacattcccctgggaggaatataagggcaactcaaatatgcccggaagttaaccttagaactgaggaagttgacttcctagccaaaccgatagtcctagactcgcaaaacttggacatcatcctagggatggattggttagctaagcacaaaggacagatagattgtgccgaaaagtccatcaccttgcaaggacctggaggaaagcaagtccgctttacctctaacacccctaccgcaagtcggtctatcctaacctgtttacaagtcacctccttggagtcggtgcccgtagtctgtgaatatcccgacgtattcccagaagaattaacgagtatgccaccagaccgagagattgagttcgcgatagaactggcaccaggcaccgcaccaattgcaaaaagaccctaccaaatggcagctaatgagttagcagaggtcaaaagacaaatcgaagaattggagagtaaaggttatgtgcgacctagctcatccccttggggagccccagtgcttctggttaaaaagaaggatggctctgagagaatggtaatcgactgtagagccctgaatgaagtaactataaataacaagtacccattgccacggattgacgatttgttcgatcaactaaaaggagcaagagttttctccaaaattgacttgagattaggttaccaccaactggaaatcagatctgaagatatcccgaagaccactttctcaacgcgttatggtctatatgagttcacagtgatgtccttcggactcaccaatgctccagcattcttcatgaacttaatgaacaaaatcttcatggaatacctggaccaatttgtcgtggtgttcatcgatgacatcctgatatactccaagaatgaggaagaacatgctgaacacctgaggctgataatggaaaagctcagggatcatcaactactcgctaaattctcaaaatgcgaattctggttagaccgagtagcatttcttggacacatgatctcctccaacggtgtcgaagtagatcccagcaaggttaaggctgtacttgcttggaacccgcccaagaatgtgtcagagatccgcagcttccttggcttagctggatattatcga

SEQ ID NO: 69035 - DNA, 517 bp, Oryza sativa
gtatattaaaaaacaaaggtagttcttttcttatcgccagcacatctataaataacaggtctcccctccttgaaagtactcatcgggtcatcaccttctcctgattcctaaaccctacacacttgagtaacttgctttgaagtaaaaaaaaatggtgtccttctacctcgactccaccttcctgcctctcctcgccaccaccatggccagcccactccacgcctgcctcctcctcgccctcctcttcctcgcgctcgccttcttccaccccggcggcgtcgcgtgggcgctgtcgtcgtccggcggccacggcgccgccgccatccctggcccgcggggagtcctgctcgcgttcgccggcccgaacccgcaccgcgcgctggccagcctcgccgcgtcgacgcgcggggccacgcgcctcatggcgttctccgtcgggctcacccagttcgtggtggcgagccacccggacacggcgcgggagatcctcgccggcgccgcgttcgccgaccgcccc

SEQ ID NO: 69036 - DNA, 719 bp, Oryza sativa
ttagtctgcccttttttaacaaggtgaatagggatatccacacattattgccgaagataaatttcatccagcacaggatactggaggtggccatggcctcaccttttgtagacgatccttaaaatttgtcccattgacagcaacataatcaatagctgcaggttctgagcccttcagtttgataggccttactgtaccagtgagattgttacagacgctgtagtactgctcatttggaaatatgttctgtttcatacacatacatttgagtacggggaatatcgtcaagaagaaattacactgctaccacttctccacatggtaaaaaattaacttagtacgagcacataactacctctccaatccgaggaaggccatctgattcgattgcagcggtagtgtccctcgaaagattactcttgcaaaagaactccgtaacattatctctactttttgctgataaatcaatgcactcagtctgcagaaagagtacaaaggataaaagaaactaattttaggttttgtcaaacttaaggttcaatctataccaagttagatcatccaatcaagatttttccaaaggtactctctgttggtggatactaaacgtgcatactgagatggcattccgaattgaagaatccaaatctaatgctcaggattattcaaatataaaatatagataggtaaactaattttgatatttggatgcctaggca

SEQ ID NO: 69037 - DNA, 1768 bp, Oryza sativa
gtccgcggcttgcgtagttgacagtgagaggagagagagagagaggagaagagtaagagagagaagagagagaggaatagtggaatatgagtatgacaggtgggtcctacatttttttaataaataaaatgctgactggactgccacgcgtatgccatgtagaccaaaaccatcgtggattgggtcgaggggggtaattcgtccggtttgcatagttggggggtgaagaatgtccggttttatggttcagaggggtaatttggacgaccgccatagttcgtgggggtaatttgtactttttttcctattagtaaacgtgggtaaccgaggaggtgtaaggctccaaatggtctgtttctgtacttgtttttgctacattcgcttcctgcacattaccagatcgatttattattcatttatgtgcttgcgattctcctcccatcttttcctcatgcagctcaccaagcatccttgtacaatgtccgatggtcccacgattcacagggaatatatccacggtacaaattctggtctcaatttgccaaaaagctctactagaccgagcatggctggtcctagttcatccatggggcacacttctatccaatcttgttggacaaccatgtgcatcgtcaatctggtggttgtaatccattctttcctcttagccatcctctgtttttacccctcctctcctttcatcctgtgcctgttctccgcacatcttgcgccctgctgcccccttttctgcagggtgaaatacacacgagcggatgactgtccaatggcaaaagccatctcgattagcagatcgatcgaacatggataatgcatcgcctggacgcagccaactgccgtccatttttcttttgtttcctgcctccagttccagatctgattggcgctcggcaccatgtttcagtcctcacctgacctgctgatggtttctggagtggttttcctgtttgatccactcggatctcagcgcccggttgggcttttgtcagtttttcaacatgttacccctagaggctgtgactgtatattagtttatacttagttcttcatgacaattttctttaactaaaacaattaccaaatgataattcaatatgaattactctccccagtatgaccaatcctagctgtggtgttcttatatgttgggacatctgtggcaccccattacaatagcacgggtcgcacgaagaatacaaattcgttcctgcatcagttaatttctttttagatggtagcataagttgtctatgacactactgttcgtatcacatgaattgggattagaagtgttggagaaaaacagtgcatgtggaattgtagttaattgacaaggtttttgatggggataggttggacaaaatgaggagtatcttggttgacctttcttcataaaaataatacttgccatctagtaaactaaaactgttgggaagtagattccttggccaattgagacaagccagtggtgcttggaagatgcaagattctgcacagaaaaatgggttgcaaacaacaatttgagttctttgattcaaacaaatagacataaactagctaatttgttctttgggtccccacaaaaaaaaattatttgggacaacaatgttactcttgccaccttggcaactggcatgacttctgtgagcctaaagggtcatcaatctggagatctcatgcccgaccctaacaactgattgccctcatatgaacatatgaatgattgtaggcttgttgcataatatatcaa

SEQ ID NO: 69038 - DNA, 1487 bp, Oryza sativa
aatattttgagcagtgatttcttgcctgtgggccagggaagccaccaactggccagccaaggggccagttcacatccttttgaaggagtgtgtactcctgctcaataccgtacctgtttggattcagagataaaaccttatgagaatggtatagcagataagatagtaaagtagatatagatttgggggtctccacatttggtggtccttaaaaacttttttttattttgaacggccttgaaaacttttagttttcatatttagctatttgataaactaaactaaactattatatttgtgtcaacaaaaatgatctagattactactcaccaagtagtaatttaaatcacttggtgaatataacaatcgtttcagaacttgaaagttctgacatgcttatatttattggaaacaaggattttttttaacaacggagttaaaattttaattaagtcgtatgcaaaaatactttaataatctggagagaacggttcttaccatggcacctcagcaacaacatcagggtggctgaagatcttggcggcactgtgcctcttgttagtggggattggctcaccttgtggcgtgtagcagtcgcacatcacctatagtaacattaaattaaaaaagtaagcaaaccagcgacttcccgatatagggtatgtttagttcacgccaaaattaaaagtttgattgaaattggaacgatgtgacggaaaagttgaaagtttgtgtgtgtaggaaagttttgatgtgatggaaaagttgaaagtttaaaaaaaaagtttggaaataaacttaggcatagttgaaaattaagggctatgcagttactgctttaagctgaatgaagtacatctaccccctttctccctaacttaaaccctaacatccaaagaaaattttaaggagagaaacagaaaccacaatgccctcaattaatgtgaaagttgtattgatttactggtaggtcgggggtattgaggtaataaaacttcttgctttgcggattgacgatagttaagaagatagaaggtgtttattttggaataaatttcaaattccagaaattgttttattttgatacggaaggagtacggaagctattcgtggccaatgtttctaacaggctaatttatatctatacacaagagttgaattccataaagtacgagcaggccaatcaatgatgtaagaattttggcatgtctacatcagggtgtaggcagtttgctggctaagagcaagataaacagctaaaggtttcgagcacatccaacagccagaaaaaataacctaactactagttaacatattcataattttatttttcagaccaagctacaattcaacaaggttaacacttaacagtgcctgaaataatatgtttctacaacaaatctaccatctcacacattcaaattttgtttgcaaaggacctttcgttcccttccttttggccatcataaagtgtcaatatgtcatga

SEQ ID NO: 69039 - DNA, 7223 bp, Oryza sativa
ccggcgaatccgagccgttggctcgtctcccctcgtcccatgcaacctcccggtgcgctcgcccttgcctgcatcgctgtagatcgccccgccgctcgccgccgccgtccgtcgtccgttccggccgacgtcgtcgtcttcctcccgccgacccgcatggcagccacgtaggcgccacgtcggcgccacctcggccaagaccgggtcaagcctaccccggtccgctgctaccctctgccccgctcgcgcgcgcggtccaccgcgagccgtgaggttgcgcgtgggcccgccgcaaccgcacccaccgcgagccgcgcgcgtgcaccgcgtcccttccccaaaccctagcgcgcgccgcgtgctccctccgcacggtgaaccgtgtcaccgacaagcgggtcccactcgggaccacacgaggtgagcccggtccaccggctccctctctcctcccctcccgcgcgtgccttgggccgtcttctcgggccggccggcccattaagcttggccgagccgcccctttctctcgggccgcgccctagctgcccgagggaagtctgtttcccctccctcttttctctttttcaaaagggtttaattaaatcatttttcctttagaccaaaaatccaataatcttagaaattcaatatcttctcaaccgtatgtccgtttgactccgttcaacttccaaaattcctcaaatctcgagatctgtttaatggcacgtttagaggtcaataatagggctctattttcgccgtttgttgagttgtcccgtttcgcgtgtagtttcggagcccgaagacccgcagtgcgaggatttcgaggatcaagctcaagatctcgagcaaggcaagtcacctttgatcatcttgcacctataatttaaatctaagtatttctttttcgcaaatattgcataaataggattatcacgagtaattcggccgcggcttgcgagatagcctgccggcccccaatcctaattgctgcaattaccctccttgaattattgaacacttaaacctcctttgtcgattgttgtgcttcgatgcatgggccttcgggcacgcgcatcgggacacctcccctcaaatttaaaatatccaatgatgggtaaaacttggggtttttacaaaagacttggaaaaacccgacacctgggtcggtgcttgcgaactaaacgaaatttcaaaatcgcggatcggggaacgtaccgggagtgcggtttcccgctcttgcacttaaggaccgttttccttggaatttcatccgaacataaggcaagtgcgaccacatgggtggaatgggacaccccctggctgagtaactagctaatcgggggaaccatgatgccaagagacatgtggattcaacggggtggtgccggggagaacccccgggtttcctggcacagtatagtctgggacctaacctagtgttggtctgggacccctctcgttggcatatggtgaacctgtgttggctctcgaaatgccttgtcacgaaagcctcaaggtctccagacgtggccgttctgcacgggctgggtgatccgggttagtaatgtcgtgtgggtaaagtgtaccctctctgcagaggttaacaaactgttcgaacagccgtgcccacgatcatgggtggatgtgaggtgattcctagcgtagttttgtttgactactgcttgtgaaattactgttgtggaatgggttcgatgtttgaaaaatctgcggctgatgggatcagccaggcccgggtggccgtttaaaagctgttggccgggtgccaaccttgaatcaattcaaagactgatacattgcacaaactccgaccgaacgagacacactgtctcatccgtgtcgtttgagaagcactcacttagttgtttcaaaaaggagtttaaataaaaacaattgcaaaaacaacagcccttcctttgaagcctgcattaaacacttaattcccatggcttgctgagtactcctgtactcacccttgctctatataaataatccccccagttgctaaagaagatgatgtggatactgctgatgaggagttcttccaggagcaagtcggctacgatgagttttagggtttcggcctagttcccaagttgcgcctgtgatgaatagtccaagtcttggcttccgttttcccttttgtaatgcagttgtgagctcgggatctgtccgcaacccaacatgactgtactcctactctgtaataaagagacctctgctgctgtgatattctgtcttcctgtgataccagcactgtttcctgggactggtatcgattaacaggttaatttggagcgtcacgggctagttccgctcggggctagttcagggcgtgacaccgttaaccgaataaaccaaaagtagcccattaggcccattaagcccagaatcactggaaaactctagccacgtcatctcttaacacccccatccccagtcattcactcattcctcctcctcatgcacgcacccaaccgctgcgccctactccgtaccgacgcgcatcctgcctccttagctcctccacaccaacaatgttgcccaacacgccaactatgatgaatgttgattaagtgttgacccccattagcagcacgtcaaggcagttggcctatcggaacataccgagcagcagcactttcttctttcctgctactgccacaactttatttctcgaccatgatctatcttcaccctttaggcaatgcaatttggtcttgaattttagacgaccgaagtttctctaaagtccccgagcccgaactgattggtctgactgattgcccacccctaatggagtatcatgatacttacttgatgccatgaaattatcatggtaaatttatcgttttatgttgatacctcctcggcaccatagaggtatcataatacttaattgattccatgaaggtataatgatacttttatggtatcttctacaataaaaccatgaagtatcggtgatacatcaatttattgtgatacctcgttggtgtgatgaaggtattaagactttttttatgttatcacagtaaacctctacgatacaaccaacaacatttacgatattttcatgatatctccaaatatttcgtgaaatctttgtaaatataaccatgatgacattttcagatatgatggaaatcatgtggtaccatctacataaataaaacatggagatacatgtgagatatgatagaaatcgtaattacctctatgatattatggagatacatgaggcacaaagtgtaagggtcgatctgatataacataattaagttcacttctaacaagccttatcctaccatgcatatgacccaatagtggtgtatgctcatgtattatccaacacagaggaggtgcttgcccggtgtgtagaggcttggaaggatgtgcttgagggaattgtaaggaggacttgctcgcaagcgtgggtgcacactgcacacgtggaaactgcacatagaagaatcgcgggattgtgatttctataccatccctgaatggtacgacgctctataggaatgtttgtattaggcagaaccattttttaagatatagtctatatagcagaacgcccaaaatagtatgccattatgtggttccttcacagtatgaatacgttcttctcctatgatatctatagaagagaataaaaatgcatttaattttcaccaatcacattaatatgataattcattcacctacctcgagctatatatggattgcaccggccaatgcaccactagactatatattggggaaaagaacctcatccctcttcagccaacataatcaagaagacagggatggagcagcaacctaagatggtgaccggatgggcggcaagagacgccaacgggctgctctctcctttctcttaccccctcaggtgatctctagctctcttgctctatctttttcctgtgtgttcagatgttcctgggtcttgaaatattcaaagagaagttcacacaaaattcttgagttataccgttttctttttatgaaagcaaagttactgataaatagtcaatagtcatctccattacttcgttaattaattgtagtcaggaattctagttttgaacgggtaccatcaaactgtatcgatcgagatttatgaggaatatggaattgcctttgacaattgacgcaccaagcacataaacgctgccgtctacgttttctaccggtctccggtgatattttctttgtgtaatgaccgatgagaagtactgcatggctcattggttctgtaactctgttaattattgaaaaataactaaattgcttcagtcagtcagtagtaaccaatcgttgggttgccactctaacgaaaacatcactggtgtactgctatatagaaattagaacactgagaactaaagaggtagtattgtctgttgagttttgagcatttttcaagaaatttgcagctacacaatgcgttctgaattacattttttgattaaaaagaaacttatgcttggattgcaaagatatatcatttactgcaggaaagtaaaggctacacgggtgatgaccaattatgcactatacattcatcatgaagcctcgattgccatcttttagaaagaatgaatgatagccattcagtaggtagtagtggcgacgcactcatacccaacttccacggctgaaaggaatcaaaccattttggcaccgatggcttgtttgcacgccattgggcgagttcgagtcgttgcaacagcatttcttccattattcacctgctgatttatgtttatgcattgtcaaactatatgcattctccccaattgttttctttttcgtgagtacagaaaagggttaattaatcgtcatttccaccgtgcatttcatatttcagagctaagggagacgaagacgtcgttgtcaagatactgttctgtggcatttgccactctgatctttctactatcaagaacgagtggggcaacgccaagtatcccgtagtaccagggtcagtacgtacacatgcaatgcaaatcggctaatgcgcaacagaattatccagagatatattattgatcgatcgttttgcgtgcttaatccagtcatgaaatcgttggggtcgtcgccgaggtcgggagcagcgtggcgaggttcgccgccggcgacactgtcggcgtcgggtacatcgccagcacatgccgcgcctgcgccaactgccgcgacggcttcgagaactactgcgcgggcctcgtgccgtccttcaacgccgcgctccccgacggcgctacggtgcacggcggcttctcggagctggccgtcgtcaaccagcggtacgtcgtccggatccccggcggcggcggcggcgcgtcgccggcgccgctcgaccgcttggcgccgctgctgtgcgccggcgtcacggtgtactgccccatgaggcggctcgggctggacaggccaggggtgcacctcggcgtggccgggctcggcggcctcggccatctcgctgtcaagttcggcaaggcgttcggcgtgaaggtgaccgtgatcagcaccagcccgtggaaggaagcggaggccgtggagaggcttggcgccgacgcgttcttgctcagcaccaacgccgaacagatgaaggtgaccaaaaaacaccgatctgtgcgccattttgcatccgaattctgaagctaagaaccaccatatgtgcaggcagctgcgggcaccatggatggcatcatcgacacggtctcggcggtgcacgacctgacgccactcatcacgctgctgcggactcacggccagctcgtcccggtcggatcgccgggaaagccggtgcaactagccctgtaccctctgcaatcaggtgcgtgtggttcatcattactgggccttacagcctcacaccaaaccaggcccatcaccagttggcccgcgaatagattgggctggaggcccaatcagagctagatgggccgtgctcatggtgtgcgatgtggcagatgggaagagcgtggccgggagcatgatcggcgggatgagggatacgcaggagatggtcgacttcgccgtcgagcacggcgtcgccgccgaggtggaggtcatcggcatggaggacgtcaacggcgcgatggagaggctgcagaagggagacgtgaggtacaggtttgtgatcgacgtagccaacacaatggcccgtgctcgttagagtttgtttgtggtggtggtttctcagggacagaagaagcaagagatgcattgaactatgatttttcgaagtcaggactgaagaacgtgataagattcagtcaaaactgaagaacatgataagattcactttgctcctccttttacttgccattgcttgtgtttcgtgtaagcgaggagtggagtatgcggctatgcccatgcatcgccgtggaaatcctgtttatcagtgatagaatttcatagtgtattcgaaaatgcgcaagggaatgaaagttttatagattagtaatggtgagctaactttggaaagaagctgaatcatagccataaaaatcactgattgaacggttggcatgtcaataaaaggaaaaatccccttttccatctgagaacagtgcttactactgctgagaataagcgtacatccattgaagggggaaaaaagaagggctgaagattaaagagaaacgtgaatacatgatattattcctcgggtagttgcatacggataagatgtgatagggttacacttttaaggctgtactacgtgctactgctgcatatatacgaggcagttattctatctttttatacttttatctgtgctgtgtatatcacaaacttagaattatcgggacccccgcgtcgctctcgcgcgggcggctcgggggcgaaaccctagccgcccgcgccgccacaccctcatccccctcctccacctcgccgccgccggagctcgccggtggcaaagccggcggcgtgccgggaaggcggcggcgaggcccaaacggctcggcggaaccggcccctgcgcgaggaggacggagaacgccgacgatggcgcggccggaggtggagacgacagttcggcttggggcggcggatccggcgcccctgtggccggatctggcctccccacccacggatccggtcggcacggtgagaggcgcgatggaggcggagcgggcggtgagcggcgcgggcgtgccctgccggtgcagcgggcggcaagatgg

SEQ ID NO: 69040 - DNA, 541 bp, Oryza sativa
ttttagatcactgaaaacacgtatataaaagttttattaacaaataatttattgtttgcaaatataccgtttggcttatttggagccgaaagctgagaaaaaaaaaatagtgaattccaaaagcggttcctcaattgtagacgtcagagggaggcgcgtgtcactgacgcgtgggccccacagcaaccacgtcagggcagccgcctcctcctccctcatcggtctcctctcccccgttcctcctctccacgactccacccctcccgactccgcctccgccgccgcttccgatccgcggcggcagccggagctcggagagagacaggccacccgccgcccccccctcctcgccttccctgtgcggcctcgttcgccggtgcgacgcgccatcccggtccgcatcgggctcaaaggtatattactccttcttctccctcttagatgagccaatccgggcttaggtttgatccccttcccctccaattaaccttaacgagacaggttcatggatttatttgagtagcagcagcaccagcatggg

SEQ ID NO: 69041 - DNA, 42249 bp, Oryza sativa
ttgctagatgacattggagttagatatttgtattgttgtatgttttacttaagcatagaatgactcaagaaataattatttttcctgtgggcctactgtcatggggtagatcataagaggagggagataaatcaatctgaaatttgtaacactgattagacaatggtcttgaatttggagacttgtagtgctacagatctcagtcgcggtgtgcttttctcataaaataacaatcaaagaatatgtcttgtattatttacttttgtttgcacttttgaagcctctgaataatggctatgaacaatccaattgatgatccacctaacatatccgtagtactttcatgtggctaagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagggctaagcacctaaatgctgtattgcctatataaatattgacttgattgtcagcttattgatacttgcaatgtggtatatgttcagcctgcagatatctatctgattgatgaaccaagtgcctatcttgattcggagcagcgcattgttgcttcgaaggttatcaaaagattcatccttcatgcaaagaaaactgcatttattgtggagcatgatttcatcatggctacctacttagctgacaaggtcattgtttatgaggggcggccttctatcgactgtactgccaatgcaccacagtctttggtatctgggatgaataagttcttatcggtaagttctgaatattaaatattgagaagagatccacaagtttgttgtaataccatctcgcatccttgtctttggttcagttgtaggcaacttcctcaaaagattaatttttcagtagagtttgacattctatatctgtttttagttgtcgaaagatgtcccacttctgtttatttttcagagtatttcatttatgttttcacatgctaatgctttctattgtttttccttttgtgcatgatagcatcttgacattacttttagaagagacccaaccaactataggccaagaataaacaaactggactccacaaaagacagggaacaaaagtctgcaggatcctactactaccttgatgactaatttgaaggcgtacaggttcctacagctctcatttatgctggagtagtttcatatcattttttaattcttattttcacttattaagtaatttcgtttttcttttgccttgctgtgcagaatcttcttgtggagcttcccgcccataatttgcccaggccttcgatgtcctacgcattacttgttcagaaggttactttgaagctaccacagcttgaagcatgctaaataacttggctgcaggagtgaagtggtatcatcatcagttataaggctgagcatgtgatgctgacacttgagttcttttgctggtttgatatatatgatgatgggaaagagagatgttactgttaaactgagcaactttgtcaggatcggaagattgtgaatttttgtgtatttttgcattattgtatcgtggatttaccaactggcacccttaaatcgttggttttataggcataaagtttttgagctgttactcatgttaccaatgttatcaaagttctctgagttattactgttaattcactttatcgagataataacgtagtttgtctttttttttattcagatttttaaaaatctgtagtagacaaaaccgaggtttttctttgttttgatcggatgccagattcatttgcttgtgtttagttttgttgtgtcaacgagaatgattgagttgcgttacatgcagattcatgttgtttgtttctccacaacttacagtcgtggaaaatttaaggttgcaatgtaagtgaaacttaataaatctattatttgcaagaagccaatattagaaaacaaactatgataagaaacctcaaaattaacgctaaaattaagttttggaatttaaattttgtttgtgaccattcttccaagtagaaaacgatagctccatcaaacaccataaaagttattgctcatttaatttcttgtcaaaattaaccttaccaaaattgatattaccaaattaattttggtattaataaaatttgggagcttttgttgcatttggtttgaccccttactaaaaattggaaaagtttttttggataggaaacttttagaattaccaatatttggtatggtagcaaatgataaagttacatttagtttgttaacatattaaaatttgataatgtcaaaacttgataaggttaaaaatggtactctatccgtcccaaaatacaagagattttggtaggatatgacatatcacagtattttaaatccatagtgataggaatgtgtttcatccaaccaaaatcacgtctattttaatatacttaaatggtaggatacgatatatcacagtcttttaaatccatagtaataggaatatgttctatccaaccaaaatctcgtatattttaatatacttaaaatgaacatgctctcggtgcataatacaaaggccttgttccagaggtgaaatgttttggcgtgtcacatcggatatatggacacatatttgaagtattaaacgtagtctaataacaaaacaaattatagattccgcctgtaaactgcgagatgaatttattaagcctaattaatccgtcattagtaaatgtttactgtagtaccgtattgtcaaatcatggtgcaattaggcttaaaagattcgtctcgcaatttatacgcaatatgtgtaattagtttttttttctatatttaatacctcatgcatgtgtcgaaacattcgatgtgagtaggatggacaggaagcttgtggcttgttagctcacttggctcggcggcaaggcccaagcccaagacaacagctgaacaacaaaaccctaggcacacgcaccgcatctctctttgtctcgcgaatcctcgtctcctcgatccccttcggcccttccgttattcgcatgttccgtatccgcagtgcgccgtcgctagccgctagggccgccgccgccatcgccggacttcccctcctcggctcctcctctaccagctacaaacctgcgtttacgatggaggaagaacgagaggtgcaagagcaagtgcctcaggttgcaagcgtggaatcccagagcaaacacatgagcgtgtcttgttggtttggctcgcgaatctaatgagctagctctagctttcaaacgagccgagccgagctgggtttctagctcgttaggataacgagttgagccgagccagctcgttatcctaacgagctagaccgagccgagctgagctggctcgctatccacccctagatgtgacagggttaaaagtttttgcgtgggaactaaaccgggccaaaatcttctcatggtcatgtaagttgggtacgtacgtattccacttttaaaacaacaaggtggctgggacaacatgatattactagtacgagtaattttctttcaacgtatatatttttataaccagttgattagaccaaaagatatcttgagatgagcttcctttcgctctctacttcacacttgttcaatacggtacggacagattttaaccaccggctgcctgcaagtagtaccggtgtgtccgtgtctgctcgactgctctccctctcctccccgtcttcctccctctcccggtctccccttcggttgccgcgtcaccaccaccaccaccgggtcactgccacgtgggccccacacccccacctccgcgacctcgcggccggtgagccgcactgcgcctcccctccgctgggtacaaaccgagtgaccgatctaccacctccacccaccgcaatcccccccaatcccccccacacgccgcgagatctcccgcctcctcctccacccgccatggatctcctccgcgaccgccgcctcggcgcgctgctggtggtggtgctggtgctggtgagcggcgcggcggtggaggcgtcgatccacacctacgacagggagccgttccgggaggtggggaacgcgttcctcctctccgggggcagcgagggcgtcgtcgccgacggggccgacctcgccgcccccgcctcctccttcatcaagtaaagtttcccatcccccccgcaccacacctccgcgtctcggtggttggaaactagtatagtagtaggttctcgaagccgctgccaagggtgagaggcatgtgctgctggctgctcggtcttgaatcgcctggggattaggcgtcgccggcgctgggaatgggaaatggggggcgaggcgtcaccgctggaggatcccgcccgcgcgcacggttttgctgagtgcttgcttgattagtggcaatttaacttttgggatttttcattttggcaagacattagtgctcagtttgtgatttatgaccaaatttataattgtgttgccgatgaagtaaaattcgggttgcttagatacacctaacattgaaaatgataaaatctgcaagttgtgacccacacattgaactcggtgctcaccatgtagttgtttgcagtgttttgtgtcaatattgttcactgcagttcattttagttttatagacttttagttcagctttgaacttcttgtgctgataagcagggctgtgctaccgccgtattaaaccgatgcaggttccactatgatcattttgagtaacatttgccatggattaggagaattacatagctagttagctactgccaatgtgaattacggagcatgttgacaagctgatatgtgggctcagaaaatcatttggttgatgctgtccttgtgcttactagctgtttctatctgttttattgcgtccatcaggctttattttttgtaggaatatgtatgggtttaatcttttctgggatctgtatgtgttagtttaccgatggaaagaactatgctccattcataacaattgtataatttagtattaaccagatgctgggttttcttactgtcaggttcacgaatgttactttctggagaactccggaatcagctgaatcacatgcaaaaatggcacacagtacaggtctggtacaggccattttatttgaagcagctgacagggataacattgggggatctgcctatggtggacagaggtccatatgttgtacccctgaccttgctaaactagagggctgcaaacaaggggaagtaatcaggagaccatcctctgatgatcctgattggccttatgtgctagatacacacttcagtggtagtcacctttctgtgaagttagaagatgaggtagttcgcattaccaagacaggcatgtacaacttgttcttcatttcctgtgatccaaaactgagaggccttagtatgagtgggaagacagtctggaggaatcctggcggctacctaccagggcggatggcacctttgatgaaattttacgtttttatgtcactggcttatctattggtcatggttgtctggtcgagtcagtatataagattctggagggacatcatgccaatccagaattggatcacactaattattgcacttggcctttttgagatgacactatggtactttgaatacttaaacttcaacagtagtggtgtacggccaattggaatcacaacttgggtggttactgttggagccatcagaaaaacgatttctcgcctattgatcctttctatctcaatgggatatggtgttgtccgcccaaccctgggaggactgacctctaaggtgttgctccttgggctgacatatttcctggcttctgaattgctggatattgcagaaaacgttggaacaattaatgacatttctgggaaagcaaggcttttcctagttcttcctgatgcctttttggatgctttcctcatactttggattttcacttctctctcccgcacacttgagaagttacaggtaagctatatttgatgtaatttttcttgtctgcttttataatgatgattactccctccgtcccaaaatataacaacttctacaccaacattctcttctcaaccaatcacaaccctccaccattcaattttctcacctacctccacttctcatccaatcacaacccaaacctatttaattctatctactttcttagtaactgtatccaactctaaaaatgcttatattctgggatggagggagtagcattttatccatgttttctcttttcaataaagtcataacatctgatgttttggtggtggaggaaataagtgcttgcaattcttttctgatgcgtaactaactgtgatctggtggagttactagtgtatgaagaacctatgatagtgatgttaatatcaaaattctaatggtgttatgtgtgctcacaaagaggacaagtgctttaaacagtgtttataatttcataaccaagtctgttgaaccatgccaaaatagaagtatgtattgtgttgcttcttaatcatcacctttttttattgctcatcaggctaggaggagctcagtaaagctggatatatacagaaaatttactaatgcattggcggtatctgtaatagcttcagttgcctggattggttatgaggtatgcaaatttgactttgttaatcaatagtgcatattggctcactgacctatgttcctggattggttaatcagtaatgtggtgcgtattagtctcttaagttcctgtaagctttatgaacatccaagtacgtcattatcacatggcattccaaaattgtgccctctgaaaacaacaaagtcttctttataatcaaaatttatctgctatttttagaggacacctctatcagaatgtcttctttgcactttagtgcttcactatttttatgatgtcctgataaagcacccatggaaaatttggatgattcattttttttcataatacttgggttctaagcctgatcataaacttcttctctgcatgagtgtgaaaaagaatcatggaagacattactcacttcatgttctgcaattttcttcatgctgatatgagagatggtttcattcatctgcagattttttttcagggaatcatctgttttatagcattatagctgtgataaataacctgctctgctcaacaagggcttcattttgcaggtctatttaaagcgacagatccctttagtgagaggtggcagagcgcatggatcataactgcattctgggacgttcttgcatttgttttgcttcttgtgatttgttatctatgggcgccatcccagagctcacaaaggttaaatctttgcctcttcaatgactggaaatgccatagtgaaagtagtagtgtagcttgaaatgacttgaaagtatctgtgttgctacttgtaataaccagcttatctactcaaaatgccgatagctcgcctggctgcctgccatcactagaaagtagtaatgtgtttttatacggcacaagaaggttatctttgaaagcgctctaaaattgacatgtcaaaccttgtccagatacgcatattcaggcgaagctgccgacgacgatgatgaagaatctcaatctctgacgaaggggaccgacggtgatgtagggatggtaaaggttgacaaggacagaagtggtggtgtcagtagtgctttcagcttggaagacgaggctgaggaggacaaaagagagtgacctgctggagcaagaatgctccaaggttcctgagctttcttcttctttttggtggtgatttgatcttctcttttgtaccttctcagttacacaggtcatgtagaagcgcaccattttatccattcctgcgaggatagtatgttcgtggtgttccatgtggagtttcacataggccaggatggtgcacattatttaaatgactacacattcacaacagtgtacatatctgtttttgttaccggttgtgcattgcctgatgtatcatggtatcatgtatgaaactggtgaacgcagtgtttgacagatctgtttgcctaattgactggaagttgcagatgaaaaatagccaaagtttttaatccaaaactccagttctcctgcactagcactaaccatccaattacttcaatgcttttggttccaagacctggcatcaaggtatttaagccataacagttcaatctttctattgttaaagcatcagcagattctcgtgagaagatttttcaatagcggattctatgcacgggatagataaaatcgtaataaaacactgttcgttgtcgtgagaagattttttgatagctggattgtatacatgagataggtaaaggcaatccagatcctctgcaggcagtattgctcactgacatgtggatcctacatatccttaggcccacatgttagtgaagagtactgcactgcagaggaccttgagggcctgtttgggggagctttagattctgagaagcagctgtttggtagccagcttctgaaaatctagaaaagctctgaaactcagcttctccagcttctgacttcttagttcatttttcagaatatgtaactacagattctcagaagctatggactgtttgggacagcttctagcacccaaaagctgcacctgggacaagcttgtttgagtcactcaggtaagagaaacaatccattttttttcagattttaagaaattgtagttataaattcagaaaataaactagaaaccagaagctagaaaatctagcttctaccgtatcctcaaaatgtagctaccaaccagttatttctcggaatcttaagctctccgaacaagccctttatcataataaaacactgttgtactctctagctgaagctgtgcgtgcagccttgagtccttgacagctgacgttaaacattccaacggcagatggcatcatggcaaacaggcaaagagccaaagatgcaggctgagcatataaaacccttgctggtcaagccgcggcatgactgacaattgcacaaacatgcgtcaaagaagtacaaggccaaggaaagatgattacaagtcactggttaactcgagaattgatggctgtgacaccgttcttgatctaggcacaagattcttcacttcagccaagcaattttctcatcaagaacgaaagagtacaaggatggcatgacaaactctggattcttacagagtaaaggctttgtctgattcttcctccctctgtagaacggtttgttctatgttgtgagttatgacatgctttcataaactcctccctatttacacaaatgaaatcaggtgagctccccttctaacttgggttcaaaatgagaacactgtaagcggtttgaacaacacaactaggcatctacaagccttaccttctgcaattctgaactagagtctagaggtcatgagttgacatgcttgtctaggaaagcgtttgccagatttctgaagctggtattagcatctccagccacggcatactctcttactgccttaagtacttctggtttcagaatatctttctttgtcgaagggttacacagataatataaagccccaagtgcatagttcacctgtgaaatcattggaatggaattattcgtataggagaaactacagaaaagtgaggaatcaataagaaaatctattttttcaaaagaacaaaacattcatttcagtaattggatagtgttgaagttatggtttcagaaatactaaccgtattcttcactgggctagataagcattgtatgaccaacggaattccaccgcaatgagtaatgactgaagcatttgctggatctgcatgtatacaaatagaccaataagattttaaaaaaaatctatgtttgctggaaacacaattaaaaagtgggaacattaaaagggaaaattgggagcttgaagtattgcattgctcaccggcacaagagttacagattccaccgatgccaaattcgataagcctttcgtttggctccgtaatgcagtccaagaacaattctaggatatttagctgagaaagcaaaacagatagacaagttactgaacatgatcgctaattcaagtcaatccttatagcacatgaaatctgcacaaactgttcctaaagaacaagtgtgcgagataacaacctggcgcataaaggtgtagttataaggatcatatgcgaaattcgccaaatttgcaacaattctctccttggactctgcgataacaaaaataaaatagaatcaatgaacaatgtttaataagcatccaatgccatgtaaactctggcgtccatgaaccgatgaacttattctactcgacagtataatcccgaattatattttcatttttaaaaaatgaactagcttatgctggcttttatcaataggagaaaaatgcagaaacaattcggctgctatggacaacctaacgacggacggtcatctcatcatgaattgggtttgcaagacgagaaatggaactagctgaccttcatccgtggcctcctggaactgggtgacgagatcctgacgaggcggacgcaaatcaaacggagaaaaaaaaatcagctgatcagcgcgaggattttgcaggataaaccagtcgaatcttttccatgagccaaaaagcaaagcaaaagtgagccaacctggaggtgctggtctctcggggtgccgtggcgtccggtccgctcgacctgccgctgcgcgttcgtgaacatcgatccccctccgacccggcagagagagagagagagagagagagagagagagagagagagagagattcccgatctgctcaccgcgccgccgtggttgggggggagaaacgctgctggtggtggtggcggagccgatgcccgcgggaattgggggcggtggtctcgacgagctccccacgcacggagagcctcggctcgcccagcggaagcgagggggcacctctcgccggagtgatgccgccgccgccgtgtttcgtcgagaggggtctcgccggaggggggatttgccgccgccgtgtttcgtggaggagagagagaggggagagcggggaacagctcaatccgggccgtacgacatcgatctaacggtttcggatggggacacgtcatgcattgaaacacagtttcgggctcttttttggaacgaaggattttcatgggaaatttatagggtttatactgctatatacgtactgtacagctcatatacggttagatatatacaaccataccatagatcaatataagagaagagcatgttcatatgtattgcagctgtttaccaccattgatcaaattcagttatacgtgagtcggatagttgggtcatatgcatagtaattttcgatgtaactatggaattattttatatttttccaatgaagctctttggttgaaagatctggctacaaaatttttattggaatcctttctttcctccaccttttaacttttttaggatttcaaacaggagctcaaacctcttggttttgatttcctttgaaaagtccaattcaccgtgtctcttcatctctcttctcaactctatcttaataatacgagtatctaaattccccatgaatttcttatgaagtatctaaatttccttcgaattccctgtgaagtatctaaacaaccgttagatatattcatgtgtcataggtagtgggccgaggggtcgaggccctagggataaggatagagtcggttggataggattagattggatcctccctccatctatataaggatggtttgtatcgttattctagtcaagcaatgaatcaagattagtctctcccaacctaagtccccttctcatccctagcagccgtcgccgcccggctatcctcccggcggtgtttacccccctatgaatcctaatccataacatcatgtgttttcaattcccgactttctatttctgcgtttttactatttatgtgtttttttcaatttctgcgttccaaaggagccctagcagcttagcaactctgatctttccaacgttgaagtatcagtgcatcttgtaatggattttgctcttcctttttttttactaacttcttacaaaatctactcttccttgcaatggaggacaaaacaatatttactgcaaaatcaaggcaacgagtagcatagtaaagctctcgtgtggttgcagcagtcacactttacaaaccattgtagtattgaactggtaacctagagctggcaaaatttgggaaaagaaatacagctgatgcagttgtacgtgagagacttctgagcacagctggggcaaacagattcagatgttagcttttgagcaaaccaaatactgttaggttcaagaactcagggtcttcttgttggtgtcttctcaatctgtgacgcggagtggctgttcattcttcacaatcaactcaacttgattctggtcagcccatacagctgcatccagatacccaagctcatataatttgtctagaacctcgtcttcggcgggttccagagcccagttaaacagctgtaattgatttgagaattgagacagtgtcaaagtgaatcaaggtgagtggtaaaaattgtgcatttcgaaagtgactgacctgtcgggggctagctctgttctccggattgcagtctggactaataccaatcccttgcaatcctagtcgactggctgggaaagcacaaattcgaacctgcaattgtaggcatagtgtcaagaataagcattgcaaaacaggcagcatggcacattgtcctgttgtatgcatcaaagatgtgtacacaaagtagtacaacgcaactggttctgctaatggatatcgtggggggcctccctcactgtttccggtaaaaaaaaaactcagagtagaatatttttggagacagagaagccctcaactcacaagtgtgatgcatcctgcatgagacaggccaacttgcacacgcccattcagaagaagcggtttcagaattgcacattcaaatttcagtacagttttttaaaacagattgctcagttatggaaaaggaaaagaaagaagataccccaaattcaggttatacagttatcttcactgtaaagtataaagagagcaacagaaaatgtattaaatttgagaagaaaaacacattattatgtactcagcttatgatcattttagtacatgaacacatcacagtgcttgcacctactacagaacaaaacatgtctgaggtgtccctatgttgcattgttcaaaatcatagtctaaccaagacagacatgtcatacggttttcaattgtaaaatcaacaatcagtgggggaaatgcttttcatacatgtgcagaaaactcaatagttctagtgatcagaataattttgcagaaccaaaagaagttatgacatactgtttcggaagcagaagttggtggcataaacaacgtaaggcccccatcaatgcacagcctgttccggaagaaagttgcaggcctgggagctaaatatctgaaacaagcacacccaattattcttaaacttagaacacaaaatatagaagatacatacagtacgagtgaggaaaagttaacatgaatcttacccaggaataaaagaggatgtaataactgcactgattacatcatcttttgagtcaaattggtcaaccagtaagcccctaggcctccaggacagctgagtaatagcaactgatgagaagaagttaagtgttcttaattattaaatccagttacttgtcagaaaataatgtagcagaaaatacacacagcaaatatgaataagcaatggttgaacagtatgaagcttaccacggatccttccgttgcacctaatgtgcacatcatctgggagaaacctgtctagaacatccttgagtacagcctgctcaagtgcacaagattacaaggttaaaaacatatcattcaatcagccagcacatgaactatttagtgacttgagtgccatatatgtctgtcgccttcagcgtattttttaaaggatacaccaggttactcatcacagttttctcgaattattacagtctaaacaccaaggtattgcaaagttgaaacatagttggcaaattggtcataaataaaccaatgatctatcacacatatagttgggtataatttacacaggaagcaaactcacatgttggccgcaagtataattaaaagtaaacaataaatggaaacagaaaacttaccccaaggcgaaaggctgtcccattgctccgacagttatcagctagatccttggtcacttgcaaagcatctcgcatcgtgttcccagatgcaatcactgcacagattatggcaccagctgatgaaccagctaacggagttctttcctaatgtaagtcccagataaagaaaccactataagaaaacttgctaaaaaaaaaagcagcagcatacatacaaaatgtatcacacgtaagtcctaaaatcacaagcataggaatgcagaatttccatgcataaaaatagcaggcaatgttaccacctagacagtacagtagcataaaaattgagagctctagccagccatggcaccaacaagctactcctactactcctactaagctaaagagaccaacacggaaattcgactgttgttagccacaatttcatctcgaaagtaacccgctcattggctaaagagaccaatgtgaattggattgttgttagccataatttcatctcaaagaaacaagccccaatagctaagcagacaaacgtaaattggattgttgttggccacaatttcatctcgagagagaaacaatctccactatcgtaggcacacggatctcacaattcatctgagcagaagctcctgtctcctactgcaaaaatcaagtacgcgttcgcgtagaagaggtaagagagatggggggtggacgcgcaccgtgaggtagcccctgtcgatgaggcactgcgcgacgccgatgtggtaggggaagagcagcccggcggcggagaagctgaacccggggccggtcagctcccgccgccgccgctccgcctccacgtcctcgggccgctgctcccacaccaccccgtccttcgcctccacctcctccaccgccgcccccccgcccctccccgcgcgcaccagcagcgccgccagccccaggaacacctcccccgtcctcaccgcgagcgacctcttctcggtcccctcgggcagcggcggcggctccgggtcgcggcccgcggcggcgcgggcgagcatgaagcgacggaagccccgcggccgcgcggaggcggaggagggaggggtggaggaaggtggctgcggcttgggagggaggccggaggcggcggaggagaggagggaggaggccatgggggctcgccggcggccgccgacgacgacacgtgtgcacgcgcggcgaagcatctgctacgtcgttaattcgtttaggtgcgtggaaaaaataattaaaaaatcgatgtagttttcttgtttctgtccttttgttttcgattttattttccgtgggcaaacgaaacgacacgtgtcgctgcccaagtcgatgtacgtcgtagctttggatagtagaactccgtatgcaggaatttttcgtgtcgtggcattggtatggctctgatcggaagtagtatttagtttcggtatcacctatatatttttcgacaaattttctcctaaatatttgacagatataattatagtataatcgtaatataatcggcacaggtgataaccagaggagacgtggtgcgcgttcaagaagctggatcgatttgtgtcgcgactccgtccaaatcgttgtttatcataaccttttgaaagatcgggaaccctagtgcacatcacaccctaattcgatgatgaagctgttgccctccacgctcaagctgtcattgtcctcaacgtcaaagggctggtgcggtctcttcctcgtcgtcttcggcaagtacgcgctcacggatcacgtcctcgctgacaactctcacctcaaccacgtggattgggcacagatggactgcgtcgtcctcggctagctataaggcacgatctccgccgacttgcttcaggaagtcatgttggccacggctacggctcgctctgtttggtgtgatctcgcccatcaattcctcggcaaccaagaatgttgcaccatcaatgtcaacgccgagttccgcaacttctctcaaggcgagctctccgtcaccgactactgtcgttgcctcaagtccatggctgacacgcttagcgacctcggcaaacccgtctccgatggtgcactcgttctccagctaatcaccgggcttagtccccgttttggcaacatgcattcacttttgtccatgtagaaaccattcccatcgttcatggatgcacgctctcagctcccgcttgaagatatcatgaagggctctcaaccggcagaaactgcttccgtgttcgtcgcagacaccgtcagcggcgcctctcgtcccgctagcagcaacaacggttctggtggcgttccccagaactcgaccaacggctccgtctccggcaaaaacaactcgcgaaaccacggctgtggccacagcaactccgatggctccggcggaaacaacggaggtggctagggcaacaccacctacgcaaacaaccaaggccggcccaccacctcccccatgaagcaggccgctgttccggcccagcaccaggcccagtggccgtccccttacaattcctaggccgggacaattcagatgtggcctgccctggtcggtgaggactttgatctgtgctctttgtctagctcttgttgatcttctcataaaaagggtaaaagatgaccaataaactaaatagtgaactttcgatccaccgccgcaggacgcctgacatgatgaaattgacggaattgctcgatagggcaacggaaagagattttagatgctaataaagtgaatgatgaactttcaatgctataaagccaaaaacgaaaacttttgttactataaatacaattttgccttaaaactttattgtacgtactttctatatctaaagtaatgaaagaaacaatctttctcgaaagcacattgggccacgtagtgttaaaaataatggccatcgaatgaatgcatcgagaatggatggccatccgatcattaacgacatacatgcggtagaaaaaaaaaacatgccgtatgcacttccctcccgagccttatagtgtctcctggcaagaataaaaagaccactgtatgtgaaagacaataagttatactagtttatgatgactataaccatcctgttattaatggtgtggatgaaatcttatctataatgtttagaatttgagtattagtttgtgcaaaaaatagaaatgctaatcaataacagaaaattttaaacagtttgctattgtaagatatacttgcaaggatgattttgtaggcagtggcatagtagaaccctttgtgtcattgaaatgaccatatgtgttattttgagcaaaggcatgatttaatgttgtcattgttcttacttttctttttaattcctacaatatgcatgtgtacagccctctggaaattctgcaacccaaaagccagaaccatgtcaaatgctccctcctgtgctcactcagacgatcttttaatccttgagttgcatgatcttcatgataacaactgaagttaacttacttttatgaagtaatttgttaatgtatataatattgtacgacttagtattataaattgcattttatcttattttttgttaaataaaaacacattatatgaaattacattcttgatgagtgcttttttttttcttctagcagctgaacttccagccgaaggcacgtgaaccttcttgattcatcctttttttttttcttttcatgcaaccattcctcccttcactttcaatcctatgtgccactgtgccagcttcattcaccatatcaatccaacagtttatatatttttcatgatgtggctcattctggagcgacaatacattttcattcgctagcggcctgccaacgacataaagattgctatgtacacgatccaatcgtccaacacgcatatgactaagtttaatcaatggttaccatgatttgaacctctaccctttgattaatttatggttatacggcttcagtcagtcttatgtggatagcacaacttgatcgaatgcatagtgagactctcgatacaaacacacgaagaagcaaaagatttttctttgtgaaagatcaccaatcttaatttggagccctcttggtcgacttgtgtaaactcattcagcatttggtattcgttcaagaaaaaatttaattcgttcaccatttggccaccatcccagaggtctcactttggagaccaatccccatcgggatcgtcgccaaattgctacaggtcccaagtcaattctctctcgaggattggcctggatccgatcaagattaggcttcctatgacagcgtttctccagcttccaggtaaataaatggacgtgcctcattcccctaggacgtcaacttgatcagccactgttgtcggttcagtgcccttaaaacttaaaaaaagaaccgatcatttcattagattaaaccctccatcaacattggttaactaatgcaagtactagtattagtatacaataatatctctcacattttgtcggcaagaaaattgcaactggagaattggagggttttgttcctctaactacaggattgtcagtgtcaggacactaaacacacggtcgtggccttttctggaaaaccggaatttcgctggattttggtagtacggattttacgccaaacagcgcaatttgttcctaaaaaaatgttaatttcatttcttgaagtcactcgtcagtacagcatgttgtcttaggcagtacagcatgctgtcagttcagagctccaaaccttaaaacacactagtatttctttaagcaccttgtcagtacagcactgcactacaacatcttctcagttcagccacatactccgtaaagcctaaactgactggctgttttaagtttaaaaaccattgcaatatttgaaataaatgttaagcatctcgagatctgcaattcgattgatctttaatcttttgtcagcagagcaatttgtggcttgatccgggatcgggtgttttgtagtaattcttctcgaagctggaggtgttttgtagtaattcttctggaagctcccgtgatccgaagctggaggcattagaaacagtttagccctgtttagttcacaaaacaaaaatttttacactatcatattaaatgtttggacggaatattaaatatagaaaaaaactaattacacatgattgcgtgtaaattgcgagacgaatcttttaagcctaattgcatcataatttaacaatgtggtgctacagtaaacatttactaatgatggattaattaggcttaaaaaatttgtctcgtaattttttgacgaaatctgtaatttgttttgttattagactatatttaatattgtaaatgtgtgaccgtatatccgaaaaatttcccctgctaaacaatgccttattttctaatgagcaccgactcaccgacaattctgatcaaacaagtctctgaaatgagatcagaatcaaaagcattggcaatgcaacagtcatgtttcccactctcaataacaagaagcaactgaagtttatttatttttatttgtttttgctttgaactgaagatttcattcgaatccaactatagttttgatgatcatatatacttcacaaaaagaagtaaacaaaggtacaaaagcaagatcaaaagcagggtagatttgacttgaaaagatgcaaatttgggccgaatttatctgtccctgctattaccagcactgataatttcattttcttttcttttttactgtaacgaacgagagagaacgaaagagctaggcgcgcgtccaggccaaggccggcggcggcggcgccgccgccgccgcgtcaccgggcggctgggtagtcgaacggcagcggccgcacctcgtcggagagcgggtccttgtggcggtacccgtagttccggagcacctggtcgtcggcgaagttgagcgcgcggttcatcccgtcggcgcagctcttcttggagtagatcttgttcggctcgccgccgcacggctggcacccggtgaagtgcgtcacgaacggccgccgccacccgctctgcccgccgccggcggggcccgggacggcgcccctcaccgccgcgttcctcgccgccgcgtaccgctcgtgctcccgctccgcgtgccgccggcggagatgcgccgccgccgccgagggccgccgctccgccgcctcgtacctcgccgcgatgtcgtcgagccggtcgacgacctccacccagtacccctggaagaagtagcccttctcgaggtaggtcttggccccccatttctcctcgtgctcggagaggaggtagacgagcgccgactggtcgtcggactccttgtcggacttcccccggagcgtgtcgtggagcacgctcccccacctggcgtactccggcgaggcggggcccatgcgcgcccacgcgtccatgaagtcgagcgaccactggcagttgcggatgaggaacacgccggcgttgagcccgacccacgagcgctcgccgtacacctccttgttccagccatagacgacgaggttgtgatccttgtacttgtggagcgggagggagaagtccatgtcggtgaagacggcgtcggcgtcgacccaccagacccactcggcgtcggggtgggcgagcatggcggcgcgcacggcggggatcttggcccagtaggcgagcatcctgggctggagcagcgcgttgttgtagaggagctcgacgccgtggaggcggcagtagtcgaccttgttcttgaggaaccggaagaggaggtggtcgccgccctcgccgcggcagggcggcgcctgcgagccggacaccatcaccacccgctccctccccgccgccgtcgcgttgagcccgcgcgggtaccgcagtcgcatccacgccgcccgcctcgcgtcccacccggtgatccccccacgccgcccgacctccacggcgtacgacaccctcgagtcgtcgtagaacgtcctccccgccgcgcccggcccgccgcgtacgccgacatcggcgtcgatcgccgcggaggcggcggacgtggaggcgaccgacaccgggagggagcggaacgcgacgaggttcgtgacgggcatgggcgacaggaacgacgccgtggccagcagcacgagcaccgccgccaccgcgcccgccgcgaagacgagcgcgtcgtgcacccgccccgccaccgccagttgcccgtgctgcgccctcgcccccgccaccccgccgccgcccttggatgccgccgagacgccgaacggcgcggtctccgatgccgccatggccggtctcgcctcgccgaaccgaactcccactctactcgcgagcggcgcgctcgcggtgtgtgtgtcactgtgtggtgttttaaagcggaaaaggccaaaggcgtctctctcttttgtagtatagcggaggcagcggaaagcggaagcggttgtggacttgtgctgctgcgcggggtgcggggttggttgttgttttgggtgtttttgctggggtttttgggcgttttcgcggtgattgcgtgcgggtgaggacgcggctcgcggaggcacggcggcgaggcgatggatctggctgtgtgtgtcggccgtggccgcgcgcgtgggcacgtgacggtgtcgcggggtgtgccgtgcgcctctaaccccccggccgagtcacctcactcgttttttcgcacacacgctttttcaaactgctaaacggtgtattttttaaaaaatatttatatacaaatatcttctatctattatatactaaaagtccattaaacttcttataaacgctctcaagccgccacgtggtctcctataaacgcttctaagtcgtcatatggcgttctaataaattagagaaattcctagaaattctaagaaaaaagcaaaacatctgtccatccgttttcacttaaattggtggacccattatttcaagccgtcagattagtttaaaaaaaatctttccacatccacctccctcctcccacacgtaaccctctctccccttttgtacatactctgtcacgtaccatgtcaaaaaaaaatctaaaatcttcagatacgtacgtgcagcccacatatatctccttttctctcaacaccctattggcctattttatagctagcaattcaacataaacatggtgagttaaatggtcacaatttaatttagattgggagtaactgataacttaagatcaataaaaatccaaaatattctgaaaaaaataaaagttaaacattgaaccattgatttacgcatatacaggtgaactattattttcaatcattagattagatcatactaaagtaattaatttctctctcctaatctcatgcgtatttgcaagagagaaaaataaatatatactattctcccggagaaaatatacgtatgtttatatgcatgtacaggagactattatttgcaaaaaaaaaacatgaatatgtacgtacataaaaaaaatattaaccatgtccttctaacccttaaattagaaagtttatacatgatcagtctaccctctgctgtggctcctttcgatctctccagtttatttcctagggtcgttgttgactaggctatatcttatatcttatatttgtgacagttaatttattattaggagccaacgtatctgagatcgttgatatgcttacccagtccaaaatgaaaatattggttaaagggtagtctaaaataaaacattcataataaaatatggcccaaagtaaaatttgtgacatatatatagcaaattctgattaaaaagttatcatatggaacaatattctagccaatttttatatctttcttatccaaataatctcaacaattactccatgttttttaataactgattgtggatattatattcatttacaacccactttttctatagaaaaattataaatatgttaactatcttttgaatgaaaaatattacatggaaccacattctatcacttttcatattattatacatagcattaacaattagcacaaataaacttgataacatatattgttccatcatatattaccccacgaacatgcatagatgaattagatcaataatacgaagaaaagaaaaatatcaaaactcatattacctcgtatgttcatgaattattactactcaagcagatatttttccacgtgtttctcaccattgaagctattagattatttgaagtagtatcgaatgatcaactctgcttattttcagaagagaaaattatatctgtaccactaaaatttagtagaccaattaacaccataaacaaatgtcaactctattccataaatggactcaaaacttttaaaaaaaatgtatcactttcatcttatctatgtgtcattccctgaagggcaccaagcattgataacatagtttgctacactactatacgtatggtgggggtatgcatatgactaagttgaggtgacccagtgagaggctactattcgcaataaagttcaaatggcttacttaccgatgtgattctttaactgatagtgaattaggtattaaaattgtgctccacactaatcttgaggagaacaactatgtcgatacgggacacatgtttcaaagtataagagaagaaagccttcgtggctacagtcgacttcacccattagaggggcatttagatcaaatttaatggttttatcccatgaattggtaggagtaatatttcaaaatatttatgcatatatttaaacacaagcgagacatgaacaatttggtatgaagtagagatgatctttttgttgtgtctagacatttatttttatataattataggtgatctatggtccttataattaattaatatggtgagataggatttctttagcattatttttataaataataaataaacgtttcttataattaatatggtgaagtatgacttcttttagcaatcttttataaataagttggccgcgcatttgcgcgggcttccttcctagttatatactaaaagtccattaaccttcctacaaacgctcttaagccgccacttggcgctcctataaatactcctagatcgccatggcactgtttaatctcaccgtcgattttcacttaaattggtgaacccggtattttagaccattagattagatgtattattttaaaagtaatacttttcctcctgtcggtgacatggggccgagggtatcgtgactagaggtttgggtagccgcggtcacccacgtggcctgaccccctcgggggggtcgggcccgaggatgatgtggccacccctccctctgtctccccgaggggtcgggccacccctgtttcggccccgagggctagggcgccccgaccccctgtgattttggcgccacatgtatgggttaggtgagcacagaggggctcacctaaccgcatttattgcgggttggacgagcgcgccacgccgcatttaatgccgcgtagcgcacgcttatccggtccgtgaccggtcgcagtgtgtgaccggtcacagaccggtcagatcgcgggttaggtggcaacaggcggcctgtcacacgcctcgccccgtcccgtcggattgatgagagcctccaggcactcgtccctagccggagccggcatgctaactcctggagttggtatgtcagtcccggccagattcgttccaggcttcatcgcaaccatagcaaggaagtcattgtatgaagaaaggcagacgtgcggcatgctaaactgacgcgcggtggacaagagtgaccggtctgtgactggtctgacgccggtcacgtcataggcagacaaccgtgctcccacgttgcatctgcttccggcggagtggaggtaggtatgacccatcccatcggagggtcattcggacagcggccattgcaaatctccacccattaatgaaggaatgacagggttatcccctgtgtcaggcgagtgacggcactgggcctcactcaaggacaagctgtgatttagcttccaggcgaaggtgcgagccaagtttgggtcaagatagggtgagtccccacccaaaagaagagtaggtagaagtggtgcatgtggtatccccttgagatataaaaggaggaccttgcccaccgaagtaaaggacggagaagagaaaggggggacgactcggagaatacctgagctcatagaggagagaaagaggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaagggggacctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgccgagctcgtactccaccgtccccctctcgccgaagtcttgggcgggaggaggcgctcgaggaggtcgaaagatccgcgacttcgccgcccgcgggtgatggagaaggacggcgagacggggaacgtcgcctcctcgtctacggcgatggcagcacgccccagggcgcgctctaggctgcgggcgcgctcctgcgtcacccgcccgtcgtccccgatccagagactccagcccaacgttggctagacgacatgaccaacttggtcatgacggcgcagcagcgcctaggtgccggcgggcggtcctccgccaccaaggcctctagcgctgctaccgccggctccgtgtcgtcgaggcggagggcgcggcgagcggcggccgttacccgccgttcgtccgccattccctcgtcaacgcctccgacccaagaagatgtgcgtggggggccggatgcccgcctcaatatcgagcgccggcgcaatggtcgtcgtgctgcccacgcaacggaggacgcttcctcgtccggagcgccacttcggtccgggcacgggggccagcccccccgtgtccccggttggcggtgccggctgtcgagcctttgtggcgagccttcggaacgtccgttggcccccaaggttccggcccaccatcaccgaaaaatacgatggaagcgtcaaccccgccgagtttctccagatctacacgaccgggatcgaggccgctgggggtgacgacaggatcatggcgaatttcttccccatggccctgaaaggtcaggcgcggggttggctaatgaacttgccacccgcgtcggtccactcttgggaggatttgtgccagcagttcaccatgaacttccagggcacatatccgcgcccaggtgaagaagcggacttgcatgcggtacagcgaagggacgatgagtctcttcgctcgtacattcagcggttctgtcaagtccgcaacaccataccatgcatccccgcacacgcggtgatctacgcgttcaggggggggcgtgcggcacaaccgcatgctcgagaagatcgcctccaaggagccccagaccaccgcggagctttttcagctcgcggaccgtgtggctcgcaaggaggaggcctggacctggaactcctccggtaccggtgtggcagctccggccgcccccgggtctgccgctcggtcagggcggtgggacaggaggaggaagaagaggtcggcccattctgacgacgagggtcacgtcctcgctgtcgagggcgcttcgcgggccacccgaaaggggaggcctgcgagcgacaaaaagaaggaggctggcgctcccagcagggagcgcccgaccggcaagtggtgttccgtgcacaacacctccctccacgacctcgcggactgccgtgcagtcaaaagtttggctgagcggacgaggaagtgggaggaggagaggaggcaggagcgccgtgagggcaaggccccggcggctcccgccggcaaccggcgaagtgaggccaagcagaaggcccccgccgatgacatcgatgatggcgacgatgacctggggttccaggagcctgaggccaccatcgccaccgtcgatgggggagcgtgcgctcacacttctcgccggagcctcaaggccatgaagcgagagcttctggccgcggcccctacccatgaggcgacgcggcgggcgcggtggtcgtaggttgccctcaccatcgaccagaccgaccacccgccgtgcattgcccggggaggacagatcgcgatggtggtttcccccaccgtttgcaatgtgaagttggggcgtgtcctcatagacgggggtgcagccctcaacatcctttcccccgcggcctttgacgccatcaaggccccggggatggtgctccggccgtcccagccgattatcggtgtgacgccggggcacacttggccgctaggtcatatcgacctcccagtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgacgatgccgggccccggtggccccatcaccatccatggcgacctcaaagtcgcgcttgcttgtatggagcagcgcgcggaccacctcgccgcggcgtccaagcccgcgggtggtgacgagaggctcagcacctccgtccctgccgccccgaggcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagaccggcagacatgcccggggtccccagggaggtgattgagcaccgtctcgccgtgcggccgggcgcaaggccggtccagcagaaagtgcggcggcaggccccggaacgtcaagccttcatccgcgaggaggtggcgcgacttctggaggccggattcatccgtgaggacatccatccggagtggctggcaaacccggtcatcgttcccaaggcgaacggcaagcttcagatgtgcatcgactacaccgaccttaataaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccagcaagcttagggatgtgcaatgcgtcaccggctgcatggccgccctaagtcggttcatatcgaggctgggagagaaggcgctacccctatttaagctcctcaaacgctccgggccgtttacctggacggaggaggctgagcgggccttcactcagttgaaggcgtacctcagttctcccccagtcctggtcgccccagagccagatgagccgttgctactctacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccaaggcccccgacggtcagagctggccctctgcccgcttgtccgacggtgccaggcgcccccgacccccaggatggccccggggccactgcgggaaggccgcgcctgtcgccctctgaccccgaggttgtcggcgcagaagtcgagggcgccccgcgtggcctctcggatgaagagcgccctggagatgcggcccctggcgaagaggatcggccccgccgaaaggtgcagcggcccgtctacttcgttagtgaggccctccgggacgccaagacccgataccctcaggcccagaagatgctttacgctattctgatggcttcgaggaagttgcgccattatttcctggcgcatcgggtctcggtggttacgtcttaccccctcggccaaatcttgcataaccgagagggtactggacaggtggtgaaatgggcaatcaaactctctgagttcgatttgcactttgaaccacgccacgcgatcaagagccaggccctcgccgactttgtggcagagtggaccccagctcccgagcccgtctccgtcctcgaggccagctcgggcccctcgcagctgcctcacaccgcctactgggtgatgcagttcgacggctccctatctcttcagggcgccggtgcgggggtcacgttgacctcgctgaacggagacgtcctcagatacctggttcgcctcgactttcgggcgaccaataatatggcggagtacgagggactccttgcgggactcagggtggcagctggactggggatccgccgcctgctggtgttaggcgactcccagctggtcgttaaccaggtctgtaaggagtaccggtgctctgacccgcagatggacacttacgtgcgccaagtgcggcgtatggagcgccatttcgacaggataaagcttcggcacgtgcccagacgggataacacggtcgccgacgaactctcaaggctcgcttcctcgcgagcccagatcccaccgggcgcctttgaagaaaggcttgcccagccgtcggcgcgacccgaccccctaggggagacggacgcgcctgaacggcctccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagtgtttctattggccgacggctctcaacgatgcggtcgacctggttcggcggtgcagggcgtgccagttccacgccaggcaaacccattagccggcccaggccttgcagaccatacctctttcgtggctgtttgctgtctgggggctcgatatcctgggtccgtttaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcatggatcgaggagctgccagcggtgctctgggcgaaccgaaccacgccaagccgagcaaccggggaaacgcctttcttcctcgtctacggcgcggaggcggttctcccatctgagctcaccctgaggtcccctcgggccaccatgtattgcgaggctgatcaagatcagcttcgcagagacgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcaggtctcgggctcgggccaaccccgcaccccccccgggcgtgcagggttggccgggggctaccacatgcatatacttatcttttttctcttccgtatttcaataaaagcattttcgatttcctaaggactgcgtctgtgccattgtttccttttgaataatcttggcttgaattagcacgctcgtgctcgatcctgcccttggtggcccgggccggctaaaatcgccaaaaggggcccagaaccgagccgtgccccggggcgtggtgaactccgggggggaatcggcaaaggcccacaatcgggttatccataaccctcggtcaccacgctcccggcctggccagtctcgacacgtggatctccccagtctaaagttataaaaaaccacctaatgttgcactattaatcagcgaagcatctacctatattcatactagtggaaccatgaatagagtacccaccagttggggttttgtttattctagggtgaacaaggtaataatatcaatagcaataataatgtcttaacaaaggtaaataggcatggctaaataaaacagtgataacgcgggaatgtaaataaagcggtaatgcattaatttaaatcaaaataattttataaacagggattcaatatgctcaaggatgatgtgacttgccttgctcgctttcccaaacgtcggcttcaacttccacgaagggcggatcttccgatgctgcagcgtctacacgaccaacaaaaaagaaaaggcttttactctaataaactccatataacaagcagaaacaaagcacaaaaatgggttcttgacttcttaaggaaaaattagagacttgaacggtctaattccgagttcaaatggccaagttatggccatttgaagtttatatgctctttaaatgaatatttgcgaatttcttcatttaaattttaatttaaaaagggtttattgcgtcagccgaggggagggggcgcgcggaccgggtccatgggagtggggcccacgcggcagcctcacggtccacggtggaccgggtgcacctggctcacactggccggcgccgtgggtcccacgcgtcagccgcacccgagggcgcgggcggctgacggccgggccccacacggcagctgctaggcgcgcccggaggcggccacgccggcgtagcggcgggaggcggcgcgcccgcgcccctatggtcgtcggcggcggccataggcacggcggagcggaggccgagagaggggaaggaaagggggaaacgaagcggcggtccacggctcaccccgggttgacggcgacgacggaaacggcgaccggagcggaggaaggcggcggcgcggctcgggtggacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcgacggcgacggcggagagagagagcgacggcgcgagctatattccagcggggagagagggcggtgagtggcggaaacggtggtcgggagctcagggagggtttatatagggttgggagtgagagagggcggccggaggagggggaagtgggcgcgggagacccggccgccattaatgccgccggcgaggttaggggaggggtttccaaacgaatccgagggagagagagagggaaaaatggggggaaagggggaggggatcccggggaataattccccccactttattgcgcgcggggacggcgggaggcggcgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgcggggagaggccggatgggccgcgggggagaggagagagggggagggagatgggccgagccggcccaagagggagagggagggaaaggggactttttagagtttttctttttataaaatcattttaactttgtttatttcttaacaattattatatgtgctctgaaaattccactaaaatttgagggctccttttagaccaaggagaatttaacaaaaattctccgggccacatttgaatttttcttgtacgtattttaatgtttgccaaattcttttcgaattttaattaattctattattccttttagaaaatgatttttatttcgggatgaatttatcaggacgtgacaaatccacccccttacaagaatctcgtccccgagattcgaggaggctagcaagaagataggttgggtggtcttctcttcttgcctgacttcttccgctccgtcttctataacaaacttgcctagcacaacttctccactctggaccgcttggctcgatctcctgttgcagatggaatcttctcttcacctgacttttccctggttgcacctctagctgacttcgactgggctgcggcattgaaggatggggcttcagttccagaacttcttataactcatatctttggagtcaacctcatacaagttaccaattcatgtcatgcgtcaacactagcttgtcattactaggataccatgtttgtcatttacttctaacttgccaccaactgcctcatattagctttcctggtctccgggtgctagctacttctgctatttgatgcaagggtcgataactttgcctttgaattatgtttctcaacagaaccaacttatcccacttgacgtgctttgacgtcttcccaaatggctttactgttggactagttatggtctgatcgtgatcctgccaaatctgaagcttcgttgttagatgtgattttaatctaacatctgtagattatcttcgaacatatcacttggttcataactgggaatagctctcacgaacaaacaactcggattcactttctttatgttcagtttactttccactattctcttcatgttgtcatcttttagcattcaacgtcttcctttacaccttcgaccttgatgagttccttcccattggatcatcttccaagacatggcattgcctggtaaccggtgcctgcacttttcactccgtgtagcatctgataccgagttgaagatttcactccttgctttcatagaaacacttttacctaggtcatcttgcttactcataaattttttttttcctcaatgtcaaggtgactgttgcagggtgatcagaggtcttcctcgagcgatgcaaagcatgtttctatttatcctttatcaatcacctttcggcctacttcttttcctgctagagaacatctttgccaatctctttgatcaatcatctttcgggctatctctaacaggtggtactctttaaggtgggtagcggacacttctggtggcgatgaggtcctttggcctactgcctttcggtgaaaccttgaagtagttcgtcaaaagctgtgctgactgtcgttgcctttgatccgaataagacacatctgaaactcctagtccaaacaaatgtctctttggttaatcgcttgattttcttttccatcatcaggttggttattaactcaaggttagaatatagttcctctgaaatgagaccctatttctcctttgtcagtaaacaattacacacataatcccatatccacatcttccaaaagaatcctaataggacttgtctgtattacacatttctcccttattacatgaatacaaggcactaccttaaacaaaaagggaagatgcttaacatcggtacattgtttctactatgggttatgattgacacgaggcctcagaggtatggcgtttgctccagtgaccacaggcgagtgacttgtcttcttcttgcataatggccagagtgatgacgcaggttacgcttcggctgtggacaatctctggagaaatgacctagttctttgcagttgtaacaaatcaatgtcttctttactgagttgtccatctaggaacgatcattctgacttggagttggaattggtggttggaaatccttgctaatattggcatcagtggtaccatagttgctatcaccattggagtctttctcagtgtcaaaattgctagggttgtcattctgggtgccttcattgatactatcgtcgatatcttggtgaatgctgttgacattgcacgcttgatctaagtggtcatgaatggggcaagaaccatggttgttggtggtatcatcagcattagtattgctaatgttgttgtctgcaatgtgtccatcttcttggggtaggaactcttgatgcgcaacagaagctccggtgatctgaagtggctcagtgcgctgtctttggttaccacatggaaatactgggacgttggcaatccttctcttgcagttcgtcatccgattatgctcactttcgagttgcatggctttgtccacaagtttctcaaaatcttcataatcctctaggagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcgaaactctcgttttcttagtgtgatcattcctacgggaacatgtgatctcttgaatacagatgaaaactcgtcccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcattgttgctggactgtaggtacttgaacgttggttgcccctgctgggttgttccaattctgtaatagttgaaaggctgttgccaacatgttggtttggttaaccacaatttggattagcactgatgaggtttcgttgatgcttttctcattcccattggcttgggttcttgagtcatcggatccatcattcccatagcctttgttaccagtgttatccatctgtcacaaggtagaggttgagagggggagcatataaggaaagaatagaccagaactaggggcaagaccttaaaggaactaactctttttgttgatgtgttgtttgttttgcttattctgcaagttgattaagcaaacaacctagcacggttacatcacaacccactgatgcaaaccacgcgctacacacacaagcaaggaaacacacaactaacgactctaccctagagggtggcttaggttctgcgacgggttctccaagatcttcactgcttcctccacttcgctagcagatcctgcagtcttccggagcttcggcaaacaattggcgacatcttcttcttcgcaaaactaaccatctagtactagttgaaatttgaagaaggaaggagtaaatattttgcaaatagcacaggggaaaggaggaaaaaggggctttcgcaaatagtttcatttataaaatatgtccttaggttttatccacttggcttatcctacagtcgagatggctctgataccagcttgtcgcgaccgagaaaaatacattttcccgaacgctagtgtattaatccccgtcccaggaaaagccggggtacaccacacaaatatggtacaaaaggcacatctttattatatcgataatatttacattattacaaaggcacttaaggcctgacaataaaaaataaacagcagcggactaacgggcctacggctctatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttggtaagcaaattttaaggattaaaacactaacttgggtacattgctcggcgtgcccataaccgagggcgcggctattcgaatagattatactctgatcagaggtgtacatctttacccacaagacacatcttcctcacgtgtaaccacgtgccacatatcaccatggtatacgaacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttccaacagaggcccgagcttaatccttatattggccggggtgctacttcccacaactggcatgcacccaaaccccaccgaaaaacaggttttaggggctttgaaagaggaagagaggggtatgtccaattccaacataagccaaccattccatagtgtccagatgatatgaatattcccaaagtctaaagttataaaaaaccacctaatgttgccctattaatcagcgaagcatctacctatattcatactagtggaaccatgaatagagtacccaccagttggggttttgtttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgtcggcttcaacttccacgaagggcggatcttccgaagctgcagcgtctacacgaccaacgaaaaagaaaaggcttttaccctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggagggggcgcgcggaccgggtccatgggagtggggcccacgcggcagtctcacggtccacggtggaccgggtgcacccggctcacaccggccggcgccgtgggtcccacgcgtcagccgcacccgagggcgcgggcggctgacggccgggccccacacggcagctgctaggcacgcccggaggcggccacgccggcgtagcggcgggaggcggcgcgcccgcgcccctatggtcgccggcggcggccataggcacggcggagcggaggccgagagaggggaaggaaagggggaaaggaagcggcggtccacggctcacctcgggtcgacggcgacgacggaaacggcgaccggagcggaggaaggcggcggcgcggctcgggtggacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcgacggcgacggcggagagagagagcgacggcgcgagctatattccagcggggagagagggcggtgagtggcggaaacggtggtcgggagctcggggagggtttatatagggttgggagtgagagagggcggccggaggagggagaagtgggcgcgggagacccggccgccattaatgccgccggcgaggttaggggaggggtttccaaacgaatccgagggagagagagaggaaaaaatggggggaaagggggaggggatcccggggaataattcccccctctttattgcgcgcggggacggcgggaggcggcgggattcgcggcggcggcggcgatagggcgcgggcgagtcggcgggatcggcgggagaaaggggatgacgggtgggccccacccgtcagcgagggtggcgggcgggcccgcccgtcagcggcgcgcgcgcggggagaggccggatgggccgcgggggagaggagagagggggagggagatgggccgagccggcccaagagggagagggagggaaaggggactttttagagtttttctttttataaaatcattttaactttgtttatttcttaacaattattatttgtgctctgaaaattccactaaaatttgagggctccttttagaccaaggagaatttaacaaaaattctccgggtcacatttgaatttttcttgtacgtattttaatgtttgccaaattcttttcgaattttaattaattctattattccttttagaaaatgatttttatttcgggatgaatttatcaggacgtgacacgtaccctcgaagttgtggacgatgtggtcggcggcgtcccggacctgcgcgcgtgcgctgtcctcggttcctggagggaactcttccagcgctgcccacggggagaagtcagggtccttggcctggtagcttgccagtacgagctccaccgcccctcgggcaaggtccctcgaggatgacttgatcgtctcctcgagctcctcggggagccgctggagggtcccggccatctctgagaggcgctgggcgaggcccccctggttggcggcgtatttcgcggtccgcccgcccagaggcccgcttgccgcccggcgcggtctagatgggagacggcgtcccgaagcatgccgggccctacctcgcccgccaggcggagggcctcgacctccccggcggacgagtccagcgcgccctgcagcttggcgatggtgtgttcggcggctgcgaggcgggcggctaggtcgccgtcgcccgcggcccccccgccgctatgcgctctcgcgtccagcttcttcgcccgcgcctcgagctcagcggcccgctg

SEQ ID NO: 69042 - DNA, 3819 bp, Oryza sativa
aaaaccttgacttcaattctgttatgcgttgcaagtgaagttgtcttcctcttttgcttttaattggcaaaacagcatgcttactgaagagttctatggcctatgggcgcatttttctaaaaaaatcatatctgatttctgaacttatctgaagcattgtctctttttgtctcttcaggctcaagcgtagacgcctcacgttttctaattaaaacgagtactactaaagataagcctacatcatcagtggctttcagatgacttcaggtgagtgcagctgccactagtcctcctcctgtaacctgttagccataatgccattagcattggaccaaattgctgagcccaaaacagaaaggttaattactgctcagaaattaaaccgattaaagtggatgatgcactcacagccacaatgattgtgcttatttttatgcagtgatttggaggcctcttttggttgtctgtacgtgaagctcacttcagagtgagacaactggaaactatgtgttcccctcgcgagccctacaacgaagtcgaccgcatcagagagggggaaaaataatggaaattctgatgctgattgtgccttagtggattggtgactcgtatactctggcagcctgatccggaaatggagccacagcattgaagcgacaacccgtcaacttttttcgtttcatcgactctgaatttcttaaacgtccgttcgtctaaaagtctctaaccccaggtaggcaaggcaggtgatcacggctatcaaatcggcgttgttatacgtagctttcgtccctgttcgctcgttttttttgcctctactgcagttcagcagtggccttggtctcatcatctttgtgcaagttggcatgtatcggaccaggaattttcagttcagcagtgttcccacagaatacgtcttggtgcgttcttcttccaaggaactaattcttatcacgtcgtaggcttttgccatttcggcatatcgtcagctgtctcgaccaatcaatcgatctgacccatttgtgctgcaaaattcctgctgtggactctatatgactcattgagtccatattgaatacgatcatattgtttccttcgtcatattggatcagtattagttattacagagatgatgcatggtcgatgacttcatctcaaacggaaaatggacaataactgataaaagatgatggctgatgactgtatatggtttcctcgatgaaaattcaaatctacctgtattctgaaactttatccacttcagtgccgcctcaaaaaggctaactaaaaaacgttcgcgtgcggtaaactcgtgcgaacgcccgtgcattttaaccgggtggtctgctttttctgtaagtttatatatacttaagaaaattgtattggtggtataaaaacttgttaggtgggtacaatttagtatataaacttgtaaaacgctcatttcagtatatgaatttgtctacttcatgtgaacaaggaccaaaataacttgtgaatgttaattttacgaagttgatgttaattaggatgtgacgtgtatatatgtagtaaaaattcataagagcatctccaacaaactctctattagcctatccaagccaaattttagctattcaagacaaaaaaggagctccaacaaactggccaacaggatggccaagccatctggctggccaaactcgctcgctggctggctagatttggccagccaaaacgcctctccaaacggtgggcccacgtgctattcctttggcgcagtcgtcgtcgccgggtcgtcgtcgaggtcatcgtcgcgagccgccgccgccgtcgccatccccgccccgagctccgccgtcgcctcgtcgagcagaggttggcaaggcaagcggccgcctctagatccggcggggagagggagcacaggcgccgccgccttctgcctccccgcgccgcgccgccgcctgccgcctcccctccccgcgccgccgcctgccatctcccctccccgcaccgcgccgccgcttgccgcctccccaacgatgggaaggaaagaaagggaaaagaaagaaagagaaggaagaagggggtagagataaagaggaagaagagtagtagaggctgacatgtgggtccgttgttattttggagaggattaatagagagtctgttggagtgacgatttagtttgattagccaaatcagatggagagttggctatataggggtgtttggagagtacgatttagagaggctgttggatatgctcacatgcaatgtttataaatttgatctctgctttatccttcattatagaaatgatggttttcatatatttctaacatttatatcattgctccttttttaaaatttttctactatcactttatcatattctattttttattgaagaggtgtatatctaatagtaaccttctcatatatatgtttacacagtatcctaattagccactaaatcaataagattagccatgtagtgtcctttttaccttcctccacacgcaccagacaagttcatgcaccaaaaaagcgttttacaatttcgtgcactagattgtacccacctgacaagttcgtgttccggcgatgcaatttactctatacttaattaaagtttatatgcatcgacagcttatacagcgaaagtttatatgtccgatttggattcaaatatttttacatagaactcccatataaagaatttctataagttattatgtacattggtcaggccgatacatgttcacgtgtctagccaacatgcgaacattatgtctattattagaccaacccgtattggtatcacatgctaccggtcgtgttggccgtctctatagaaccacttgtgtcactaactcgctaccactattaactattggtttgcctttgtcttggagtatttttgattgatcggttatatagtcctaagtcagattattatccataggatatcttatatgtatcaaaattaaaaggatgtacaatgcattttttattcaatagaagtccaaagagttttgataaggggatttattcatttcataaaggcttcgacgatgggggtttttcattttttgagcaaaaagataaaagaccagatatatacgaactacaattacaaatgtaataactactataccaacccaaatcatgatcttaaccaatttgaatttggttttctcgtgaaaatcaccacttgcaaagttgagaaccataaaaagcaatattgtaataagaagaggaaaaaaaaggaaccacaagagattaatacacaaattgttgaagcggccctcccgctacctggcatcttgttgtaatttattcaaaacagtccttgttgttctataaaatacaatgtgaagaagacaaaaatttgtttttagggtttgcgctataaacataatgagtacaagggtgcttttgcaaagcattattatctaaccgaaccatcagatcccccttcctggcctcccccctcggccgcaaggtcaccgcctccgtcccgccctcctcagccctcgcatcacggtggcgtcagagccgacgctgacgctagtatcctccttcccccttcttcttcgcctcaccctattcctcctttgggttgatggtctagcaagcaatcctcctgctcgatcattagatatggggtagtaccagtggtggtaggctagtagcagtagaaagtatgggtccaaaggagggagcggcagccaagacgaggcggtggcgagggtggtgctgcggtgatggtgacccttccctccccaaccttggtgatggggacaaccctaggcgacgacagctgtcggg

SEQ ID NO: 69043 - DNA, 2478 bp, Oryza sativa
cggtttcaccctggcgtcgtttaagagatctcgcttttgttgcatgtccaacgttcgatctttcagtcttcaacgacgttcttaaatgttgccattcggtctgctcatggtaggagttgatattcttctctctctctctcgccctctccttcggcaacccttctacgtggtgatagttgagagcctgtgggggatcttttggttggaattggctttggcaggtcgtttgtgactccttcgtagggctagcagcgtccggtcacatatagcagaggcccgactcgatgctagttccttttttggggagtgtgtgcaggtgctgttaacatgtgttggtgttgctttggtgttcttttttcttttccttattgttgtctcttaaggtggtaatcttataaatttttttcactatattaatatgaaacttgcaccgtccgatgcctttaaaaaagagactgtctatccatttgtcgggtgatttctagtaaaaaatcacccagattttttctacccttagatttatatccaacggactacaaaagaaaataataaatacatatttacttacacaatatttttatcaaaattacagtgcacttacatatcatatcaactgaatttacaaatgtaattttagttatataggactgtaattttatattttaaataaaataactagcgatttcgctagaaatctgtcgtgtgatttttttcccggtgatttcacggatttgctgaccgcacgatggtggaggctgcatgcgtggtcagccggtcgggatgatcttgttcgcactgtgctcgtccctttgggcatgatgagtggagacgatcgccggacgggacgaccttctctgcacttgaatcttgtgcgtaaatctgaaccaagccaaagctaggatcccacactagattacaccaccatgcggccatgcctaacaaatctaccatcgctagaaacctattctattcaattttttttatatatttgctgataaatttttttctagaaatttgacagatgtaattacaataaaatcatagtgtaattacactgcaacttgtatataattacactgtaacttatatgtaactaaaactatatttgtaaattcagttgatatgatatgtaagtgcactgtaattttgataaaactaaagtgtaagtaaatatgtatttgttattttctttaaaatataaaattacagtcctatataactaaaattacatttgtaaattcagttgatttgacatgtaagtgcactgtaatttttataaaaataaagtgtaagtaaatatgtatttgttattttctttaaaatataaaattacagtcctatataactaaaattacatttgtaaattcagttgatatgacatataagtatttaaaatataaaattacagtcctatataactaaaattacatatgtaaatttagttgatatgatatgtaagtgcactataattttgataaaaatattgaataagtaaatttgtattagttattttattttgtagtccgttggatataaatctaagtgtaaaaaaaatctgggtgatttcttgttaaaaatcacccgacaaatgtgtaggcaatcccaataactaatacatatttacttacacaatatttttatcaaaattacagtgtaattaaatatcatatcaactgaatttataaatataattttagttatatagaactgtaattttatattttaaagaaaataaataatacatacttacttgcataacatttgtatcaaaattacagtgcacttacctatcatatcaactaaatttataaatataattttagttatataggactgtaattttataactaaacatcatgcgaattaaacgaagagaagaaagaaacaagaataaacctggtggtgaagagaacgcggtggccgccggcggagagtcgtcgtcgtcctcggcggagacagggacagagaacgcagcgtcatagccatgccgatttaccgatcgatcgatggaacatggaagggaccgtacgtacatctatacgttgcgtgtataactaaaattcgagtgatttccagaaaaaaatctgtcgcgtgatgtttagcaaaatcgaaaaaaaaaatattggcggctcgctcaaccctggcccgtttctccatcattggggtcaacctgggctgcaggtcttcggaggttgggcctcgttacgaactccatccaaccactgtggcaggtgggcttctccgccaccgcccctctcgagcgtcacatgggccgcctctccgtcatcctccacacgcgcggcctgcgccgttcaccgaatgtgccgagaccccgtactgaaattcctgcgcgccgccaacccccttcgttcacgacgagcagaacgagacaacgagtcagcatcgacggtacgaacatcgcacgcacagagacccaatcggtgctatactcctatagtacaatttgctccctctcaa

SEQ ID NO: 69044 - DNA, 21246 bp, Oryza sativa
ccatcgttaggtagagagtagtagaggagacctctctttacgtcggactagtgaatatgggcgcgcagaaaggtgcgtcgtcgcatgtgcccgtgtctcttatccacggccctctttacgcatgcatgcacactctggtcgtgtcggcctctgtacatgtcgccgcccccctgctgtgctaaactccactctgatccacgcaatgcaaaacgcaagtgcatgcatggtactacttggtaccaactccctcctttagtttcttctcgccttttgattttctgcatggactgcagagctagtagaagatgatgatcattgccggggatggtcactgactgactgtgtcgattgatagatcgatcgatcgatctcattgcgtgtgtgtgtgtgtgtggatcgagttttatctgcgcatgcaatcatctactactaataataggctagacgtacaccttcgacagtgagagtagatctccggttcacctcatcctcaatcaaatccaaaaagggagatctagtcgtaagacatgccgggcctcaccaccaaatcgtgcattggatagcacaaatgctttgtgtcgacgcattcggtggcaagcagaacattccagggagggttttgccgcgtgcgcttactgtttgggtgcgccccggcccacaggttaactcaccgagacaaccacaagtactctccatttcgcccatacgtatatgcttcaagcatggtgtacattttcttggtctctctttgttctttcaacttaatttggacatatatatgtatactcatttggactagtgcagtagttagtactactattttactagtatattgtactgtgcagtgtgaacagtgacagcaagtagattatccagtacggcaaggtcgtctaaagacgactgaataagtatctttcagtggaattgaacaggataccctcaaggatttatgcttagctagctgccaaggaatgaacaagcgtgctaattaattagtcacaggagtctgacgatgcttccactgtacacagtctacagaaaaagttgtccgacgtcgtacatttgtaccatgtaactagccaggcaatttctatcgctttctagctaggtttcaaaaatttctatcgctttctgacgacgaattttccccatggttaaccagcggcacgacgacaagtgtctgatgaagcaatgtcgacgaacgacgcatcgttcgtcaaattcgaattaactacatgctagtgtggagggagcgtgcggtgctgtctttttctatttctgcatgcatatatatggtcgcgatcgataatgacatcgttaagcgtattatatggggttagatagttactatttggtccaaaatctcgcttcgaaaacaaagttatcttggttgtcaatttgtcattgtgtaattgttcgtgccaaaccatatgatcagtcaaagtggacttcaccaatcaccggcttggttggtaagcctgattactctgaactactcgcatggttacctcgctatttctaacttgggattgccgtcgagtcaatcacgaaatgcgcatatcgctaagcatgcgagatgtgcagttagacatgaagtgctagtggtatgcattttcaatctgcataggttttcctcgagatgtttggattagatttgtaatcttcttcagaataatctttctgaagagaaggatctacatacagaatttcccgtgttattccttattcgttatcaggatgactttgacacgccgataaaaaaaatcgcactcatctcagtcatgggagaggaggaattacggttagacatttctagagtctagactcagctttcggtgcagactaacctttttttgtcaaatataacgctcgatctagcaaccataccaacagcaaatatattccattgtaacaggaaatggtagcttaatagaaaggctagctcaagctgcttgacatggaaaacgggaagtaacttcgtacgagaacttttgctgtcaagtccaaattaattccttccccgggttaatgatgctccaattaaacaatttccacatgctcaggacatatggatcgaatcatcaccacggatcacaaccgaggcttcgtttgctgatgcgggggtagataatgttcttttctttttgacggtcccaaatgattctacctgtaacaaaaggttaacaagtctgcacacgaccaaagtccaaagcggcagcaggagcagcggtacctaacaccatgcaaaacacaacacacggcctcccttttcttttctccactttgcagtatatttttttgacagcaaacgacgctttacagtcttacagaggccagtggcaggggcaaagcaaaggaggagctgccaaaacgaccgtcatgatcacgagctagagggtcaccgggtcgtcgtcccccgagaaattccggggcatcggcagcacgggcgtgcgtggacaaaaagggtctaacaaacgtctgttctctcccccttctggttcacgtgacagaaaccaacccccgctttgcgcccgtctcggcgtctcccctgtccagccaaaggggaagcttcccggcacttgctccgtctccggccggcacgcagccgcaacacgcaccaccagcgtcgccacagctctagctcctccccttccactgccaaccccgcacgccgcacggtcagaaacaggctaaccctctcgtctcggtgtgtggtggtgtacgtacgcgatcggttgcacgcgcgcgcgcgcgcggaggcggacgcggtgcagccaacccaacgacgagatcggcggtctcgcgcgcgcgcggcgcaccacgccacgctcacgcaacgcactctgcattattcgacccggcccgtaatcaatcatgcagaagcgagggcggcaaccgcgcgggagtggcggtgcacgtcaaaaccacctgctgcttgcgcgcacgagccgcgtgcgcggggggcgccggccggcaggcaggcaggcgggggcctgatcagccgacggggtatcttctcgaacgacagggcggcgagaggcgggagccatgccatattccattgcgcagttgcgaataaaaatgtgcgggcagggcggtgattcgaagtttcctttaacgcgaaccggatcccggccggatcatgcagcacacacacacaacctcgcgcggcgagtgagcgagtgattggcacaaagaatatctgactgactgccatcccatcccatcccacccatccaggcaggcaggcagggatggccagtcccgtcgacctatcatctcctctccccccctgaccatgttacaacttgcgacggcttcacgtggccgccagcccgtaacctgaggtgaactctagtctaatccctctcccagcacacggccggcggtcgctctctcactagctagctaaccttccccaaccacaaagattcattgaatgcggctgcctcgctcgctcgctcgctctcgccgcccgccggccaggttagccgcgcacgcgcgccatcagcggctggcgcgcggccgttccgtgattccgtcgcgatcggttgggtgcgcgcgcccgtcgcgtcccaagggaaagtttggtatcgcctttcccgaatcagccgagctcgtggcccgcttacgtacgtgcgcctgtgacctgtctgcccgcgccgtgtgcgctgcatctatccatcggtcggctcgatccgtcctccgtttcgcgtggtagtatgcccgtggcgcacggaattccgtgtcgagctaaaagcggctcgacaaaggcttgcgcgcgagaaagtcggggataaggcctggctttcactcgctcgctcggccagtattagctggctgcctaagctcctccctctccccttgcaaacgaaacggacaggccatgttcgagaagaggcaggcaaagaggcgacagggattttgccttcgattcagcagttcgcagaggcgcgggctctgctaaattcgggcagcgtttctgccgtgctcgcctctgcctctctctctctcatcagagaatctatcgccgatagcaacgcgaaacagatcaagcccgatactagtaatttgttaatcgcgtccgttagtctacgcttccggccgaccttacaccaacccgacgaccaagttgcacgagacatacaccgtccacgcatctgtcaatgaactactactagtaactactaccgcgtggtgaagtgaaagggtgaaactgctcgggtcggcttggcttggcttcggccagctagccgccacgtctccgccggttttaagtgtgagatccgacgtggaggccccggccgcccccaccgtgccggccgttgtccacctcccgacgggacaccgggccccgccgttgccgcgccgtggaccgacagccactgacgtcaccccatgtccttcttctcggctagctcttctcctcctcgcccgtgaccagcagctcgcctcgccctctataaatacccggccattcgaaggcgttccgactcaggccacacaccaccaacacaaaacatttccttgtccctcgccttcctcgcctcgcctcggctctcacacgacgcctcttcctctcgctactactagctcaagctaagctagcaagagcattccttgggctttttttcttgttcggggttgagaggcaatggcggtgatgactgatgtgtcgaccaccgggacggcactccggaccccggcggcgggggcggtgaaggagggcgacgtcgagaagctccggttcatcgacgagatgaccaccaacgtcgacgccgtgcaggagcgcgtcctgggggagatcctcggccgcaacgccggcacggagtacctgaccaagtgcggcctcgacggcgccaccgaccgcgccgccttccgggccaaggttccggtggtgtcgtacgacgacctgcagccgtacatccagcgcattgcgaacggggaccgctcgccgatcctgtccacccaccccgtctccgagttcctcaccagctccggcacgtcggccggcgagcgcaagctgatgcccaccatcatggacgagctcggccgccgtcagctgctctacagcctcctcatgccggtcatgaacttgtaagttgatactactcctatcattgtctcattctgatagcacacacacgtacaagaagcagatgatgattaatggccatgaatcattgcataggtatgtgcctgggcttgacaaggggaaggggctctacttcctgttcgtcaagtcggagacgaagacgccgggaggcctgacggcgaggcccgtgctgacgagctactacaagagcgaccacttcaagaaccggccgtacgacccgtaccacaactacacgagcccgacggcggccatcctctgcgccgacgcgttccagagcatgtacgcgcagatggtgtgcggcctgtgccagcgcaacgacgtgctgcgcctcggcgccgtgttcgcctccggcctcctccgggccatccgcttcctccagctcaactgggagcagctcgccgacgacatcgagtccggcgagctcacccctcgcgtcaccgacccgtcggtgcgcgaggctgtcgccgccatcctcctcccggaccccgagctcgccaagctcatccgcgccgagtgctccaagggcgactgggccggcatcatcacccgcgtgtggccgaacaccaagtacctcgacgtcatcgtcaccggcgcgatggcgcagtacatcccgaccctggagttctacagcggcgggcttcccatggcgtgcaccatgtacgcgtcatccgagtgctacttcggcctcaacctccgccccatgtgcgacccctccgaggtgtcctacaccatcatgcctaacatgggctacttcgagttcctccccgtggacgagaccggcgcggcttcgggcgacgccacccagctcgtggacctcgcccgcgtggaggtggggcgcgagtacgagctggtgatcaccacctacgccgggctgaaccggtaccgcgtcggcgacgtcgctccgcgtgacggggttccacaacgcggcgccgcagttcaggttcgtgcgccgcaagaacgtgctcctctccatcgagtccgacaagaccgacgaggccgagctgcagcgcgccgtggagcgcgcgtcggcgctgctccgcccgcacggcgcgtccgtggtggagtacaccagccaagcgtgcaccaagcgcatcccgggccactacgtcatctactgggagctcctgaccaagggcgccggcgccacggtggtggacgcggacacgctgggcaggtgctgcctcgagatggaggaggcgctgaacacggtgtacaggcagagccgcgtcgcggacggctcgattgggccgctcgagatccgggtcgtccgcccgggcacattcgaggagctcatggactacgccatctcccgcggcgcgtccatcaaccagtacaaggtgccacgctgcgtcacgttcccgcccatcgtcgagctgctcgactcgcgcgtcgtgtccagccacttcagcccggcgctcccacactggactccggcgcgacggtccgaatagtcggtcaaatccccacctcgtcgttggaccgtgtccaagaatctgaagtagtagaagccggatgcctccacctaaaaacacttatctgttatttttggaattaattttgatggttgctgtcaactctgtcagttagtggcaagagggtacctctgatgtgagggagagaactgcagaacgaacggaagaaagtgttgatgtaagaggttaccactagtagtactgtttgtctgtatcaggaatgtgattataatttaacctgtcctccaaaaccgtacgagtcctgcgcaagatcttgttccaattattggccagacctggacagcttttaggctgtgttcggcacagcactttcagtgggcgctacagtgttttgcccccgcgcacgcttttcaaactactacacggtgtactttttttcaaaaagtttctatacaaaagttgcttaaaaaaatcaaattaatccatttttgaaaaaaaaattaactaatacttaattaatcatgtgttaatgaaccgttccgttttccgtgttactgtagcgcggtgggaaaacgtccaaacgaacgcagcctaagcgtagcgatcagttgcatttcctgattctcctgcctgtagcctttccatttttgctgaaccatttcattgaaggttttcatgggagtttgttgtagcttctatgttgggagattcaagcaaaggagggtaaatttgccgcattattagctcatgaccgtataaggatgagactggattgctttcggcttctcgccatctctcaacaactactgctttcaccttaaaaaattcttgaagtgcatttgattatagtcttttaaattattagcgcaagtgtcgagtagataatcttttctctgagatgttgacacttgattaaactaaccaggctagcttaaaaaaagtgaactgctgaataatgccagaccgaagcacgatcctgcacacggctcggtcgtcaggtctttgctgagtgctgcaaacggaccaacatactttcctgactgtaccatcatgcttttgcgtgtgttcttctttctcttgctttcctgttttccacaagtccaaaagcaaaacagtttcgcctctcttatgtcaaaagcgagggcgttattcgcaatgtagtttgcaagtcgtgtgcagtatcgcgtagaggcttcaaattctgctattggttcaaagtttgcggatgggtcatgaccgagaaaaatagacgcatcccattctttgtttgccatatcgccagcgtctaacttcttgccgtctttgttggagcaatgcagacatgcacctgcatgtaacaaggcctaaatgacgagttgttttttagagagagcccaaatgtcgagttgacaactagtgctggtctgaaaaaagggcgtagcgctgatatactgaacagacaatttgacttgtaaactgaacttccgtgcgatagggccgtaagcctacctgcaaatcttatcgcaaaaaagatcactatccattccatcgcacaggaggaagcagaacaagagtacaggactgcaagtgtatgttgcgtccacttgtaacgtgcccgagtattttttgactctccaagaacaaaacacaaagtcaaagctttagactcctctccgaatccggtgcgtcccgctcgttcatccacacgtatcacggccgctgttacgagatctttgaccccgccacgctgcgcaccagacgatccggtaagatctgctcgtgatttggtgggcggaagacgcctacagtaaaaaagcgctcgcgattcggcagtacaacgtctcctgcccacccgagccgcactgtcccgtcccgtccccgggtcaaccacctcccccgcgcgcaccacgacgttggaccttgcgtgttggtgttggcggtggtggtggattgggctggttggcttccacgatggcggcacgcggtgcaggtcaaggaggccggggtccgaggattcaacggctgctcgcccgtctcgcgcctcacacgcacgcgcgcccgtgcgctgcgtcggaaacgtggccgtgtggccgagacacagccacacagggggcgggttcccttgccggagtcccgcgcgcgcgccgctcgggctacctacctaggcgggggcggcaacgagcgattgcgtgcgggccgcggcgaggttttgcaggagggcgggcgggggcgcggggcgacgtgccgtggtacggccgtgcccgtgcgtgctggcggccgctgcgcctttgaccgttggtctgtgccgcgccgcgccagcttggtcgctggggcctgcacagctgcactgtcactcatgcgagcggcatgcgatggttgactagcacgaatcgtgcgggtgttgcaatcggagaagcagacaagaaccggcgctttgcgtgggaaattcgtccccagggattcatggacacgtcgaagatgtatagtaggtcggccgtcaaccgaggcacggcttgatgacaaactagagacaagttgcttgctcaggtgagagtgtgataaacaataaggtcgtcgctgactgcactttgtatgcgtgtactaggggttcagcctctcagaatgttttgctacaacacgtgattgccccttacagttagggtaaagcgttgagttcgttctaatcaatctgcatgcctctatgtgcacttgtgcattggtgaaagtgataaactgagctggatactaggaactccgggagagtttgccagggtgttggacaggaacgcgtgcaaggaggtgccgctgttcccgaggagcaaaagaaaggctcacattgctgctggtgcccgcttggcaagcaaagtagagagcgaggcacacacgcacgcacgacggcgcgagacggtccggaaacgctgcgggggcgcgtggttcatgtgggctcggccggtcaagggagagccgaggcaatccagctcgtcgcgctgcctgcctgactcctcgtcatgaggtcgcctcctcccgtgtttccctcgtacgggaaactcgatccggtggtcgccagcggtggcttccatgaatccatgctcctgtcttcgtggcggcccgcggttttccgatattgcagcaattgaaatgcctcgtgcagcgagggcccgagcgtaactacagggtatcagcaatagggaacggccgaacggggaggcaggggccgagcaaaaattcaaagtccacactccactacgggcccaattcaagaaggccaccactgttttaggtcgactgagccacctagttgccactcgactcatgggctagagccctaaagaaaacgggaacatcgtctacgtcgcaaaaaaaagtacaccaaatgtcccttatcttctcactaaattacaaaatcgtctctcaaccgaaaaactagatatatgacatccttaaacttacaaaaccggatcactttaggtccttaggtggttttaaacccggttttatccaacgtgagccccacatatcagcgactatttcccctccccctctctcttcctctttcactctcctctatctctctttctctctctctctccctctccactctttctcctcgccgcaaagcttgtggcgaagacaggtggcaatggcgctcggtggccaacgttgcggagacggtgtgcggcagccgccggtgagcgccgtggccgcctttccaccacgaacccgctgctgtagccttttcaccgactagcgggggcgtgggcaactgcggtgtcaccgacgcagcagggaggagggccggcggagaccgttggcggcaagtgaagaggagctgagcgacggcggcgtggcatcaacaacgcaacaaggaggaggggctgacggagagaagcctaccggcggcggcggtggcgtctctgacatggcggggaggatcactagtgaggcaggcgcaactggctccctgccactcctatccccgcttccccgccaaccggctctcgagctcccaattcacaggctcggtgccgctgccgctgacgtcgagctcatctctgtcggccgccattcttccacaatgccatgttgtcgccgcgcaggtgctgagcttcctctagtcttctctcccctcaaactgtccgcactaccgccgccaccggcgttcttgggagccacccgccgccggcccacagccgccagagtcgcgcgcccttctctgcccttcctccccgcacacaagaatgagaggaagaagagagaaaagaaataagaagtgatctgacaagtgggtcccacctttttgttattttattttttttggatcgaataaccacataagcgctaggtcaatacacgtgggatgaagacttaatcaaaggaggcgccacgtcaattaaaacaggcgacaatatcactgagggacctcgtttgcactggttttgtaagttgagggatatgttgtatctggttttttattgagagacgattttgtaattcggtggcaagatgggacctccggtatactttttcctctacgtcgcatcatgacatgtcgcaacgtggtgtgaaccggtgagcgtgcgtcctgtggcgaccgccgatccgtgagaatgcgcatcgcggggtcacgcctcgcgggcttttccttggcggctacaggctactgctgcgtaaacacgataggtggctccaggtctatttggtttccacacatcgaatgtttggatactaatttaaagtattaaacatacactaattacaaaacccatttcataaccttggactaattcgcgagacgaatcttttgagtctaattacgctatgattttgacaatgcgatgctacagtaaacttttgataattatggattaagtaggcttaaaaaattcgtttcgcggattagctctcatttatgaaattagtttttttattagtctatatttaatactccaaattagcgtccaaacatccgatgtgacatgggctaaaaagtttttgccccatctaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctaaactctcaatgttcatcgactcatgcacacaattgtagactgtagtacatgtttcaggcatttttcggatgacatttttcacaggccctatgacgaaaatgctaatgcgcgactgaccgcgcgcgcgccctcccgcgcggcgaggcacgtggcgcgcgtggagagggccgcggtggcggcagcgcgcagggtggggcccgcgcgattttttttcctttttcctgtttcgttttttctttctcgttttttgcagttttcctttttttttccttttcggtttttcataacatatacgtatacaaacttttatacaaacgtctacaaagtttgtatacatacgtataaaaactttgtatacgctatatataaagtttgtatacacgtatgtatataaagtttgtatacttgtatatgtatacacatgatgtgttttatggttttttcaattttttaatatgtacgtatacaaagtttgcacatgttgtatacaaagtttgtatatgtgtatattttttatacataaaaaatatatacatataaaaaccaaaaaacacagtagtactaatagtagtataacagtagtactagtagtattattatagcagtagtagtagtactgtagtactactagtactagggggcaccgcgcgggggcagcggcacgcggtcagtcgcgcattagcgctccccgccctatgatgttgcttcctgtgctggcccatgctgcatagcatttttaggctttacttgggccgaaacaaatcacagtccatattaagatggaaaaggcccagtttcactcccctcaactataggtcaaatattgttcagattcctcaatgataaaaccgtgtataacgtgtccttcaactattaaaatccgtgaaaaatgactccctccgttgtattaatatggttttcgatgacgtgatatctacatggtgcattgacctagttttcattttacatgactcttgtatcttgtatggataatggtcaaagttgatgaagacatcatgctcgccccaacgcgaccccatcgagtttgagctccatgaaaagagaggcagcggaggtggcgatcgatgagccatatcgagatcaaactcacctacccatccacatggaggcaacgccctgggtcgttgccaccatccatctttgtctttacctattggaccactagaacatgtcgtccttcaggccaactttgtcttcctttgtttcgactggtccagtttcgtcctctctctaaatcgacaaggagatgaagagcagaagaggcattctgtcggtcgttgctcctctaccatggatggaaagggagtaaggaggaggaagaaatggatgataacaatgcttgccaacagggaattggagtccaccttaacatccgatttgtgtgtgcccgccactgccctgctgcctcacctcaacctctcattgccgttctgccgtcaagaaaataagggatagcggaaggggtagggaaggaaggagagaggaggacatgtgggctccactccatttcttaatttatgtgatgattgacatttcatgtggatgctatgtctgcgagaaacaccatcaatattaccgaccaagtcgttcttcactgatattaatagtttgagaagtgttatatcggttccagggatacaatcagattcaacgttgaggcaggcgcattaaaccttttcccattaagatggcgctgcctacgcagctgggcttctgcgtggtgtaaggcgtgtaggccttgattgggccgaagcaaatctcaccgtaacatgttagccacagaatgcatccccatcccaagcctctcagggcgcaggctccggcgaacccaaccctagtccggtagcccccgacgccgccccaccgcgccgacgccgcgcatcctccccgcggccctcggaggcatctcctcgcccgtcgtccctcggcgcctcgccatcgccggcggtctgcctccgctgctcggcggctcgcccgacgcacccacgagtatcttccccttccctggcgtaaaagaaaatctcccgtctcgtctcctccgctctttgcgccgtctcgctgctgaacaggggaggggcggcgatctccatctgccgagcagagcaggagaggggatcctggtgagcatccacatcctctatctgattcatctctctctctcccagcgggactacttttgtctggaatttgcttgcgtgcgttcgttaaccctagcttctcttctagatctggaagaggctcttctcttaatttcagagccttaaccttaatacaagtaacagtttatttgttccccgaaaagtttgcgattcaactgaaccccatgtcccaagttggttcgcccctgacaaaaaactgtacacagaagaatgtaaaaaataggtcgcagctatgattatatggcaatgttgacatgatttctcagaatccttcaacagtggaattgttagattagttttgatgaattcccgcagaaataacgccataaacagtaaggcacgcactggcaatgagagctttggttcccacgttttgaaatcgtctactagatgcggacacttgattgcgttgtgtaaaaaacctcttttcccttctaatatatttacgtgcaatccttttgcgtgttcgcgaaaaaaaaattaatactagatgcggacacaacaatgtccacttcaatgtcgtgctttcttcttcagggatcatcatatttaatgtgaaacagtatgtacagtggtggaaactgtcaatgctgaaatgattgtcctcatgatctaatgtttagccagccagtacaaggattggatttgcactttctgttaaaagcttctagcattaattttgttaaaagctttaaccacaatattctgatttttctacaaatttggttttagttatactttggtcggttgcaagtaccaaacaggattatatgaaaaatatattgaaaatcgttgtacagaaactgatttcatagtccaggaaacaaccaaacaacgtttatgactaggcactgttttccttccttgctaaaacatgcttctcatttgtaaagttagaatatattgtattgattttgcctcaatgttttaaatagtggtaagcggtgcaatgtggtcattccaccttgtagagcttatgcggaaagtggccttttaagcggttttaaagtcgtataccaagacagattattgacatctgatccatctttatttatttatggataatgaacgtaggcttaaaggatcagtaaagaggaaagactcatgaagaaccaactaccaaagaggacccaaggatgaccaaaatttaagtcactgactcaatgtaatgaagcaaaaacataaatgcagtaaattagcaataaagatgttgtgattcacacattatatatattataggttccaaacttctgatcacaccatcatagttcatagaggatagagcaaatagcaaatactaatggcactatggcagaacacaaaagggtacctaagccataaggccaaattgcctacacggtaagcaggccacatatccgaatatgtggcccgcttaaccttgtaaatgcaccgtacagcaataatcggcaaggtctgatgacctgttacgcttatacggccgcataagcggtctgtgtggctgctttttaaaacattgttttgccttcatatttttacgagttactgcaattacttagaacttgcagaccattttttttaccaattgattcatattatctcagagaagctaaatactcctaggacttatatattctcaacttttccgatcttcacttgaccttttggctttgggctgtacttttgtaatgtgctattgccgtattatggtattagtttatttctttatttgtccatgctttctattttggaaacaatggtacatcaataaattccatagacatgctagttataacgtgatctgtacctctatatataaaacataatacttagctccttttaactttggttctaatcctacatttctccaggtcatcatttgttgaaaaatggccacagaagatacttctcacatttctggtagttctgagtcaacaattccattgctagaacagcttgctgaagtatttggcaagctgaaatctcacacagaaacatccttgcaattgcaaaacggcatcaattgggaagatatcaaagcacatttcctgaaccttgagaagtcgtacaaaagtaagtgcgatgaacttgcagagaagcagaaggcattagaagaaaagaaagctgaatcctgtaggcttattgcagagaaggaagctaatgtttctgcaaaagagcgtgctttcctgaaccagtttcaggagctaagggatacagctgtctctgccctttcagaggtgcgacaaaaatataaggtggagcttgctggtatacttgatgccaatggaagcaaagataaaaaggtaagaacctcaaccaatgacatgaatgcgttgtgtgcttcagaggagaatacaactgctagtgggctgggtgaaccatctgaagcttcacctgttgatgttaagccacgtcctgtattgaagcaactatgtgagcagatggatacagcaggccttctgaaatttctttcagaaaattggaaaaaactttctagccttcgtgatgaactttctgctgcactaagatgtgctactgaccctgcacgctttgtgcttggttccttggagggtttcttcccatctgaccatactagttcacctgggaataaacagattattctccaaggccagcgtagaagctgcattattttgatggaagctataacacctgcactagctacgaaggagccaggtgacaaccacccttggagctctgaaattagggagctggccaaggcgattgcagaagagtggaagagtaagctagctgaggttgacctcgatgcttctgatggctactcattggaagcacaggcattcctgcagcttcttacaacatttaatgttgattcggtgcttgacgaggatgaactatgcaagcttgtagttgccgtctctcgtcgcaagcagactgctgagctttgtcgctccctttgtcttaatgagagaataccaggttggtatcccctcagaatgccacaaggcgttcacatcccttaaaccagaccacagccattcctgatttattactaagccacagagctttctagggaattgaaaccttcctgctttatgtgaaaacctggtaatttgcataagtttggaaatttattatccttctgttgacaatattttgcttatattatcaaggaattggttaatagacacaggcaaattgatgcagttcaatttatacatgcctttgggctttctgagagcttccctcctgcacctctgctgaagacatatgtggaggaattaaaagattcacttggcaataatggggatggcaacgcggcttctctgaaggtatggtctttccaccatgtttgagatggggataatttcccaatgtttaggtcacagttcatccactgtactgtttcaccaaggaagtatactattaagcgtagtgcaaatggaccagcaatttgtgagtagtcatacaaacaaaacaattgaagtcaggaatcattgttgcaaggttggttattgctgcgaggattattggattgaattcatcttgcttcgcagatggaaatttactttcaacatccactgtttagtgcttatgactgtaatgcagtgcggacttgtttggttgactgtcaactgcttttctacttgatagtactattgaacattgtagattattgtatattacttcgtacttgaatgatttcatatctgtttcccaatcttcttttctggttttacatttatgtttgtatcctttttcaggatgacccaaagactcgggaactacttgcattgagggctgtaataaaatgcattgaagagtataagcttcagaaggactatcctcttggacctctccagaagcgtgttgctgagctaaaatctaagggtgagaaaaggccattggaagctgggcgccataatgcaaagaagcctcgcactttcggcaattcagctgctcgcaggccaccaaatcctgttggttcagctggtcgcagaccttcaggcccggctggtacttggcagcggccccctccaccaatgccttcctatcctgatcgatatggacatgcagatcggtaccattacactgcaccctctgcaacatatgatcctcctgcttatgcttcttacagcgaaccatacagtgcctcaaagccataccagtacacaccaggctcagtagctcctgcatcatacaactcgaatcagttcaaagtagcttatggtggacctggtgccccgccaacagcaggcggctacggaagctacaacgatgcagcagggcagtctacttcgagtagctattcgggttattctggttaccacccttcactaccaaggttataacttgcatttgctatgctacgctggttatgataaagcacaatctggctatcaatctcgttcagagttcagaccccagatgtaacctttagatatactctagtggattttgtagctgtaactggtgtagatcttgatcttccaaggctggtcgtgtgagaagccggtcgattttagagactttttttttgtcctgctacatgtatccagttgaatactgttgcgtgtacctaacctgttttgaatattctccatgttcagtcttctgtgactaactactaagattggctccattttaattcgccctctgggctctggcgcttttgagtagtagaatatttttttccccttacctttctgaactaatctcttgctttgcaaactgcaatttccttgtacagcttaagatgcaagcctttctgattactttgcagagcctacaatcttgcacgatttaaggatgcaaagatatgagctagataagcatggaacgcatgagcagaagcacgttttttaggatgatgagacgaactctttcacaaatcgcatgtctggtggcctccatgtggggcccacacgcaccccgctcgtctcgtcaacgccactctcctcttccactccaatctcactaggaaaacaaaaaaccgccacttgcgcaaaaaggaatacagctatacgcatcgggatgatctgagccaccgacaggtgggacccacgcgaggccgcccccacctgtcagccggtgccacgcccccgaggcatctcccacacagtgacaaaaaatatactaatcccggacctgcgtgaaccggccggcgacgcgagaattaccggattacccctcgccttctcctccaacaagtcgtcgccctctcgggctcgctcagctctcttccccttccttcctcctcctcggctcggcgcgacgagtcctcgccatggcgagtcgccggtcgcgtcggctcggctcgctcgtgcccttcgccgccgcggtggtcctcctcctcctcatcgcttccgccgccgccgccgccgcgggatcccccgatcgggccggccccgcgcggccgccgctggtgctcccgctcacgctcgcctaccccaacgccacccgcctccccgcctcctcggccaggcgcggcctcggcgatggacacaaccccaacgcccgcatgcgcctccacgatgatctcctcaccaacgggtcggtacagttcgttttttgccctccgctctctctctctcgataatttcccccaaatttttttttcttgggggggttgcgtggttggatctgaggctggatgtcgccgcgtgttgttcgtgctggtttaggtattacacgacgaggctgtacatcgggacgccttcgcaggagttcgcgctgatcgtggactccgggagcaccgtcacctacgttccctgcgccacctgcgagcagtgcggcaaccaccaggtcggcctggattcgtcaaattctctgcttacctgtttgaattgtgtgtgacgatcggtttaattaggattggtgatggtcgcgtgtatggatattggattcccatatgtcaaactgtcgcttgaccattcaggttggacaattgactccagtgcaaatgatacatttttgtcgggcttgggtgtgtgcatagacatttattgttccaaaattcaaagtcttggaaaatacacgtttccatttggataggttcggaagttccagctatacgatgtggataaagtgtatggtacgcaaagagcacctccacaacctgcagggtatattaaaactaaccgagcgacgatgatgtagcttctttttttctcaattgtgaatgcctcagaatttaatagaggtcaacatccaacaaagcccatgccaatcttggtcacaaccaacaagaattactatttgtttgatagccatcattttagccaaattttgcaccattttgttttcaaaccattggcgttcctggttgtcaacagttagtcgattcttctttgttttttctccatgccaaatgagtcccatgtctttcctgagtgctgacaattatcaggcaatagatttgggaagtgtattggattgtttatggcaaagcagtggaaacaatttgtattaacaccaattttcctaccaagtaaacccactgccatgtccagaatacacatctggtattgctatgcaatttgatgtttgttgctcccttatcgttctctgaattttgggctttagattcaaacgtcacatagaaaacatatccatatgaaaaggcaaatatgttactgtatttttcacttctttctgctacatacccagccttttcttgggcaactgtttgcatggttagtcaggccactgttctcttgtagtcctgtataatctgagtagtttggaaatcttccatcagttgtagattgctactattgctgataagtaatagaggagtccacaactaatgggaagcccataacctgattctaaaaagaactgttcttgtcacttgcatagttgcatctttttgacacaattgtatcattcttatcataacttgtgatttttctagattctagatggcaccattgttgtaccatcctcttattctatgtcatgtttgcagagtgaatcacctaacatcattgaggcacatgtaaaagtttaagcatttatactatttaatttatattaatgtgtgtacaaacagtgtgacaatattttggcatgatttctccaatgcgatgtatatcttacgtgataaaaaaagttaagatgtgtatttgatcatacccattgagaaaatcacctttttcccacttgaagtttcctttttaactatctagaaatcaactttctctagtatacactaaagtttggcatgttgtaggatcc

SEQ ID NO: 69045 - DNA, 720 bp, Oryza sativa
attcctgcaccccgttcgaagctgaagcaaagcgtgtaaaaatttgcccgcttcgattttgcagatccgatacacggtaaaatgtacagaaggatttaacaaaaccgtacggttatcacgtggttatcacaattaccatacacggtaatcttttcagttttttaaccacgatatgtctcacggttaccacgtagtttatcgcggaggttttgtaaccgtaccaaaagcaataagagaaacctgatgtgttaaatcccatatgggattggtttattttggaacgtggcgttgagattggcgttcgatctgcgcgtaggtagagaagaatagaacctagttttgccggcaggcgcgccgcgtttcacgcgatgggacgcgcgccacgtcgccggcgtaatggcgccgcggacgctggctgcacgcgcccctactggcccctgctccgaggctcgcctcgccgcgaatccggtactgcgtggtacgagtcgggaccgggtcaccggtccaaggcccccaaacaaattcaccgatccgatccgtcgtcgtttctgccgagttttaccgccgccgctgctgctgtaatttggcgaaggccacacgagttcacgccgcgatcacccagacacgggacaccaccctggttgcgacagaaacaggggagcctttcacatcttacgtggtcagtcctagagaaacagagtagcgtacagtacaaccact

SEQ ID NO: 69046 - DNA, 1698 bp, Oryza sativa
  unsure (1)..(1698): unsure at all n locations
tagtgcagacgaatataagaaatcaagaacagatcaaaagcagaggaggtttgccaaccagatgtactcggcgatgatcttgtcgctgcagtcgctgaggttgaggttaacgaggtcggtgaggttggccattgctcaaagcagaagagatctgaatgagcaagatgcaagcggaaaatgaggtgtagaagaggaagcagggatgaggagaaacagggagaggagagggatatttatacccagaaggagagaagttagctacggtgtgcttgcaagtcgcaaatcgcaactgtggatagcgaagtaggggcaagtatcattcagagacatttttttttcagttatttgattaataatgatattggccgtttaaaaagatagcgtctatattatctttatcttttaacaaaaatcaagggaatggattacctctggtgtggcaagaaactgaagtaatcatctcaaatcgagaggatgctgcagtattttcagggagaaagaagaggtgtaatcataaattcatacgtaatatgataatttgacactattgtctaaaaaaacatggttaacatagtaaaacaatttgttcgtagtcaataggaattaaccgtggaccgtggtaacttaagttggatggaagtttactccacttattattttcttggggttttttttcatctggtgtccaactcatgaattatgtgagcactgtgcttgtgcacatatgtatttccagaaggatgtttacaactaaaaggaggagcaaaatatagtgggtcagttttccaaataatgaggaaaagagtttgtaagtgaacatgatcgtgcaactaaaatacaaaatagtttgttttgtatgcttgcacattcacgtttattaacttttgagttacattgatttaaataattcaaagtcaacatggtgattagttttcggtgttgacctaagaatatgcgagctctatttttaaatgaaaaaagggaaagaaagacacaaaatgctgccttgatacttagacatatttttattcgaaataacgtttgatgatgatgtatagtatagcaaagaatttggccgtatgctccccttgttctgttggatggtcacttatccagaacctaaattgctaatgactgttgcttacttaattttgtgtccttaagattttagagtagaatagctcttatagagcagtacaaattgtaactgctttccattaataagtttcggctatcacaagtaatcaaaaaccatgcttctggttaactacatctccatgacaaaaaaacaaagaattggacgtcatcattccaagccaaaaaggagcgaccccttttctctttgtttttcttatctgttctgagaaatacaggaggtagaggtttgatgtatctatcaggcctccaatagtagacatcagccaacaaatttataaaaaggatcaccaattgatccacggaatctttttttttttaactgttgacctcaacgtgacaatgatcattgattggttcgtcacggtcngctctgtatttgcatagacaataactttccaaatgttaaatccgacaacggccgtggcatacactccacagatgtcaatgatttgtcaatttattacaagtttttagaaagaaatgacacaaggttttttaacctaagaactgaggataaaacactgattattaatcggattg

SEQ ID NO: 69047 - DNA, 707 bp, Oryza sativa
ctccaataatattacatgctaagactaaaatagtcatctatgctaagtgtttcgtgcgtatatgctaagtctaattaagactacaatagtcaattgctacttgtcgccccaattccgtagtcaataattatacatactaataagtctaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatatatatatatatatatatatatattgcatttcacgttaacgttcgtcctcgttcgttcgctcgttcatgttccctagctcgttcacgttcgttcgctcgttctcattcacgttcgttcgcttgttctcattcacgttcgttccctcgttctcgcttgtcttcgatcgatcgttctcgttctcgctctcgttcgttcgatcgttctcgttctcgttcacgttctcgcggcaacgtacgttgacgtgttcgttctcgctctcgttcgttcgatcgttctcattct

SEQ ID NO: 69048 - DNA, 34861 bp, Oryza sativa
ttctctttccatctttccccctcttctctctccaatctctgcccgtcctattctttattctctttccatctttcacccttccctctccctaaattgtcgcacatgcgatttccatcctatcttaacgcgattttcttcccagcatgcataattccctacagcgcatgcgcccttgaccccccccccccccccaccttgcccgtgtctacctgatttcacaatatattagaatccaagacgtgtagaagggtaggcggtggggacgctctgatccctgatggcgctcagacgcctaggcgatgcttttaaaaccattggctgtgatatttttgaactgcatatttttgctattacatggaaaacatacattgatagtctcatacacaccattaagcatgcacacaacactcacaaacccataagtgcaccccctgatacatgctcaaagagaaggagccagcgacaaatccctgacttcactaaattcccattgaaagtacaccatgtgtgtgtaatatatgtgggcactaatatttaaatcctagtgggtggaatcatgcactcgactccaccaccacacatttggtgtttccccatttttgaactgcaattgatatcttttcaatcttaaaagttaacatattttctggaagggtttttctccgtaacatttctttagaaaagtttgtcagtaccaaaataaaagtgattttaatggctaggatcttatagaggagtgaacatatgtcacttgcttataaagtatgaaaaactacgaacaattgttgtttatttatctctctaataaaatttctgtcttcctgggcccaaacctagctcagcccagtcttctgctcgtcccctcagcccagtgcggtctccacttcagtccaagcatggaatcagcaatgaagaccaaagatatgtgattagggatgagcaagggtcaggcgacccattttagttcatctttatgaacataactaagtgtatatatacaaaattgaacaccacatggaccagatgtgaagtgggggccatagccaggctcaaccctacacctcaaaacatatttctgtatagtgcaaaatttcctgcatccaggactcagctatcatgattcatgatcttgcatacatctagacaggccatagatcagtcctaaagttgtgattgtatacaatataatgggtacaaaaagagctgccaaatataattcttgctgattttgcaaagaaatgaagaggagagaagtgcatctcattatatcctaaagagtaaaaactatcaacttctgctggtcatttaaaaataatccacttctgctggcattcactatcaatgtactttgaacatcgatccagaagcaattgaatagtctgaatgagggaacaacctacaactacatgatatattatagtgtaaattcacaaatggccagggcctagtggaaatcatgaagaactttggcccggcatccatgtggttgaacctcatgaagattttgctatttcatttgcaaatagtcggatgtatgtatcagttaagacgggacgaaacaaataactggtactggaatgcaatgcacatggatcagaaataaagaacacaaaggtcatgtacaagaaacagataagtggaggctaaacagttgttttttaactgatttataagaaacatgtgcgactatgtcccaagataatccataagaaacattgttctcttacaggctactgaaaattagtcagggttgcaagcaacagataagaaactgtaacagtagtagtaagtttgtgacattcgttgggctatttcggcacaatctatcgaatcgactatataatttgcctcctctgtgaggaaaatgcagggggttagtgcatacgaatgtgtgaagcggtacaccactgatgaacaatgcaattacaaacagccgaggacagagcaggaggaaggagatgaaaaggaggagcgattaattagggcgagtagctcacctgtgacgactctcgcgtagccagcagaacgtgtacggtggcggctgccccttcccccatcggtgcgcgaggcgaggggatgaatcgaagaggccaagggaggagtttaaccatcatgggttcatggccttgtatgctcccgccgccgccggcacttgtggtggtggtggtggcggcgggtggtagccgatcggaatgccggcgcaggtgggcggcgccgcggtaggtcaaaggggatcgggggagggctcgcgctgcgggctgcggcaagctggagggggagcgagatgctgggagtgggaggtcgattcgcggggcggatgatcagggactgacacatcggcagttcgagccgtctgcccgtccagggatacgatgaatttgatgacgatggatcgcacgagaattattttttcgagtaaatttcaaaataaaaaaaagcagatacattaaattatacaaaactacatatttaactcgttgtatcacaaaacaacatatttaacatcaaatttatcataaaactaagtatttaagataaagtttcacaacatgtttagtaactaaattatcacaaaactatttttttagtggaattgctacctgtctgtcgacagaaaattgagggttgcatcgttcgttttttggaccgtgcgatttgcttgcgattcgtgctcgctaaccgggtcctcaggttacaacccattatgactagtcaataggatgagctcgatgggctttttaccgttcccctcctagagaaattctccctccgtcgacgcgaaatgagaggcgatgccattgacgattctgaggcgatttgttcttcggttccctactcgatcttagtggtaatctatggcgaggttcttattttggaagcttggaatctctgtgcccgttttggtgagttttttgttggctgatttgctcttttttatgcattttgagaagtagttttatgcgatttgacaggaatttgagttctattatctgaaatcctcgtcgttaaatggatttgtgagccactaatttgactggatttgaggttcttcttcgattccgagacgttgagctccctcgttatctaggtattctctgtggacttgatttgttctgatagctgatttgtgagctgattcggtttatggtgcttcttgtgactcgttagtgcttgttcccaacttgatctgttcattctatcgagctctgccatggattgtggaaatggagtgtggctgtgctgattgacacggtgtttttcaggcgaaaggcttgcgaggaatgtggtgaccatggcggtttgggaggcgtcgaccaagccgctggctgccaataatggagacgaccgagttcatcaacgccttgaaacaggaggtacataaacattgctttcctctcagctgaaatacagtattagtcaaggtgtactaacctgagtattatgtctgaccaaccacttgaaccatttggtatttgcatgcagtgggacagaattgaggacaagtacacggtgatgacactcgcagccactgcgtcgctcaggatgtggagccggcggagttgcatcggtcggtactgaaactggagaatcacatttgcttaattttcagggagtttttgattatgtaggtacagtcgttaacttgggtgtttggttaattaccttgcaggcaattggcatgcctcatgttattcctggtctaatgaaggctgttggcattgtgtacagtgaaggtaagattatgcacatcagaagttcaggaaaaaaaaatctccccatttataagtaatataaattctttgacatatagatatactttgtgcagttttctaggtacatgcctaaatctgatatactctgaattttttgacatttttgctattgactttggctgtaatataaattctctgaaatccaaattttgatataagttctgttctgaatacagtacatatgcagtacatattctttgaaatgcacctgcacatatgttctcctagttgttcaaaaatggttttaaatctgtactgctacttattgtaagacagattacttgatagattatatagattctatattgttaacagtttctatagattctataaactgaatcaaacatatactaaatcttgatgtttctgtaaagtctcaagtctacaagatgttagttacatatttttagtattgaaattacagtgttttttttatgtaattcttgtacaaaatgactgtaatttaacaacaaaaatttagaatgctgctgaatattctcaatatagtgatttgaatcgtttatggcaacttgtagcaatttttagtttatttttaggttgtaatgcattatgttattcggattttgttgtgctatgaatttctgaatttcctgctaatcagtagatatgcaatgatttgtctgttttctgaatattctcagtgagttatggtctgaatttagaattctttgaagagcaaaaaaataatctgaagttgtatttcattgctgcctaaggatgctagattgcaatctaagagtttcctgacaattgtactttaaatagtcaaaatgctagcttaagacaattgtcatctttttttgtaaccatctatgtctctgacattgatcagcaagtgagtaatgtaaagagagtggtgtatttgaatttttttttctgtctgatcatccttttgtttcctctctaggtgactgaacagaagcttgccgtagtgtttctaattgtggacaagtaacttatacttgttcatctctgaaatctgaaattactctctgtcctggagactgtactggaagaagctatactgctactaaagttcagattggacatataagttcagaaaaaaaatcagaattatatcttgaattcatataagttcaaaaaattcagaattatgtcttgaattcatacatctgagtacagaaattgataccatttaagtttctcagatctgttcaaatatgcaatacaaaattgtcagatgttttctgtgaagttctgtgatgtttctgtaaagtttttaagtctagaagttttttttttgttatgaatttaacatgctgattggtttttcgattggttttcctctttctccttgtatttgattcttctcctccatctccatctcctccttctcttctctctttgatagatctgtttgtgtgtaaaaatcccgaagtgttttattcttgcaaaccaagttgctttattgctttactgatcagatcacgtgacactgtaaagattcttcttagtagtcaagttttctcaatagggtataaggtacgcgattctgttaatctgggcctaatattagatttgagtaacggtttgaatttgggctattatttggatttgggtcctggtagcatcgaattgatttgggcccattagcatcaaatgtatttgggctcaaataaatgggtcatgaatagcctttcagatttaggctagtatgttttttttttttaattttttgttctaaaaaaactgaggctgtttgattcagatcttgtggctagaaaattcgacagattgcaagttaaaaaatcggtcgactgagttgtattgtaattctcctcaagtaatgatagacctatttcaaacatatgaatttgcaattttttcctcaactaactaatggaggcatgaaagttactaatcagatttaaacaatatatcaattacctgattgtgatgttgttgcgttcatgtccatgttaatttcttcttctgataaaagctttgtgatatacctgcatatatagacacaaaattacagtgtttagaatttaaaattacagtgtctgtaacatgtaattatgaaataaattgactgtaatttcacataagtgactcatacctgaacttggtacatgttttgtcactcttgaattgctatcttcattattcccatctttgaatccttcaaatttagacattttttttctcacagtgtaaattaagtagttaaaatactttatataattctatcttctaattttgctctagattctttccagattttcttgatcacaagttgtcaaaatttgtataactaccattagcaaaatgtaaatgtacatgcaaattggatgagtgaaagtacaacagttacatacctgtgctttgaagttgcttatcttccactatattttgatagtttgatgaatttttcttcttactactgatacaatttttctctttgtcctctgtgatgattgcaaataaaatgtttttttttattttcatattaattttcctgtttggttcttactgtgatagaatcttagtttgaaataatgcactgctatatcaatcaaacatacctggatttattaaccacttttataaaaaaaatcactataatttaaaaatagtgattcatacctgtacttgatatctcatttgtcattgttaagctgctattatcatcattgtcaccttgtatacttacaaatgaagggaaatttaagttgaacattttgtttccaggtaatgacaaattagatttgaaactaagctcatcacagttgtgacatttacatattttttatttagaaattacagagttttgtttgtgtaattcctacataatttcactgtaattagtttgaatagttattaaatacaacatactgatagatttttctaaatatctgtttgattctaaattaagaactacttaaaaattaatattagttctttcattatggtattatattttttttacttttgatttatgacatcctaattcataggaagataaaatcatatggaattgaaattcaaaaattttataacggtttgtctcttatcatgcacttttctctttttctgtactttttatgcaataattgtacaaattgaacaattagaaacctctacatttgtttccagattggagatgctcctattccacattctttacaatatttgatgcttttcctttgttagttgtgatgcctggaaataattgtagaaaatgaacaacatataaaatcatacaaaatatcttttgactatgttgaaattacataaacgttacattgaaattactgtgtttattaaatgtaattcctgtaccaaatgattgtaattacatatatagttgcagaaaaagaagtctatatgaaatcaaacaaaattacatacaaatgctctaaatttaagttttggagccagttacatgaatttattactgaaattatagtgttttttctatgtaattctcatacgaattcattgtaatttgacttataagttagaaaacagatccaattaaactgttttttctttataagtaatcaactgtattgttttgggtcaaacttgctttctacaatttgcttttagatgaacttatagtacgatttgattttgatccgcctgctagtgaactaatgtaagcaaagtttgtttctcttgactcatttaatgaaatctgcttgaaagttagtttatgctacaagtgaactttttgaaaattaattttgtacagaattggagaaagaacaaataacttgtatcattgtttttctctcagaactttaaattgtaaagaattaagtaatgttcatttgtgctatatataaacacttttttgattaaaagttataccctgtttatttttttttccaaacagttaatgtatgttttgatttgtgtatctttgcagaccattttgcaatggaatacaaaattacagttcaaatcaatccaactacgcaaaataatcaatttttgaatctgaaaatattcaaatttgaaactgtatagtgttagtgaaataatcaaatcgttgaatatatattagtgaaataatcaaatcgttgaatatctattttatttctgtttactaaaatcagtttattttggaagataagttaaagtttagacttaatttgattataagatttaaaattctgcctattctccagactttaaatttaacattaatgttgtaatgttaaatgctctagatttacactgatatatcacaataggtacagcacaaatcattcttctaaatgttcagattaaataataagtcaaacagttcagattaaattattattcctggatagaattgttcctgtatctgtttttctctgtgtgaagtcctgaagtgatttgctttttcttgaagtgatgatcagatcacgtgagtttccaaagattcttcttggctgtcaagttttctcaatttggtaatgagtcacgtgaactgtgcaagacaaattgggctttatttgggatttcaattctgattctgaagatcaaatttgtttgagcagtgaatcttaaaaatttgttattgggcttaaattttattatatgatgggcctttaatttgattctccttttgttgttatacagtgggctgaaaacatcagttttgggctttttttgggccacgaactaatttgggtcctgaaagatgggcttgcgaatacactgttcctagcctgtttgtagtttttcaattatctgtataactagcaaaatgcccgtgcttcgctacagtgtattaaaactaaaaatatttgttttaaccgaagttattttcacactgctttaatacttttgctcgctagaaaaagtttcaaatgacagagagaaatatagttccgaacaaaagggagataaaaaaagacaaagccggtttgatttccacctttagacggtgcaagtcaacatggactctgaagatatgggtagatctacggagtggctcggcagcacggtcgaccagcgaacccactcagaccaatcgacgaccgatcgacgaccgtagcacggtaggtagcagccgcatctggctgtccgcttcccttccgcgacaccggtgaccatgactctatgctattattatttcaatatttcttatttttaattatagccttcatccgtcctgtgacgaacggaaagcccatccctcctggccatcggcgaaaaccatagcctctcgcccgagttggggcgaacgacaaaaagcagtggtgccggcgtatgccccctggctggtgcgcgcactcgcccgagggtgagtgcgccgccgtcgagcggccttgcctcggcgcccctccccatcatctccccctcgtcttccgcgcagcgtcgacgacggctagtggcggtggttgattacccgcgctcgtcggcgacgaccaacggcggcagttggctacggtgaatatggcagcggtggcggcgggttggcggcggccgtgggcggatccgagcgtggtggcagcggctctctccaccccctctagcctccctcctacggcagatccgcgggtggcggccgcgggcggatctagcggcggtggctccctccgcccccgctcgccttcctcccacggcagatccggcggcgttggcggcgtcggcagcgttcgcgagcggataaggagtggcggtggtggcgttggcggcgactgtggatggatccggcggcgggcgcgcgttggcaacgacgggcggtggcggagggcttcccacacggcgtcggcgacgaccggccgtggcggaaaacttcccgtgcggcgtcggcgacggccggcaatgaggtatttcgttcccttttttttcaatttttggttaaaatttttggggcttttcttcgggaatccgagaccccctttttttgtacggacgaaaaatcacccgatggatgaaacggactgtgaagaaagaaaaattacaaatattttaattagtgaagatatagaaaaaattcccatgcgttgtactgggtgaagactatcttaatcttattattattatatggtttatctaaagtgaaattaattgtaggaatttgcttggatattgtttttagtttttacacgatcatgagctacaattaggagtccgatcgtctcaagttagtatgcaaattgaagatgtttttttacaaatatagaagaagctccttctatatttctaaaagcaaacaaatttaaaacctactcaaatacaaatttgtaattcaaaaagcaaatgaacttaaaagccaacttaaacacgtatgatgtatcacagtactgataaaaacatcttcaatttaaattgaaatagtagagatagagcagtatttaaatgatattgaaaacattcatggctagtaaaacaagtatactaattaaaccatcgttgtctaaaaaaaaattaaaccatcaatgctcaccatcagccagctatttgccctccacgcgtcgttgagtctcgggacacgtcccagtcatccatggcgacaacggacggacccacacttctcgccacttcccagtcggacctatccgcccaggcgccctggtatcggtcttatcctcttttcctcgctttctccgtcatccctcgttttctcgcgccgctgcttgcctccgctgagctcatctcgctgccctcctcacccatcgcccctggccacgccttcactgccgacttcgccgccttggctacgctcgcggtcgcgctcgcctggagggccgccgcgccgtggcgggatggggtcgtcgcgcagactccaccgcaccaggtcgccgcgctacttatctccaccgcaccgtcggccatggagataaaggctgctgccaccggcgataaggcggtagaggagcaccttgtgattttttttttgtcatctccatctaggtagaggagcgggtgaggtgaagcgatgatttctttgattgggatgttttgattgaggattacttaagtacacatgtgcctttcttgggtaagggaaggatgtgggtggttgatttggagggagtttcttagatcggtttgggattgggggagagtcgctgctggatttgggtttcttgctggtttctcatgattcttcttcccccacagccacgagatagctagaagaaaatggtaggccaatgcagtctttccttctcgaatgcctcggcagcgagaggagctgtccttgaaaatttgtggttgttttacggggatctttgcctctttgtgctttcctgattcgctagctttgatgctggttcttgccttgtgatgtggtgtatccgatttggttcatttgttgcattgaaaacctcctggtctgggctggcagacgctcaggatttctcggaggcgggaggcccagcaccgcgccatgcgtttttccaccgcgggggcaaccgagacggattacacgaatacacaacacggaagtcacacgcgtagatttttatcggataacaggagacggacgatttttttagcggaagccttgcgtattttttaattagatatatatagatttatatgcttcaagtccttggcggttggatctagatcggagggacaaaaaatttgacagattgagagggttgttttctgtcgaatgagcagtagacagtccattatcacaaaactatagatttagaactaatttagtcataaaataataatgcttatagatccaacataataataatggttatagggatttaaagttgtagttttgtgataactccaattttaaatatgtagttttgtgatatttaactttaaatctgtagttttgtgataaatatgatgctaaatctgtaattttgtgatataacgccttaaatttgtagttttgcaatagtttaatcaaaataccaaaagttttgtgaaatttactcttatgcgtttcttgccaattaattactccacatgtttgccaccattaaaacacataatagcatatttgcattaagaaaaaagaagctagaatacatgttatttagcttctcctaaacctccaactcttttctttcaaacagtctagttcccacctaaatcttaggaatatgtggttgtagaataaaatgaattagaaaaaaaatactgaagctaactacgtcacatcatctataatttagtacatattaaaactcgacatgtaaccaatgctaaaatttatcatttccataatatttcaatctatatctatctatcatttctttctttaacatttaatacatatccatccatcatttctacaacatttagcatatatttatcatgtatttggcagcaaagcaggagatgtaagtgatttgtgattcaaagacataacttttatataccagcttattcactatatatcatctctgtatccatttcccacctattaacttttgtactacattattacccacccactaactatttattagtttatttttcacctactaacttttgtgttagtttatttcaccaactatcgtattttgtattacgatttgttttatttttactaggaaaggaaaaggcataatttcctatatttgtggactgaggtaatatgccattctatttgcaagtttttagtttttggcatccaattcacacgtctgtcgcaaaatatggcaaaagaggacgaatttctcccctctctctttatttcttcttttacatttttctcacaaatgtgtggacgggttttacacagcagcacgttacatacgtagatcgatgaactgatttttttttataagacaaactgcgctagacagtacaacatttcatatttgatatattttcataaaaaaaaagattacaagattaaaacattgggtaactatatataatgacgaaaaaaaataaagacacgccatcacatgctaacgactcctatcacagacacgagaaaattctagtaacaaattgaccgccgctatgtaatttcctctaaataaattttatgattttgctttgttcaagagcaatcaaatttgttttatgtgttctatacattgttatttcaatcactattacaaatcgatttttcatggcaccaccttatttgctttttctgtggcgtttatacgtggaaaccgtcagcaaaaatattatgaggggtggggggctatgaacgaaaatatgtgcaacattctgaacacataccgagggtattagaaaaccggttgcttagcagaaagcactcgcagttgtaggcattgacgacggtgtgcagcacgtgagcgaagaggaagacgagccgttgtggttgaacatggagcaatcgcgcgaagcgcttccaaaaactttattaccaccttctcccggtacagggcatcgaaggtgaaggttacgaaaacctgttttcccgatcgttggtacatcgacaagcgggatggagtagactacgagcgacggtgcagtacagaggaagaggcaaagccctagattgatttcacgtgtattgcgtggaggcgacgactcgacttatatagagatatcaggacacttgatcaggacgcctgcacgatctccactctgcgtaaccgaaacgaataagtcgcatgcaacttatccggactccacgccatttcacgtactggaatattcaaagtgtttcaaaaaacaaatctaaatttcccacaacaaaacaaaaccgtaaaaggagaatgcatctacgcaagggtgatgacaccgcagatgaaccaattttgacaaaccattcaacgcgtacgtcgtgcacgcatgcacacgcaccgccatgctattgccatgccaggcgaggggagcgagcatgttccccctcttttctccacctcatatgtctcaagtggctaggagagcatactcccttataaggagatctctctctcctaaaataggtaagatgaacagggccggccctgactttttggtggctcagtgtggaaaaaaaaatgaaggctcccattcaccataaaaatacaagataatatttaaaaactcattgtcattaacgaatttcacactaacaagtttaaaataccaaaaagaaatatctctagatcatttaaaacaatttcttctaacagttcagatgcaaaatcagtgatgatagtgtcaataacaatctcatctaacagcatcttctcaatgcacaaagtagtctatcaggcttggtactatagtatacatattttggaggcccctaatttttggaggcccagtgcggtcgcactgcccgcactgccccagggccggccctggatgaactaaactccctatgcatgctatccccatgaggtgggcttttgtgattttctaaagaattaatctttgaataagctaagaccatctattaattccgactagagttcacccataatcggaaagctgaagttaagacacggggattttaccaacatgagttttgctgtcattctcgaaggtcaaattaagaatttccttttaaaaaatttcaaattaagaaacattaaacaaaaaaataaatgggtaaagcttttatatatgcattcctaacgatttaaaaaccaatgctagaaaataaataatagtggaaaaatctcaaactcagttccaaatttaagtttcaaaattcaaattgtgggcgtgactgctaagccaagaagcaaacggtgaaatatgctaaatgaagacaagataattcacagttaaatggtttgtgttaataagaactgtcaattgtatgacttgcaaaactagaatatccattagccgttcctcgccatagaagctttcgacctgcaaaactagagtaagcaagagagaaacgtgctaacagtttaaagaaaatcttcacttgggagatggatatctaatagactgcagaaagtcagtcttagcagaagaatacaaaaaactcccatgtctttctggtcaaagaaagtatagccatgtccagatcatttccttcaaaaaaaatcaactacacatttaaaaatgacgtacgaggattggaagaaagtctgcgcatggtcagtctccgttaagctgataccccacaactctacataatgcatgttatggtgaaggacctgattggcattgcgttgttgacgccttgaggcacctcctttcagtcactgctcctcagctagcaaacaaatggtaaaacagtcgttagagtaatccaaagatgaagacaaaccagtgtagtattgcttgtggaagtacttctacctcttgctgatggccattatggtggccatggcgacatatgccgcagggtttaacctgcatgagatatgatgactagatccataaaagtctttacagtgttggaacctcgacagttacaatctgtaagtttgggcagtcaaaatgtataagtaaacgcatcccatctgaaaagaaaggacagctacagaaagcagctagacacaccctggagtgtataccaaactttacatacatgtatatctcacgttcaccattagttggaaagctgaatttaagactatgggcatttcaccaaacaagagttttgctggcattttagaagttcaaattaagaaacacttcaattcgtctcctgcatatcttacacattagcatatatgctgaaatagagcactggaatgaagacaagatagttcacaattatggcctctgttaatgagaattgtggcttgcctcgcaattaaaaagaacatccagtagctgttgctagccaaagagactgtcaagtttcaacctgaaagtccctcaaaaaaaagtttcaatcagcaaaattagactaagcaagagaaacgtggaaacagtttaatcaaatcttgacatgggattgggatatatatgaactccataaagtcagtctttcagaagaaaacaaacactcgtcttttgggtcaataattacatagatgtccagatcacttggccatataaacaattcaagccgctcatagacagatttatgggaagctcaaacaaagaggaaacaaggtgagatcaaatcaacgtcaatgaatcaactaaactttaaaacgacgaggacgtctgcccaaggccagtctccatgaagctggtacaacacaactctatataatgtatgcatgttgaagcaccttcttggcattgagtcattgacaccttgaggcacctcctttctatcactgctccccagctagcaaatggcgaatggacactctacagaggatcaagagaaagtggaagaaaaaccactggagttactcttgcggaagtacctcttactgctggctattatggcagccacagtgacatatgccacaggtttcaatccacccgggggtgtctggcaggataccgaggccgggcacctcgccggtgactccattatccgggatacctactacccccggtaccttgttttcttctactgcaatgcggctgcgttcgttttgtccattatagtcatcatcctcatcttgagccttgcaatcgcacaagagaagaaaaacttttggatccccatgcttccactgcgggtggccatggtgctggatctgcttggccttgtgggggcctatgcagctgggaccagccgggccgtgctaaaacccaggaatgcttgggtgttggccgtcatttttgtctatatggtgatacaacttgtgctgacttcattgagcagctgcacaggtgatgctcttaactcttgcttgacagaaaccataaactgcctaatatggcagaggctaaatatgtaacccgtttccatttccttttaaagaaaagaaaccatagactgttcctaacataaccaggataatcacaaccaggtgatggcaaaaaggaggaagccaaggagcaactgcaaacagctgatggcaaagaggagaaaatcaataagctctcccaatcaggtcataagaaagaggaggaaaaagagcggcgccgcaagctcctactacttctcgctacatttgtgatgagcgtcacttacctggctgggttgagtgcacctggtggctactgggacagcagcaaggagggacacaatgcaggcgacctggtcatgcgagagcaccatgctatccgcctgaaggcattctttgtctttaatgctgctgcatttgtcatgtccctgctcatcattatgctgctcctagacaagcaactagtcatcccactactccaggaccaggatcaaagcatgacctcccgagtaaggacccgctttctcaaagcgtacatcattattgctcttgtcggtcttgtgggggcctacgccaccggcagcagcaggaatagtgacactaccatctatgttggctgtctggttttcgctgttcttgcatgcattctttttctcaaggtgattatatcccctcacccacaagggtcagcatcagattcaaatggaaggtatggatgcatgaacatgtttctgcttccaaatattattaatatctgtatttccatcttaaatttgcatgctaatgaatcgctaggccaagcaatggagtaaagaagaacgcaagcaatggtggagtacagaccaatacaagcaatgcagatattctggagaaggctcaatctcttgttgtcctgctttccactcttgtaacaaccgtcacataccaagcaggactgatcccaccaggtggtgtttggcaggagaattggaaggagcatgaggctggcaatccaatactcttatctattcaaccagaacgttacaaggtattcttttactgcaactcaatagcctttgcagtatccttggtcatcatcatcttggtccagtacaagcctatcctcaagcaccacatactagagcttgccatgataatggatctgtttggcctcattggtgcatactctgctgggagctgccgagatgtaaccacatccatttatgtcattgccttagctggagttgttctagtctatgtggttattcatgttatattcatcacacttgatgaggacatgggaaagaaagatggggacaaggacaagaaggatgagggaaagaggcgcaagaggttgctcctttttgctgttttgtgtacgacccttacttatcaagctgggttgaccccgccaggcgggttttggctgaaggacgatgagtttgggcaccatgcaggtgagcctgtcctatcttacaactatccacgccattataaggcattcttgtactgcaactcaatgagcttcatgtcatcgattgccgtcattatactcctcgtgaacccgaatctgtataagccagccatacgaagctatgctctctctgtttgcaccgcagtaggcatgtttgctctcatgtgtgcctacgctgcaggaagcactcagcacctgaaaacatccatctatatctttgggttggtggctttggtcctcttcattatgattgtagtcctaatatgttttgtcaaaaaggaaatgagccagctaactcacaagatgaggaagaaagagtcgtacagaagtcccctccagcacaagatgaggatgtcatagaacaagaaactcaaacattgaagccgagcgagacaatgtctgccgatgaaataaaagaagacgacagaacaacgaagtccgcggacatagaaaatgcgggtgaagccaaaaataatacatccaacgagactaatgagaaagaaaaacaggaaagagcagccacagagtctaacgagaaagaggatgaatcaaaaaaacatgccaaacgtaaatactttatgctgctaggagtcttggctgcaagtgtgacttaccaggctggcctcaacccacctgggggtgtgtggcaaggtaacagcaatgggcgtgcagcaggtaacccggttatgcatgacaacaaaaggtaccgttacctcatcttcttctacagcaactctgcttcctttgtggcatccgttgttgttatcatcctgttgctaaaggagaaactgctaagggaggactggttgtttaaggtgatgaacataacgattgtgttgaacttgctcggcctcctacttgcctacatggcgggttccagaatgaggttggagtcttctggatatttcatcgcattagttatagctgcactaggcattgctgcaatccacaagatttggtcacgcaatagagaatctaagtaaaaaggaaaaggaaaaggtcaacttcgcttgttgtttacaaagaagaaaagtcaagttagggagtttagatgttctatgtgtgttttgtaacactatccatccatgagttctttgtttactgggatgcattctttacattccaatgcattagctggctaaagcaagatgcaatcatgctactagtccattcatatctcctctggaacagcccaaaagttaaaccagtgttacaaatattgaggttaagtcctgtataattattaaattggtccttcataaagtgtttttagggcttcaattaactctgtattgtttgaaagcccttgcccaattttcagagtccaaaacaaatattcaaacgtatggaaacattttatgtgggtttcaaataatccagtctgcttttgtgatattttttggacttcactccttcctttttcttttgtgattcctcggaagttgcacatgcaacacagtggctggaatttttccttgcaaaaaataaaaagcaggggctggaattgctttggttggacaaaaaagactttgaggatgaaatggttaggtcttatgtgccattctgtgagcctcttccaccaaatataattctctattcaaaactatcaccattaatttatgcagagatttgttctcaaggatgcatgccattaaaattaaattgaaatgtcgaagggcaaagagggagaggctggcgactagcctgtgtgggagattttagatggctctactggctcaggtgaagggattaccatgatggtgagatatattatatgactctacaggcattaaaaaaaaatctactttgcgctcgattcagaggtagtacaatagtatggatgagggaacaaactaaaactatatgataatatggatgcacgagcggccagggcctagtggaaaacatgaagaactttgccgggcatccatgttgaacctcacaaatcacaaattttgctgttttatttgaagacagttgaatgtatcagttaaggtgggatggaacaaagcaaacaaatggtgctgaaatgcaatgcacatggagtagaataaaaaaagtcaacaacgtcatgtgtttaaatacggaggtatgagttatttttatccaaaaatgatctataagagatatctgcattgtcccaacatattctataagaaacaccattttgttacagggtcaaatgaaactgtaacagtatagtactacagtttgtggaattcgttagatagtaatcagcttaccatcagcatttgctgggctattttgtcacaatcaaaacgactcaatttcctcctgtaagggtatatatatacaaatgagtgagcagtagtataactaagcaggaggaaggaagcacacggattaggcgagtagctgacctcacctcacctgtgattgctgtagtgcatcgcagccagcccagccagggcggccagaggaaacagccggccggagcaggaggagcgggtgcccggccgcagcgcgtacgctgcccgcttacccgccatcggagcgcgaggggatgaatcgaagagggcaagggggaccttgttggcgatggttcctggtggacagctgctcccgccgccgccgcccgccggcatttgtggtggcgccaagatagggtgatgggggaaacggcggggcggcggcaagcgggaggggagcgagagacggagagagctcggtttgcgggcggcgcacctttgccaccggccggcggcggcggcggccgtcagtgggtgggtggtcgcaccgcctcccgttgcagatcgggctcacatgtcagcccaaaagtgagcgtaaattcggcccaaaagtacgggtcaatttggtgaattttttttatttttaattttttttattaaaagttttacaaaaataatttttcattttgaaaattgacagaagtggtcacctaccgccctctgggagggcgatttttaaaaatcgccatcccagagggcggcgaaagtgacgtggcagacggaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattatttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccttgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacatcgtggtggtgtgcaccgtgcaagtcgtcgtcgtagaactggctagtaggaccagtcctaccgacgtgagacgaagaggccccagtaccgaagatcccggctgcaaatcctgctggacaaggaccatcagtttcatacatgtatttaatagtattaataaaaagtaaagtaccgtgtgggcgaaggatcgacgctccgtgagaggaagagctggcgaacgtgcccgaagaggtggcgaacgcccctgcggagctcgcggaagcgccggtcgtgcctgcgaacgcgctcgaaggcagacgaggtccagcgacgaggaaacgtgcagttaaaacatggtgacatattcgtgcaaaagctgaaacaaaaatgaactaatgtctggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgttgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacatgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaatgaagtatcataaaaatttagaaatgaacaatccgaactcacgagtggtcggcagggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcaacgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccggtaagtccccatcgtgggaccgtcctctggccactgcgcgctgcgtccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaacaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctataaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcgaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagcttaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgtccaatgcttcaccgcctccttcatctcatccttatgagcataccttgcaccctcaattacctcgttctccttatactcctagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctcctcctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatgcccttagatgtcattacaaaatctgacagatcaacaccatctggaccaaatctaatatttccttcaccgtaaactatctgaaatgtgaccttatttgacattgtgcctgatgaaaacaataactgcgttaacctcgcatttctgtactacgccctaagttacattctctacaatattgtcacgccctgaagttttccccctttttgcttgctttaaaaatttggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaatcccaggaaaaatcctttcttctttttccttttcttttccctcctttttctctattgggccgtcggcccagtccactccacccgtcgcccgcgctcggcctccccttgtgggccggcccgttctccttcctcctctctccgggacgctgacaggtggggcccacctgtcaggtcgtccccttcctccagccacccgcctccgacggcagccgccgccgaatccgccacgtcgccgcctcctccgctcttcccgcgcccacgccgcgccgctcccgcgtctcccccccccacgtcgccgcctcgcccccgcgtctcccgccctcgcgcgcctcgcaaatgtgcgggattcggatttgaatccccctctctctctctcttcctccccactcccccacatcgccggccaaatcggccacctccccggccacgtccgccccctcccgcacctataaatcgctccccgcgtcttcctctctcgtttttcgcactcgccgcgctctcccgtgccgtctaccgccctcgcgccgtcgcacccgagctccgccgcttgccgccgccttcggccgcgagccgccgccgctagagtcgccgccgcgccaaaccgccgccgccgttagcttcgccgctgcaagagctttcccggccgccgcctcgcgtcgccggaatcccaccggagcacctctcccctcgcgagccggtgagtttttcccctcccctccatctccggccggcaattcaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctcccccgtgagcgccgccgccctccgcgcgtccgccgtcgtcttcggctgccgccgccgccttcgcgccggctgccgccgtctccccgcgccgccggtcaccgccggcggtcgtgcgccgtcgtcgcctcgccatggccggccggcttgagccgtgccaagccagcggccacgcccctctcccgccctgtgccgctgcccggtggggcccaccagccggtggaccacccctccctctccccttgtgccgctgccagtggggcccgcttgccagccgccccctctccctctcttagtgccgctgaccagtggggcccgcctgtcggcgccaccccctccccttgctgacgtcagccctgggtattattgcgcaataaattaattaaggacttttctttattagtaaaaacacactttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccacggtttctcgaagacgttgctgaggtctcgtcagtgcgagagcaaggcaagtcatgcaatacgtttgatcatattgtacccaatttacaaatatcccgcatttctattaaatgttgcattcttttacaatatcatgtgggatgggtcctattactcagccatttattgtttaccatatgccattgataacctgggtatcaaaatgattagatgttggtttaggaaatgcttagccatgcttagctcaactagtacacaaaaagggattacattattacatagactttgactatgagcatagctttggattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggctgggcctgttgcaacgtggtgtagcgttggacagtgtttggttaatattgattaattactacaactgtcttactgctttcaactactgcttttaaatgctagctttatgcaaaagaacctctagcttcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatttcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacaagttggtatcagagccaggtttgaccgtaggacaagccaactggaaacctaagagccctctgaacccctttttcatctgcatatgcctttttgcacttggattttgttttggaaaaatttggagttttgcctctttggtttgcgggaaaaatcttggtcgttctttcggatcagatttttttttaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgtttttcttccttttctcatatttctacctatccccttcagatggagacaaggaatggttcacgcgactcgaacaacgccagtggcagcgaagagccgatcaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggttctccacctcctcagtccaaactgctagaatttcttcgtgtcaagccgcccaccttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccaactggggcagaggttacttggacagagtttcgtcatagtttcaataaagcacaggttcccgagggaattgtgggacaaaagaagagagagttccgttccctgcaacaaggaaccagaacagttatagagtatttgcatgagttcaaccgcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagcccagttcaggactccccaggggaagagtcagaagcctcgtttcacgatgggacatcacggtggaccttccaccatgattatccggcagcaccgtccctaccacccgggtaacttcaacaagaaccaccatagtgacagtcacaacaatagtgagcagcacagcctcaaccctactccgagttcactaaagattccagctcaatcagttcagccagctctgccagaacagcccaagaggtggggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgtcaactcgacaccggcagtaatattgtttgattctggtgcaacccattcctttatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatagtcagagagtatccagaggtttttccggatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggaaaagaaagacaaaaccaagaggatgtgcgtggactaccgcgcactcaatgaggtcactattaagaacaagtaccctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcacgatctggaattggccgcagtcgttcatgctttaaagatttggcggcactatctcatcggtaaccgttgtgaggtatatacagatcacaaaagtctaaagtacatcttcacccaacctgatctgaatctccgacaacgaagatggttggagctaatcaaagattatgatatgggaatacactatcatcccggcaaggctaatgtggtagcagatgccttgagcaggaagagttactgcaacgtcgcatgggtagaggaactatgctgtgaggttcaacatgatttggaacatttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcatttcattccggtgcacactacctactcagggaagaaattagcagaactctatctggcaagaattatgtgtttacatggtgtacctaagaagattgtgtctgatcgaggaagccaattcacttcaaagttctggcagaaattacaagaagaattgggaacccgattgaatttcagcactgcttaccatccacaaacagatggccagaccgagcgagtcaatcaaatactagaggatatgttgagagcctgtgcgcttgactttggtggggcatgggacaaaagcttgccgtatgctgagttctcgtacaacaacagttaccaagctagtctgcagatggcaccgtttgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgctttcgaaacaggggattatgtgtatctccgtgtcactccgctcagtggagtgcatcgcttccaaaccaaaggaaagttggcaccacgctttgtgggaccatatcggattttggaacgtagaggtgaagttgcttaccagctcgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacc

SEQ ID NO: 69049 - DNA, 2048 bp, Oryza sativa
ccagtagaaatgacgcatatgaagtccacatgctctggtagaaacagctatatgtgtccgaaaccgttaatcgtaaaaaaaccataaattatttgccatgaaggtaacctcctaaagtaaaattgtgtggttcaggatcacacaaacattttctcatgattaacatttttcttttgactttcatgatgggtttgtgagttttgttaatgttgcatacaaatacaatgtatagttgtgaaatattaaattcaaattgtacaacattcataatgtatatttgtgtgcgggtatgtacgaatatacatatgcaaagccctttaattagagcaactatatataaatatccaatttgtaaattgcaatacaaagcaaaagagacaattgaacatatcagtaggtcttatctagccatatggctcgaccaacaatgctctgatccaatgtgaccaagtcattagcatgagaaagactacatgaaaaaacccggcaattacattagtttaaataataaaagcattacattagggatatatcgtgatgctacttggtgcatcaggtggtagttgcggtagcatgttccatcttcgttgatggatggatcagatgaggtgttgcttgctcaagtgattggagcagcggctgctttaaatgtttcatccattaccctaagcttgtcagcgggcgcggctgcgtcaaccgcatcagcagcaatcatgtagacgatggaaaccgcggcaacttttttcttttctcctgtagccttggccatgttgagagtagaggcagcaaccgtagcctgcttggacgtggcctccaaagtttccgccttatttgctggtagtgcaacagcaacaacaccatcgagggcctttcggatgtaggagcatgtattacttatgcatgtgtcaacattggcggtgcaatcctccgttggcactcacatggccactttaaagatatcaatcattgtcgtaaagttgtaagcggatgccgaaatagggatgataccagcaatcttgttggcgcattccacgggtgaggctaacatggttgacattgtaataaccacaagcataagtgcaatgaccttggccatcatgaagtatatatcctaataatttgatgagggatgattcaatgcaacaagaactagctaccctagatcgatgagttgcttgctattatgaaagtgggacgtgatttctttaaatagtctgtaaggcgtagaagctttgtggtcataaattggttggttgaatgcatatgtgccatgtctatgggtcaccgcgcatttctcccaataacatgtcgttagcgagcagctaggtgtttggtggatggccatggtaacaggttatccccttttagataatggaaggttctattaaacttgttctattacatcaaagtcatacaactacgctaagaacactctcgacgtctctataacaaggatgcgcttagccaaaacacatgcgaaccaatttaaaagaagggaggtccaagaagcattaaggaccatcagtaccaagagtaaatcgccaccaatttacctaggtaagactctcattcgccatctcctgcaagtgtagacacgcaacagtaaccaactcccgtgagctcgactttttagtataaccttggtgcgtaaccaatgtatagttaaaaataggaccagcatgggagaagaaacaacttggctgcttcttctaaagcggattagagtgcgacgaccaaagctacggatcagcctctaccgctttccatgcgaagaaccctagcctggcctaaatggaccacaatttggaaggtgtgcctcctgtagattcctcggtcctgtggtgtggtggttgtgcccatttggtgttatttcactggatttataagcccatcaacctataagtctacctctcaatggagttcaattgattgttcggttgatttccatcgattctcctccaattacgtaattttctcttcaaacaaataaaatttcaagtactagtggagatagattattcttaaacaaaatatgcatgcaagcatag

SEQ ID NO: 69050 - DNA, 10723 bp, Oryza sativa
tatttctgtaaatattaaaaaaaaaaatctaaaaacaaaaaaaactcccggaggatgaaggagctcccgacaggtggggcccacctgtcggtctccacaggagagaagagcgggcggcgtcggctgggccgattgggccggctcggccgcgcgggagagagaggatgttgggccgaaatcggcccaacgacttagggaaggattttcaaaactttttcaattaaaataatcacttaaatgatctttcaattgttaaaaatacttccaatgctcaaataattccaagaaaaatcctgaaaatacttggacactaaaagtacttaacaaaattataattagaccatttaatgattaatttaatatttaaataattgctgaactgctctttgtatgattaaaattaagaattgagctccgaaaaatccaagaaaatttcagagagtataattaaccatggagaatttaataaaaattaaatccacccatgctttatatttaggaaattttatttcccacatttaacttcacttgtaaattaatgaacatttaatataaattctaataataatttattaaataatttataaatcctgaaacaaaaatcaggatgtgacaccgagcccagcccaaagtgtgtcctccctccctctcttttcctcccctctctctcccgggcctccacttcctcctctcctcctcccggcctgcctcggcccaagccaggccgagccgagtcagccgcgtgcgcacgagcgctaaccgcgcgaccgcgtggggcccaggcatcggtcgtctccttcctcccgccggctcctctctctcccccgtgcaaccctagctcctttcttccctcaaatccgcgcgaatcaattcccttctttccaaattgattggggggaattaataccctttccttcctcttcaattccccctaatttcccccttgcttcgtgctctcaaccgcccggaacagccgcgccattcccggccaccttccatggccgtcggccccaaatcccgccgccgttccccgcctctcccatggccggatcgctcccttccactataaaatggagcctcctccttccgttctctcgtttttgcctcttcccgagctcccccgtggccacaccacctctccccgccgcccttctttctctctcccgtgccgccggccgcctctagccgcctgtgccgcctcgcctgtgcaccggccgacgtcgccaccaccttcctcggctctgcgacgccaccccctctgccggcctcaccgtcccctcgccctaagctcgccggaacggtgtcctcgttgacgtccagtggcgttaccgccactgtgccgcctccagccgctctggttgccgcgccagagcgccggccgacgtcgttgtctcctcctccggcgtcgaagcgtcgacctccaccccggcctgccctcggtttcgtccggagaccaccgtgccgcgtcggcttctccatcctccatatcgacgtctgtcacgccctgaagttcccctcccttgctctaaattcataaaataaatcgtccgaagaaattgtttaatttaacctagagatgaatccctaattaataaatgcaaataataatcggaatcgacatgtggaatttttcttggattctacatgtcaaaatattctaacaggatttttagttgaattttcagagccttggaaataattttaaccaattaaaataagcaaagtgcaatattaaatccctgggaaaatcctttttcctttttatcttttctttccctcctttttcctttttcttgggcccggcccatttcctcccgcgccggctcgctcctccctcctactcccgaagttcacccggcctccttctccctctcgggcgctgacaggtggggcccacctgtcagccctttccctaacctccggcagcccacgcctgcgccaaccgccgccgaaaccaccacccatcgccgcccccctcccccgccttccgcgccccactccgcgccctgcgcccacgtcgccgcccaccatccccactcctcccactcgcgcgtgcaccccgcaacggagggattcaaattcgaatctctctctctctctctctctccattccccacgtcggcgagaaatccggccgcctcccggcctcgtccgtctctctcgagccccaataaagcttccccgcactcccctccacctttttcctctttccgccgctctctcccctgccctccatcactcccgcaccgctacacccgccgccgccgccttttccactcctccggtcgcagctcgccgccgctggagccaccgccgagccaatctgctgccgccattagcttcgccgccgccaaagctaccccggccgccgcatccccatccaatcccgccgtcggggcccgcttctccccgcgcgccggtgagtaccaccattgccgccgccttcggccatggtttccgcccgccgtagaccacccctctccctctaatccttcccattttgttccctaggaggtcccggagatcgttcgcccgtcgccgtcgtcctcccgtcgctcgtcgtcgtcgttcgccgtcgtctccactcgcgccggccaacctcggtgaaaaaactccccctcctccctctttccctctctcccgtgtgcgtcgccgtcctccgcgcgcgcaccgtcgtcttcggccgccgccgccacttttcgcgccgtctgccgttgccgtccgcgccgccggttgccgtcgccggcgaccgcgcgtgccgccgtcgctcgccatgcttggcctgccggctttgaagccgagccgagccaccagtcgcgcccctcccgccttgtgccactgccagtggggcccacgtgccggcgcccctccctctctctcttgagccgccgctcggtggggcccgcttgccagccgcccctctctctccttgagtcactgacccgcgggtcccgcgtgtcggcgccacccctccttatgctgacgtcagccctgggatgaattattgcgcaataaattgattaagggtttttcttttatagtaaaaacacagataatcttctaaaaatcataactaattcatccgagctccgattaagtccattcaagtctcagtaaattcataaaaatgtatagaatccattaaaaatggttttgtttcctgtttcagtagtcttatagcatgtcttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacgcaatttacaaatgtcccgcatttctattaaatattgcattgttttaaaatatcatgtgggatgggtcctattactcagctatatgttgtttcccttacgccattgataacttgggtattaaaatcactagacgttggtttaggagattgtcacatcctgatttttgttttagggtttataaattatttaataaattattaatagaatttatattaaatgatctttaatttacaagtgaagttaaatgtgggaaacaaaatttccttaatataaagcatggatggatttaatttttattaaattctccatgattaagtcaactctctgaaattttctcggatttttcagagctcaattcctaaatgatacaaagaacagttcagtaattatttgatcaataatgatctaattataattgttaagtgcttttcttgtttaaaatccttaaattataaattgttgtttaaaaggaattattagaaatgattttaaaagcttaaaagagaagatctaattttaatttgttaaatctcaatataaaattgggctagataaaattttgttaaatactttgcttaattctataattcctagatttttctgggatttatttgagctaagggagtatttttaataaatggaattgcatttcatgaataatttaaattgaaaaaggtttttaaaagtcttcttttggctttgggccgaaagtcggcccaaaacctctcttctctctctccctcggcccagttcggcccagtccgccgagccgccgctctctctctctctcccgctgacaggtgggtcccacctgtctggcctgtcttcctccttcggccgccgccgcccgaaaccctagccgttgcagccgccgtctccttccaaaattccgtcgctcctttccatctccggccgaattgatagaggggaaatgatcctcttgatctcctcttccttttctcctttggaaacatcggctaaatcggtttggaaaccgttggattcgagttggattcggattcgtttttcccgaagtttccttcgccgtcgccggccgccgtgggccttcgccgccgcctcttagcccctttaaaaggacccccgagctctcctctacccgccgcccccttcgccttcgcctctcgtcgtcggtttcgccctagcgccgtgtgccctagcgccgccgtcgccgccgtcgctccagccatgcgccgccgccgttccagacgtcgccgtcgctcgggaagaccgccgtcatggtcgccaagtcgtcgccgtcctcgtccgccccttcgccgtcgccgaagatcaccggagcaccgtcgccgccgtcaagccgaagaccgccgccgcttcaacctcgtcgccgttgtcgtccgttgttcttccgccgccgttttggtcaccggtgagttcgccgcgtcgtcctctacgtgctggtgcccttcgtttgcgtcctcgcactgtcgttcgccggcgagcgtgcgccgtccgagccgccgagccgccgccgccggtggtgacgtcatcgctgacgtcatcgtccccgtccgtcgtgagccggtcgtggaccgatcgatctcggccgtacgttttggatcaagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatttaagtgttttaatccgattaaatcttcaaaaattcataactaattcatcttagctccgatttagttggttcaagtctctaaatttttctaaaattgagatatacatgttaaaaatatccacatatactgttcatgcttgtttatgtgctgttttggtgtttttgcttctttttgcttagattccgtcgtttccggagagtccgttttcgccggagaagaatttgaagagttccaaggccagcaaggcaagtcacacagatcccaaacaaccctttgagcatgttgatcctatttaaagctactgtttttattcaactattgcatttattttcgaatgtcattgggtggaaataacctattgtttgttacaacccttttgttcttgattactttattccttgataccttgggttattataacttgactagttgagctttatatattggttcaactagatattagatataattgcttagccctgcttagaaacattagctcactattgggttaacttatgactcactgttatttaatgatggctgaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccataccttgtttataagggggtgattatgatccaggaaaggtgcgccgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgcttcaattggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttatcaaattctcaaatgtttgctaaatgctgcttttgcaaatgaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttatcttattttccgctgcttagatctttattgattgagaggaactatctacctctgtaatgacattttatacgcttaatcattagagtaataattgtactctattatcaatttgttcttgtgtgcctcggctgattcctggacgagggttcacacacatgtaagcgtttggaattttggatagaaattccgggcgtgacagagatgcttagccatgcttagttcaactagtgcacaaaagggggtcacattaaagtataggctttgattattagcaatagctttggattagtgccactgcaatggtgttggttaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagctgacgtacccaggcgagggtgggcatgatggagttgggtcggccggggtgtccggttgatcggcttccggattcaccgtggcacgaaaggggggttgcccgttgcctgctggggacgggggcgaaccctaaggtgtggtgcgatcggttagagagggttatgcgaacggtcctgtcacggcctctttccggtatgtcgtggtggcatgtcggcgcacgggaacgtgtcgtggggctgtgtcttgtgggtacagttgtacacctctgataagagttaaactattcgaatagccgtgcccgcggttatgggcggtcgaccagattcaccgtgattagtctcacccctagtttagcttaatgaactggtgtagtccaggtggttggttgggcctgttgcaacgtggcgtagcgttggatagtgactggttaacattgcttaattactacaactgtttttactgttttcaactactggttttaaatgcctgctttatgcaaatgaaccccgtagcctcctttggttatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagccttcaggcttagctcgcttttatctttttccgctgcatttgtaatcttttgtatttttgtaagacgtggatctgtatgtcaacaattgtcgtttgtgtaccctggctggttctggacaggggtttaatgcacattcagcttagaaattctggttcgtgaatttttgggcgtgacaacgtccccttcggtcggtcgttcctctccgtcggctcgtcatcccgttgtgccgcctccgtcgtcggcatcgcagcggcatgctccatgccgtacttgcctccgtgcagctgctgccggctgccatcttcgcctcctcgccggccccggtcgtcgtcgtcgtcctctcgtcgttaccggtcgtcgtgctgttcgttcctccatcaagccgtgctcgttcgttgcccgcgtttcgtcagagtgtgctgcagccccgtcgtcgtcttcgtcctcggctccgcgtcgtcaagccctgcactggccgcgtctcgccttcgtccaaagaccgccgccgaagtcgtcctctcgtcgttcgcctccgtcgtccctgagccgtctccgccgcgcccgttcgtcatcgtcgttccacgccccgtctcgttgtggtgaggaccactctactggctgccccgtcctcgccctttcggtgtcgccccgtgcctgttgtgcggttgtcgaccccggtactcgtgtaccagtgtcggtagtcgttcgtgtgtgcgtgtggtgaccgtgttagtgtgcccgctcggtagccgcgtggtttccacgtgtgtagcccgcgtggtatctagtggagtccatttgtcggccactggcctcggttgacacacagggtccgcttccgtcaacccgtggaccgtctctgtgtacccggtccaccgtggtcccttaggttgacatgtggggtccgcatgtcaacagcgcagccttcttgtcttttccaggctagcgcttacacatgttttatagttgtaaagcttaattataataatccacaaatctccgtataacagcattaaacttcggatgaccacgtcctggtcatacgaactccgaatcgacctgttcaagtctcttaatgtttattataacctaaagaaccatgtgcctttctttttatgtattgttattgcttctttgtaggcttgtagcttagcttgtgtgtttcgcgtagcttccgttgttccagaggttcccgaagtgtggttcgtggttgtcgccgaaggttcgaaaggccgttctctctaagcaaggcaagtcgcataatccttgagcatattgaatcccagtttataaaattattttgatttaaattattgcattaacgctttatttaagtttttgcgttattattgttttatttagcactccctattaatccttgttatagccttatcattgctattgtttattatcaccttgttcaccctaggaaaataaaaccccaactagtgggtaatctatgcatggttcctctagtatgaacttaggtagatgcttcgctgattaattaggcaacattaggtggttttataactttagactttgggagttctcatatcatttggacacacacctccccctctattcaaaacccccaaaatggttttaggttgggctcgaggtgcatggttttgatagtagcacctcggccatcataaggaccggtcttcgggcctctattgcaaagcactaccgtactaaccacttgtctaatgagtaaggcttaactcggtgtttagtctagtcctgaacaaaacgacacggatagagatggatgaagtcgttatgatgaatatctctgaggcaaatgtaggctacacgggctgcggttcggcagtcgagatatgtaggcaaatgaaggctacacgggccggtgtccgttagccgagatgccatggcactggactagcacgcgggtggtctcacctctatgtgtgtggtgcacccggtctaggtcctattgctaggggctcaatcctggcctgcctgtcccgggataccggtcgtaggcagggttgggtcggtgcttttgttcacggctaggatgggtgaagggttatgtcacgttttttatgatgggttccacttgcaagggaatgcagagtaaaggcgtgtcttgttgttaacagtgaaatttggtaagcccggagtagtcatcggcttagagttagcatcggcttggaagtcctgagattagccgatgagagttgtcaagtcgtcagttgtcggattcttgctatattcggttaagaaaattgatctactaaaggaagcttatccagaagagaccgagttcaaagagaatgcggcatggcaagttatctattaattaggaatagtttgttagtttccttttatctctaggaaagtgtgtttagtgtcctataaggactttattttttttcttttatctttaggaaagtttctttcttgtccgacaaggacttgtatcaacccatgggtataaatatctacacccgaggtctatgtgatctatctctacgatcaatacaattcagcgcatcgccaccctttttacttctacttttgttttttacgttccggcggaacttggcacccgacgcggggctgcatcgtcttcgatcttcggcgaagggataagtccaatgttccgtaggcctaggcaattctatcgtttacgtcggcgtcgttcaaggctgcatcagtacattcgacctcttggattgctctggtttggatgatatttttgtctacctatttatcatatgtctatgttaatctagtcttagcaaatcaatttatctctatcggctgcttctcgttttagggtttctgccggtataggctaaatcgtgttgttagattagattagcttagacatctaccaccctaaaaatcagtcaacgacttgattgtctagatattatgtttcttttcatacttagtgctgcatcagttaagtttgatctactaagccgtgcttaaaaccataatctctagcatgcttcttgattgccaataagggtttca

SEQ ID NO: 69051 - DNA, 641 bp, Oryza sativa
attggactttggttaccctgaactaatccatttgtcctaaaataagttcattaccaatacaaaccaaaacaaaaattagaatactcctactttatcaaatattatgggattatttttcaattttatttatttccaatgcaattattcctaattgcataaactttggtgtaataattactcaaaatgcacctattttggaacaaatgggagggaaatatgaactaattgtggaataaagggagtatataaaattaataaaaaaagatttgggattgtcataggaaacttaacagggttagttttctaacagtgaaagtacatgtaccaacctcttcataaaaaaaagacagccatttcttttccatgacatgagagtatagatggccatctgggctgcccagcatggcatggcccaggcccggtcatgcctgggctgaggcttgtcgggccggcacggctcgaccgacacactaggccgtgtcgtgccaccccaccggcggcatacacggcccaatactactcgggccgtgacgggccggcccgaagcacgatggtccatcgtgcttcctcagagaaaaagtctatttttggcccctcaactctgtggggtgtgtttaaatggctggaaaataagtctattt

SEQ ID NO: 69052 - DNA, 1473 bp, Oryza sativa
cggtcgaaagaatagggatgtaaaatagacttattttacctatatatatgtcagcccaaagaggagggacggaaaatagacttattttcactatatatatgtcacagcccaaagtggagggacggaaaatagacttattttcgatatattatgtcacagcccaaagaggagggacgaaaaatagacttatttaaaaaaaggcacgatgggctacctgcgccttcgggccggtccggcacagcccgacggttggtgggccgtgcctaggcgggaggcgcatcccatgggccgtgccggcccggcacgaagtgccgatcgggccgtgccggcccgatggctggtgggccgtgcctggctgtgcttgggcgcaggccgtgccgggcgggccttttggccatctatacacactatttctagctttattttatgcgctgatgaataaggtttttctcctgcttgcagaatttgatgttggcctaatcactgttgatatgtccataaatgttacttatccaaacctgaaacctcacctccatgagctggctgagcttatagctaaagagctggacattgactcccgtcaggtaagggtgacccatagtctgtgctgttgtggtttttctagttttgtttggaggtgatgcgtgagggacactatccttgctattgtttacagctttgcaccatcctatcttgatagcactagcattcttttgaagtgatttgttaaagttgcctcttgagtttgacaggttcgagttatgaatgttacaagccaaggaaactctactctaatcagatgggggatttttccagctggaccttctaattctatgactaatacaacagcaatggtagcatccactcttgcacatatgaggactactttaatctatctgttataaagataattgatttgctgcattgatgtatgattagggtatcatttatcggttgacccaacatcacgtccagttgcctgaaaatcttggcagttatcagttacttgaatggaatgtgcagcctttatccaagaggtaagcaaacaccattataactgccaagattatattgccattaaaagcttgtacagtccatattatcataataagctctgtctttatcattggaattcaactctttcttttcattgaagccctgctttcatcctgatctaaaatgacaaggcaacatcccttcgacatcctttttgcagggaaaaagtagatacatgtcactctacactagcctgtttagagatataccattataaactataaagttctctctcccaaacactattcttatactgatcagtggctttagcgtgtagttgtagtatgcaatggggctgcctggcaaacatggaaaacctgaatatctgtcaaagtgcttaagcaagattctcacatctattaggaaaaatcattttcaccaattcccttgaatatttcttgtgcggcatcgatgcat

SEQ ID NO: 69053 - DNA, 20352 bp, Oryza sativa
gttttttcttctcaagtaaattgcattgtctctaccttgactttacttgcactggtggagaaaccatcttctgtcggttggtaaagatggtcggccaaaatacacaatagtcccggttgcaataaagatatctttaatcccagttcaaaaggttagagtagtttttttatctttagtcccggttagtattaccaaccggaacaaaatatctatttctagtcccggttggtaacaccaaccggaacaaaagatctctattatctttagtcccggttggtgttaccaatcgggactaaagattataggcccgattggtaacaccaaccggaataaaagatcagcatgcgcaacatgggcggcggagagtacgaggccaaatcgaggaggaggaggagcagttaatatattctatctcctccctggccttatctcttcctcctccatatctcttctttttagaatttgtgtgtgtatttgatttgtgtgtgatgtgaatgtgatgtatctgtgatgaattttgtaaaatttatgatgtatctgtgatgtatcgatttggggagttgaggatttgaggatttggggataatttatttgggattttgggatggggatggggtgaaatcaatatattaaaaacaatgaagaaaagaaaataataatggagcaaccggatctagctagcctagctctatctttatatttagtcctggttggtattaccaaccgggactaaaaagactctatctcaccaaccatgactaaaaatggatttttactcccggttttttcacccgggactaaagatagtgatctttagacccgaattggtagtccggtttgaaaaccgggactacagtgaggttacgaaccaactcaccgggagtaaaacccctttctccaccagtgttgacatataatgctatttaacggaacatattgcatttcttttgtatttctctttttcttttcagtgtatgacaattttgtggagaagccgataaagggtcttgagtgtgacaaaaaactccagtgccatagctattttcatcttctttggatttcatgttgttgcaatgctgctgggggtatgacgagcgaggagattcaaactcacccccagttgtttagaaccatacatactacatacatactagtaatttgtccatgctaacgctacggtgtaataatattttgattaataaattatattattaaatttcatgttagtcaaattacatttctagaatcagtctcaaatgttaatttaagacaaagggcaaaaatatcatattgtctgaaaaaaataatttaagaccatcaactatatctaggctaaattctttcccatgagtcgctttttaaactgctaaatggtatgcgttatgcgaaaagtttatataggaaagttgttttcaaaaatcatattaatatattttttaagtttttttataactaatacttaattaatcatgtgttaatctatcgctccgttttccgtgcggaggggaggggttcccaacctctccaaaagaaaacagccctaatcacctcgacacaagtctagggacaatatatgtccatgtgtggcggggtaaaaataaattgaagacacattgcacgattagatccagacattcatttcaaaagcattataagaccaagtgcatagacattgaaatgccaaaaattgacctggcatggccaaactcaaaatgaaagctaaaccctgtaaacattcaaattctgtttctcacacaacatcccacattccacttgctttgattggagtgaatatggttaagaatatgttcatctcggatccaaaatataccttgcttaagaaataagttgacatgcattgcaattttaaacaaatattaaatttgttagcttgacctttagaattataataaatcagtacctattcaggatattctactgattgtagtgaggtacacaaaagaatgccaaattactgcaaataaaaggagcatccacattggtctcgacaattctaagtcattgcttacatggtcatgaaagggcagtcacattctaattctgaaacaagaaagcaatacctacataagggtgttacaggccacataagggttataggcctcccaactgcatttgcatgaatctggaataaaacaaatagtggcaatccattttcagttaaatggaacacacggagttgagaaatcaatataaaatcaaatgcagatgttataagtcataaccaattgattttttttaattgtaaaagcaatcaaacaagaaatagagggcaaagttcatcgatcatcaactaataataccttaagtagtcctgcattcttgaagcagtcaaaaattttggttaacaatgaacatgttatctgatcatttcagatgagcgggatgcctaacctgaaatctgccttggtttgtccctacggcaagatgagtgccacgctgcgcccaaccgatagaaattaacattatagagacctgtcaaccacagcgtctcatccaaccataaccaagtccaatatagttaaagcaattggtttcttaggactgaaaactttatcgaatttcagtctctcaggaatttttcagacaaaaattttgagaaaattctttcaggttataaatcctgaacttctatgctgcatgttggactgacgtacattactttttttcttcttgatctaaaagtgaacttaagcaattctaatcccagagatggccctaattaaaatctgcctgtccaacggtgcctgtttttatacatacatgcatgcaacaaaaaaaaattaaaaccgtttattaatctattatcattgatgaataattataattagagcatttgccttattacaagattagaggagcataataggtaaatgtagatcaaccaactccctttttcatggctaacatttgatagaaaatcctccataaaaatccatcaaatgtaatatttataatgcaattacaatgtaagtataattagggttaaataagtcacattaaactacacaaaacaattgctaggtaccaaacaatctgtcaaactcatgatctctgtcatgcaacagaacaatggagctataaaaagattgaaagaactggataataatttggaaagcctgaaaacaggaactacgtgcaatttgggccagcagttcacaaagcaaatgtacaacaatgcttgtttgttcaatcgaaattaaagaagtgaacttctacagtgtatgtatgtatgatgagaaaaatgtggacgactgcgtagcatttcaatctcatacctgctgtgtgggttcctgctgctatggaggctcctgctgatgttgctcgtaattgccataaccatgtatccattgatgtcccgtactcctgtcggggttaacctgtggacaagcaagatgcagctagcatcaacagacaagaattcaactctgtacacagaaaaacccccctacaaatcccaatatgctatcacggcagaaaatccacaagatggcgacctggaggaaggccgcccggtgccctagttctgtggccgcccgtcgagcttgtccgtggccctgactgaggcgaggaaggcgtcacggtgagggatactggtcggcaggggattccggtggtggcgcgacggatagcagacgatggaggctcatcggagaccaaacgacggcggcgcgacggagactggcaacggcgtgacgaaggccagcggtggcggatcgacggcctacggggcggcggcaattagggttggtggcagtgcgctcctgaggggggcacaatacgtcgattgcgcgtgcagggcaaggagatgcgcccgcgcggggtaggcgaggtgagtcgatcaggatcgttcgatcgggataaatgaatacagagcgtaggatttgatgaatgaaatatgaaggatgtaagacccagttgttgaattatagggtagatgcagagatttatgctttgatgcaaattgtagcacgcaccatcttccagcatcacattatctagctctttttaatgatgtaaatcattattgcaagattgccattagaagattacaaaaattccactataattatcatccgagtggcatacatgcaaaattaaaaaaccagtggcatgcatgcaggtaattactatgtatacatagatttgtaaaaatattgtggaaatgatgtgaggggtaatgattggatatgtttacatgttgatttgtttaattaaatagattgtagatgatgttacatacttgcatgaggttgaatatgtaattattgctagtgggtaatgatgtggcatagttgcatgttaagatttagagttagtgggttgtaactttatagaaagtaagtatagattagctaccagtacaagatgtaatatcctcgtgataaaaaagttaaaatatgctttctttgcacgtcttctttcaacattgtacaacggcgcataaaaactatacaaagtctatttaaagtacacatgtacatcacatatcttacacaatatcgagcacacaagacttgctaaccacaaacttttccaaaatcatgtacgtaagatcattccttgtgttgcataactggaatcgcagtctcaacattcataacacaagcaatcctcttcctttcaactcgccccaatggctagcccagtaaggatcctgaaacaaattctcattgttgaccatgagatgtcccagtagatgagtaccacttctcaaccatgctgttcttcccaaaattcgtattggtttgaaactgttgcggatcataggtccaacggaggtgtttcctgttacatggcatggcctgtcaacctcaactttttcatatcataagttacatatcaccactagagaacagatctctttcgtggtaaaaaaacacaaatttctcggatctataatctttagtgattttagttatatcactactaaagatgttttttaataccggttggtaacaccaacggtactatacaatctttagtaccggttggtaataaaagatagtttttaagtcccggttcaacattgtcaaaccgtgtcaagccgcccctcaggatctttagtatcgattggtgtgactaatacttgttccagttgatgttaccaactgctactaaagattatgttgatctgtagtaccgattggtgttaccaaccagtaccaaagctcatttcccttttatatgccttcttcctcctctagctcgaaccattgttgccaagaggaggaagagaagtgctgccaaatttttttggaaagtatttggtgatattacacgaatcgaaaggatctaaaaggttagcaatttcatcctctattgatgtatggttaacatattacatttctagctatgtttctacacatttctctcacaaaaagttgtggaaaaagaggagagaataaacttttagagaaaataagagtactttagaattttagagacattggatgaaaatgttaaaaaaaaagacaacaaaggaaaattatagaaaatgaaggaataagaacagaaaactaagtccatttttttttaaaaaatagttagaaataagaatatattgaaaatatgctcagaattttaaaaaacttctaaaaatagttaaaataagtataatacatgaaaaaaaatacttacaattttataaaacttctagaatttatatataattaaccatagctctgattaagtccatttaaaactcattaaaatcactagaaataagaagaattcattgaaaatgtttttagaattttaaaaaagataatacatgaaaatgtatatttacaattatgatgttttaaattattaaatgcttatttaaccattttcaccttcgtcgacttcgtttacatggccgatgcatctacatgaaataaataaatgtaaaggaagtcgaggaaggtgaaaataatctttagtatcggttggtgacatcaatcagtactaaagtgttgatccttagtaccggttgatctttaatccctaaggatctgactcggtctgacaatgttgaaccgggactaaaaacaatgtttagtgattgtacagtactagtggtgttaccaaccggtactaaataacatatttagtatggttggtaatagatctgagaaatttgtgttttttggtaccacgacaaaagattagttctccagtagtgatagccaatacttgataattgtgacaaaaaaaagcaagaaagcaaaaatagttatcaacaatctcacacagaataaagatattgtttgacaacagcgaatagttgataattgtgaaaacaaaagcaggaaaagaaaactagttattaacaattttagtcatcaaaataattattattcacaagtagtgacggattttaccttgtgcagcaggtcatgtgcaatgtagtcccaaggaagagatactgacatcaagcaacattttagaggcagaagctcatcatcaaagcgtttgttggtagatgcagcctcgtaggcatgctttgctagttttgatgcagtagatgctgcactatggacaagggcccgaaagctatttcctggatctttctttgatctctcatggctctgatctggtagaagacaatcattcccgtgtgagagtttgatggatcaacaacttgcactagagctacagtaacccaaaaagtgaatgtgcatgtctggggtggggcagtaaggatatttggaagtagttctaatgttgtacatttgttatagaatgcaaaatgcaaactataacctagcattgcaccaaaaagtgataacttgtagagaaacaaacatttcaacaacagtataaagatacgacagtagtttaccaattaccatagcaatatatgtgtgtcattattttaactgagtcccaaatccattctattagaactactcattacagataatgcatgattgcatgtcacagcatgataattatggcactgatgatttgggactctcagactaaccataactgacctgctattccagaaacagctacttcaacttctccacgtccttcagggcccctcatataaagtttatcaagtttagtgcggtcatgcccgagtgagaataagctctcaaattttgatctgccagctataacaggatatcagaaaatgtgaaacctacaaggaatgaaatgttaggtacctacaatttttttaaacaggaaatccactagttgagcaaagggttgatgcagttaaaaccagtactatcaaacatatgattctattagatttagctatggaggaagaaatatgttgacaggaatattaatcatgtgacaatagtttctgtgcagataaagttgaaaggaagcaaatacttcagaagaccaactgaacaatagtttccttggaaatacttagatggacgaaagactaaccatcataagcttctcgaacgttttggtagctgacgtagcctgaaaagagagttctctgcaataataatcacagaagccctatgtaggtgagaaactcattaatattgtatgacattatacatcataaagttgtgttgcagaagcagatatcttctaaagcgtaactatgctttgaacaagagtgatgccagtaggcagagagaacctgtcaatagttctaaatttatattaaaataattaggagcatagtgaaagatgtgcacaactgagaaggcacgactgagcaagccctccaaagcatataaaatattattatatctataaaactagaaaaggttgaggtgccaagaaaatactactttactatggcactgataatatggggcctgaaactgttgtccttgtgaccacaataaattaccagttgccaacaaccgaagtttaacaagactcttatgggtttgaacaaatgctcacagttttaaagtagatcggttttaaatgaatgatcacagtcttaaagatatgatggatttggcactcaattactaccggaaacaagaaagtactgcagatcggtaatgtttaacaatgcataactcttttaaaaactgattaaaacttctgatcttatgtgacattatctaaaaaaatgcaagatgtgataacatatatttctaactgcagaactactcacaacaaaaaaagtgatttgaagttctttccatctgaaaatggtactacaaagaaacctgcatcgtatgtgtgtgtgtgtgtgtgtgtgtgagagagagagagagagagagagagagagagagagagaacctttggtggtttttcttgtttgctcccagtgtttaccccagatagcacatttgagctaggatttttcgattcagtgttttcaggaaatgctgccccatcatgtgcattgagaataacacagtagcaatgttcagggtctgataaaacctgctaaaatttgaatgaccacgttaatcattagggttttcctatagagtatatatatgaaaacaatgaaaacaatgcaatattaaagatacatccatatgacaacacttgttagaacgctgaacactatctcttctactagggggaattaaatgggaacttacaactgcatcaaaggtatcatcgaagtcatcaattgagaaacaaatattggggtatgcaggtaccgtttctactgcctgttcaaagaaacaagaatgtatatagaaaaaccatctcttttaacagaaaaggccagaaaaaaaatcaccttccttcgatcaagatgaaaatttacgcggctcggggatgcatacacagtttttgtgacctgttttgataagacaatgagtttgagatggaattacttaacactgagaacatgttaaactttagctagggtagatagcattgcaacaatgaaatacagaagttaagagttaaataaaatggaacaactctttcagagtcaggttcatttcaacccaaggcttggaagaataaagaaaacccagccaaatgatcacacacgaggctttctgcagtccttgagggcaggaggtaccataatcctagcagtcaaatacacaccatctaatggctggaaaggttttgtaccgcccgccacgacggcctattgagagcaggtaccaatctatttctaatggtgggagggtaacatggtaatttcgcatcaactatttctccccatccaacgacattacctccttggctctgcagctcatgcgctgtctccccgtcttccctctcctgccgaccatcgcccacctttgggacagacatggccgccgccgatgtcaggggtgccagatatggccgagggcggcggtagctgggaggcttcctcgatttcatgggcggcctaacaacgagaacgatgagcagacagtgacagcgatgacctttgcgtggcagatgtggcagtggaccggctcgacgaccttctgatgcgctaggaggagagagcagggaacgtgggggcaggtgacggcagggacctccctccaccctggtccactcccatcgccgctggttcagtactgagctgagaccccactgacctctcttcctctttattttttgtttgttgctatgaattttgttgttgggtttgctgaaccaaacgtaaatagctatatgctggaataccagattacagtggaattggcagttttatattgatgaactataaaaacaagatccagagcttggatctgctgtaaataataggatatcgattcatgagaaagtcttgttctttgagttacgcattatttttcctcatccagattcctccctctgttcagatcaaagcagcagactcaaattgggtgccatcatgtgcattccccttgcaaggcatcctccctgatcctctgatcccattcccatgtctgtcgtgagaaacggatatagatacctagcattgctatttttaacttttggccatcatcctcccagcaaatcaatggttagatttgaatggtacccgtcattaccttgtacctggtggcacctcttaaggatggtaaaatcctctaaacacacagaagcctgatccagtattgtctgtgttctggactgtttagctccaaaacaggtgaaacaaaatttaaaggagttgcaatatgcagatttgaaccagcatctttgtctttcaatgtaggaaggaatcaagtggataggaccattgttcgtaagaaacaatactaggtattagttggcaaacaactcgaatagctgttaatcttttaaaggattttctcaagacaatttaatgttaccttcatcagactgtgttcctacagaaaaacctgactagtgaaccaagaaatagccagttcactcactggcctggtttaaaactgtggataaaattatggaatgttctgaaacaatgaatatataagtagtcatgaaacaaagctcaacattaaacatcacgagtaagtggcacagaatgcttacttgtacattaccttataaactggtgataatggtttgcttttctctgcacggttgcaaagatccatgatactgtacagtagatcataagaaacacaattgttgaataataatttgctatatatatcaactaaggaggaacatatgacacaatcagaggtctcagtttgtgtgacaatggatattgttgcactccaaatatttgtgagtaccccccccccccccccccgccccaaacacccacacacacaatgatgccagtataaattaataacgaaagatatctgactagttctgtaagttagaaggtaacctagatccagttcacaactgctagagcggggaagaaacagaaaatagaagcataaaactagtacagacaacatgtggcaacagtgtcacatttgagcaaaggaaggataagaatttaagagaatatacaggcaacttttttactgacagattagaagtttagaaccattaagttgcacattagaaaggatgtgcatcactagatcaccaaataaacttttccttgttaacataaataactgaatgccaatcattcaagataaatactaggtaaattttgctacaagacatcgtgacttcacgattttagctctaggacaccgcacggaatgacttttggggtaatacactctataaatgtggtaatttgccaagggacactgcacccattaaaataataactttcgctggaaggagagagaaaaatagcgcgaaatgtcaagaatacccttggacccacatgtcagctctcccatctctcttctctctatcccccccttccttcccacgcttccctgcgccagtccgccaccactcatcgattcctcgcgctctagcccgccgccaccacctcccgccaaagctgcttgccgcctcctcacgtgcgcccgccggacatccgagcgccgcaggtggctccggatgcgcgccctaccccgccgcctccgaccgccggacagctagcgccgccactggttcagggcgcgcgcgactgccggacatccgagcaccgccgcctcctcgatgctggcaaattaatcgagattcgctatagatgtttttctctcgtggcaagaagatggataatcaaacagacctccaaaattaacagctcataggcggaccatggacacctggaccatgacgagctcccacgtgagctcgaacaccttggcggagatggcgagcgcgcccttctgcccgttctgcgtcgcctcgatgctcacctggcagtccttggtccgcgccatgaagctcaccatgccggcgatctcctctagcttggcgatgatgtcggccaccgacgcgccggacacgaagcgcatcctctcgccgcgctcctggaacagcccggacaggtcgaagctcggcgacgatgcaatgatgtcgaacgcgtttaggatcttgggccgcggcatgcgcggacactggacacagtcgtggcagtacgcctccccgacgtggcgtcccctgccggcgggcgtggtgccgaggtaggcgcacggaacacgttgttggtcaggtcggcgaagcgcgtcgccagctaccaccggtgagccgtcccgtggcgccaccttgtccgcatcgccggcaaacccatctgtggcatcgatggaggagacatcgatggaggagacagagagacaagagagatgggagagctgacatgtgggtccaggggtatttctgacatctcatgcggtttttctctccttcaaacgaaaactattattttaatgggtacggtgtctgctggcaaattaccacgtttatagagtgtattcccccaaaagccatttcgtgcagtgtcctatggctaaaaccgcgaagtcacgatgtcctgtagcaaaatttgcctaaatactaaatacaaaacatgcaggatatcttgagagatttgttgcagaaacattacctgcatattgcaactgtaacagagtatgacgtgtgagcaattaaattcaaatagaatgaacgttcccaattgacatcagctaaatttatattggtgatcttttcaagctgctccacataaaacaaaagaggccaaatagaaaatcaagacagtatgtataaatgtagtataagaaattgttgagctcatgctctagaaagtatgttatgaaccaaacactagcttatgaaagtaaatttaccaaatttaagtctgtcaaattgtggcagacaatcaagtacatgctaaagaaatgcagtataagacttgctggtgcaagtgtaaatgtgcaatgaatgataaatattattggaaagaaacatgaatgaaaaaatatgttatggttgacaatacatgatgatgtagttcatcttgatacagtttcaaacagaataactcaacagtaaattacagagaaattccaaaatagaaagaagtcttgaaattttccttctaccaaaagggacacatgcatttattgatcaagttaaacaaatagtctagcttaatttaccttaggagcccatcttcgcacaaaaaagggaggtggattttccatgttatcactggacctgtacccgttcaatttctgcaccaacatagaatattgagcttcagttagcatacaagaccacaccgtcaagctaaataaggggaatcaatagattgaaatgtaccatattattaacaaagaagacaaggtcatcctcttccctcccctttgaaaccctaccatgcacgaagaaaagatcaagtatttcatgccagaatttatcatccatttccacgtctgatgcatcagcttcagcatcaataactgtccagccgatcaaatctgaatgttttttcaccatactcagcagtttgttcctaaaaaaaagtacaggacagaaagttgagcactggttaaaggatataagttttcgcagaagatgaagatatgcttaaatagaacaaaatcaaatctcttcctatttccaatgcattaccactagggagataacttagctctgaccagcatcattgggtggtatgtgttacagtggggtatgatgttgtcctttttttttcagcggaagtcacaagaatgatcattttggtcatgttttccttagcaatgggatcaagagcgctcttcaagcatagaggacatcagcaagggttaaggttaagcatgcagacggagctgcaaatcaaaggagggtgctttgcttgttgagatagctttagttctagtgaaaatgacaactgaagtgagatgaatgatcgatagtcagcagagacaagacttccgaagctgaaactattgtttattttgtcctgggtcccccatgatctaatcacatcactgctaaacctagaaaataaggagaggctgaaaagaagccattcaacaaagaaattcaatctttacatgagatcatcttaaaatagcaacaagaggaccactgctcaaagaaaagaaaaactcccaatatgaacacaggttaacaaggttgaatggcaatcttggttccatcgtaaagactaaagagcggtgttacgatataaaatggtatcatagatagctctaaggtctcagtaaatgtaatttcactcgaatgcattgagcatcaatgagcaataacttgtgctagatttcaaaacattactttaggtaattgaaatcggaatcgctaaccatcgtttgacagatttatgagccttcaatcattcggttttttagccgtaggatggtttgtgagatccgtgcttgcatctagctgctaattaactaggtccacgttactgttccctggtgttaaactagccgtacgtgttttccaaagttaatttgtttatgatccccacacgtactaattacatcgtacttacactataattacatattaattacataggtaattttagtgtatttacgatgtaagtctgaaaattacatatgtaattttagtgtatttacgatgtaagtttgaaatctacttgagcccatttgagcccacgtgagctttagatttgtccacgtgacccgtttgtttgttttttgtattttgtttgtgtatattaatgtcatccattagatgttgatctgaagggtaagaaatctgtatgataggaggccaaaaaatatgtcacatgatgtataggcagcctcgattgaaatcgatatgtgcaactgccaagctaggaatttcacaacttttgcaacatggaagggctgcccaaagctcacagaagtgaaaaataattaaaaaaaaaagaggagaaaaatcatcctcggcggcggccgggcagccgaggggtgggcgtccagggcacctcccgcggcgtggatgcgaggtatgagccatggcgggtcctccactcctcgggaggatcagttgtggttcccaatttagggattggaggaaggggatataggtgcgtgccgtaccttgaggacgaggccccggagccgctctctacggcgacctcgacatctccggaggaggacggctggtgcggaggaggaccagccatcgagagagcggagaggaagaaggaacgggagagaagggcggcggcgatcggcggtggatggccggatgcggccgccgccggcgactctcggtggcgtttgggtgttgaatgggtttattacgggcaaagccatcgtggcaggttattctgttctactatagatggccatctgggccgcccggcacggcacggcccaagcccggccgtgcctgggccgaggcttgtcgggccggcacggcccgaccgatgcaccgggccgtgccgtgccagcccacgggcggcataaacggcccaggcacggcccaatactagtcgggccgtgccgggccggcccgaaggcacgatgggctattgtgctgactcacagaaagagtttatatttggtccctcaactctgtgggctgtgtttaaatggctggaaataagtctatttttgatccctcaactctgtgggttgtgtttaaatggctggaaaataagtctattttgggccatgccttatacggttatataagtctattttttatccctatattttttttatttgatcgggccgtgccgggccggcccaccgtgccgagggtgcagcccaggcacggcccggctatcgggccgggccggcacgggcacgaccctagtcgggccgggccgtgcttgggccgggccaaaattgcgggcttcgtgccgggccgtgggcctcgggccatatggccatctatatgttctactccctccttccaaaagtctaatacctatttcattctttagttttttcaaaaatctaaatcctatttgtagttattatatgctaaattaaattattgatagaaattaagaaaccattttaatgcttattggtaacatatttattggttttgtcacatggtgaatgaattaattacgtcatgctcttggtaaaaaaataaatagaactcagatttttggaaggagggagtatttcttcaactccaacttcaacttcaaattcctcattttccgttagcacgtttttcaagctattaaatggtacggtctttttaaaaagtttctatgtaaaagttgttttaaaaagcaaataagtccataatttaaatttataatagttaatactttattaatcatgtgctaataagatttctcatttcgcgtgcaaccaaaatttatctccatgtgtggagatcgaatgggggccttagcagacatatacgatatcaccatagacattaattatacatcacctgtattgcaaaaataaatagctgtaaatgcgattatccgtatcaaatctatgatgttaacatcggtgtgtaggttccaccacacaagaaatctaaccaattgagttacgcttacttcgcgtgacaagtggctttcggctaaatgccacttatcaaaaaggatttgataaaataccactatcaattcgggactacatgtctacatgttagaatactatctgggactaaggccctgtttagatgggactaaaacttttaagtccctatcacatcggatgtttgggtactaattataaatattaaatatagactattaataaaacccatccataatcttagactaattcgtgagacaaatctattgagcctaattaatctataattaacttatgtaatgctacagtaaacattctctaattatggattaattaggcttaaaaaatttgtctcgcgaattagctttcatttatttaattagttttataagtagtctatatttaatactttaaattagtgtctaaagaaagagactaaagttaagtcactgatctaaacaccacctaaattgcctctctactcatcttcttccttcttccggcactctgtcaacttctcgtcatgctactcactgacgtcatcatcgtctgggctgccatgtcattcaactccctctatactggctacgtcctcctcgtctagacctgtctggacctatcactgttgttcggccatcgctaaagacaaggacaacaagcagcgacacctcgcctcatacactcctcatctccaatcacaccacactggtaagaatcaaacgagtgaagggacaatttcgtcccagtagtcttaaattaagagtcaaaccgataataaccaaacgagtgaagggacaatttcttcctagtagtcttaaattgagagtggtaatttatcaaatctctttttaggattggtatttgaggaatctcttggttgaattggaatggaaaaaaggttttattagcttgtttgaattatttttattttaaatctcgcttaaataaattggtaaactggaatttttgcaatgcctaaattttggtggatggttttggtttggatccaagattttaccaattatattcacggtctattgtttgtcctagctaaaatattaagttattaacagcaccgaaatttttggtaactaaccccaaatgcatgtatcatactactccctccttaccaaattgatcatcacgtaatagaatctaaaattttccaaattaatcatcatataactgtatggacacggatttcactggaatacaattaatgcagcatgggagaatatgcgcatgctaaggtgtaattggcatggagttttattgttttaatttgatgtaaattatctatgattttagtgcataaacttaaatgatgatcaatttaataggagtaaatattatccattctgttgtctcgccatttatcgttggttgccccccaaaagttgaggatcaccgatcctactgtgctgtgcataactagcgagcggacgctccaacaacacccacgttaacactcaccacaggatgtctcgccgccgtctgcagctgctgcttctcgccgccgtcgtgctcgtccacgccgccgccgacggttgccgagtgttccagatcgaggaggccaccgtcgacgacatccagctcggcttcaacaacggcagcctcacctccaggcagctcgtgttcttctacctcgaccgcatcgcccgcctcaacccgctcctccacgccgtcatcgaggtcaaccccgacgcgctcgcgcaggcggcgcgcggcgtcgccgtcgtcgtcgtcgtcgggcagctgctgcggcgggctccacggcgtccccgtgctcctcaaggacagcatcgcgacgcgcgaccggctcaacacgacggccgggtcgctggcgctgctgggctccgtcgtcaggcgggacgccggcgtggtgcggcggctccggcgagccggcgcggtggtgctcggcaaggccaacctcgacgagtgggccaacttccgcaccatccaaggcaccggtggctggagcgctcgcggtggccaaagccgggtaaggctaagctacctcctctcactcgctaacttcgccattggtttctccatcacaaaagtcaatgctgaatatcgatctctttagttcaaaaaattagcttgtatattccatgccaagttcttggagaattcttttaggaaaataaccatcaatgcaattctgcaaattcttttgtagcttgtcgaaacataatccacactaaaatttagtgtgaattctgtaaggtcgtcactgggtttatcacttatcacctttgtatttttcagacaggaaagcatatttttgtgttgcaaaattattcaaaactcaagcaattatatatggcatatactgtacattagtaaatatttggcatgtatatgtagaatccatatgttctatcagctgctccatgcggttcaagcacaggatcagccattgcagctgcagcgaacatggcggccgtgacactagggaccgaaaccgatggatccatactctgcccatcgtcgttgaattcagtggttgggatcaaaccaacggttggattgacaagcagggctggtgttgttcctatctcccctaggcaggacactatcgggtaagctaaggcctcgattgtttcctcgttcggcagttacaaatttcttatttctgtatacccatttaccaaacagttaaatagtgtatttttttaggaaaaaaacattttatttagtaatgtttccaaagaaatcgaataaatttaatttttaagttcataattattgataatcaattaatcgtgtgcctgtcttagctcgttttacgtgtaaataaaaaataacagctacttattagaaccgagactaatacatgcattacttatttagcccgtaccgatggttgatgtttttttactgtcactatccagttgttttcttgtgattgcacgagatccaaagtacactttattttattttcttaatgtgccaattggacaattggcttagtaaactcgatactgacaagtcaatgaaggatgtttatacataacagatacttcgagtaaattacttaacaaatgccatcagaaaatatcatgtacagcaaaatgttattcgaaatgttgaaaaatacggaaaatacaactagctatgtcaatatgtttcccatcctgaggtccacatcaatctagtgagaaaatatagaaaatgacggtttacccgttatttcttccccaacatgggcatggactaaatggcacacgacataaatcaaatgaagtccaaacatttcataaaaattcagagatggacttcaaatatttacttcgaaacaattttatatgtattatattgaattagtttctatggtcatttttattaatttgcttgatattgtgatttttcctacttgttttatttttcaaaatacaaaaaaaaatctgggaagctgatctaaataagtcgtcagatttttggatgctatacttatactgtaaaggcctgctaaggttaaaaaaattaagaaaagaaaaaaaaagaagggcatgattaatatgaaacttttataatcttccgatggaaaatgtgatggcaatagaaattggatgattcgttgttaacacaaaaattttttcgcatgaatccttatttcccctagttatgtaggcagtgtcattttttctataatataatatagagtaaagtccatcaccggtccctaaacttaccgctgtgtcatcccggtccctaaactcgcaaatcgaccgttcaggtcctcaaacttgtttgactgtgtcatttcggtccctaaacttgcagatcactcgtttaggtcctccaacttgttcagttgtgtcaccctggtccctgaacttgtatttgaatatcatctgggtcaaataggacggtctaaagactttatatttaaaaataattcataactttttcctgtgaactctaataaagacaaactttatatcaaacatgtagccctcgacgcgatctacaactttgtagttgaatttttttattttaagtcattttttgtcccaaaatgtaattttaaaattaaaatttcaaaatctataaacatgcaacaatattttgggaccctaaacagttttaattcaaa

SEQ ID NO: 69054 - DNA, 10085 bp, Oryza sativa
  unsure (1)..(10085): unsure at all n locations
ctgcagcccatactgcttggaattttgctagttgttttgctgactttatcggcccttttagtactgattgtctggagaaagaaatttagaggtcaagcggcatatagacctgtggattcagcagttcctgagcaagagctccaaccgctataatttggagtggttcaacggagtaaacatataggcgattctttggtagaaataccgttgtgcgggctgccatgttgcagcgggttcacatccgctgctgggagttgccctttttctttgtatgtaacacaagctacaagcttacagaagaagcacaagattacataacttctcgattcagcacttagagcctctgttcataaactgtctagcgattcagatcaagagcttcctcttgtagcttacagtagaagaaggttttgttcgtgtaatgtagattaagtagaatagagcaaggcacaaaagcacagcagccatggacggaatgttgtattatctagtatctgataagtgctgaggatattcggcttctacagtgttttcacgtttcatttccatgctccttggtaaaaacgtgttctaacttttgttctagctcataactggcaaagagcttttgctttatacccatagaatgcagaaattattattgatctgttgctggaggcatttgcagcccaacatctctggctcgtcaacgtggaacccgcatgtccatcggcttcccgaccgtgaacccgccgtcgatgacgtggttctgcccggtgacgaacttggcctcgtcggacgccaggtagacggccgccctcgccacgtcctccagctccagcaccgcgccatggagctcgctcatccccctctccaccatctccttcagctgctcgtcgctgacccccgggttcatcctcgccagcgaccggaccagcagcggcgtcgcgatggcgtgcggcgagatggcgttcacgcgcacgccggagcgcgccagctcggccgccgccagccgcaccacgcccaccaccgccgccttcgagaggctgtacggcagcgccgcgagcccgccgagcatgcccgtggtgctccccgtgcagaggacgcagccgccgcgccggggcaccatgacgcgcgcggcgtgcttgacggccgccaccgcggaccgcgcgttggccgccatgacgcggtcgaagtccgcgaggtcgagcgacgcgagcggcgcgggcgccgaggagcccgagatgccggcgttgctgtagaggatgtcgaggcggccgtgccgcgccacggcgaggtccaccgccgcggcgatctgcgcctcgtcggtgacgtcgcagcgggtgtacgcggcgtccgggcccagctcggccgcgacggcgcggccgaggtcgtcctgtatatcggccaggatgaccttggcgccgttgcggatgaactcggcggccgtcgccttgccgatgccgctggccgcgccggtgatcaccgcgaccttgccgggtaacctctggcaactcgaggcagtcgagaagtggctgcccaaaccacacagagctcccatagctccgctcttctccctcctgcattgatccatccacatgaccatacatcgaacaagcagcaagggaaactgatcagcttcttgttctttccaagaaacaatcagattcatcgcacgcaggcatcagaagaacgtgctccgtacaagaaacaatctccatggaagctgaacaaggtagaaaatgatatttgataaaaaacaggagagtagaaaatgatcagaaatgagagacctgacaacgagttgcgttgctctcaacatccttcacccacagtgctcttcagtgttcaccttgagaaaacttcagtttctgtggtgcttgcgaccgagctaggtgatgaaatgcaggttgtagtagatcttggcacggttggatcactactgatggatcttggcatatatcggaacgttttcttgtcgacaaaaaaatgctcgtgaaacacctgtatttgaagtccaaaacggagcctagctgctacacgtcagtacaccattgtcagctttcgtctgaactgatgcggcacgtgtaccccacattctatccgatgagatggtggcacgccacctatggcgcgtcgtcgtctgcgctgcttgaggtgtgatcaaattcatttacacacaaacaaaatcagcttctgccggaacgagtcgtcgaaggtttggatcggagctaatcgttattcttttagaatttcaccttcatatatacctcatgtaagctgttgttcggtgttggaaccttgtggagatattttattggttggtggccgtggttttttctcttctgctttgaagagtttttcacgttaaatcttgtgtcttctgtcatttattgttttttatcgtttgtttgactattattttctaacatcggaaactgcttgctccaaattccaaactgtttgtgtacaatttcaggcagtggttgggttgggcgtcgaattggacagcgtccagattggtccagtttgtggaggtggatctgacgaatggttcccgtgggtggtcaacgcaagttttcgtcgcgagacaaatgatcatttttcaagcaatcagctagcattggttcatctgactagctagtcttaagttccgtaattttcattttaatcgcactaactgcgagcagtactccattgaaccagtagaaacttggatgaagcaagttctccaaaagaaaagcatactcgagcccagggcgaagctagaaggaaatagatggtggtgtcacttgtttaatttactctactttagatcaagtttaagctgatgcggatgcctaagtttgtatttagagggtacatacatgatgaaaatagatgaggtatagctaaaaaattttcttgaccaggtttctgggcacccccctaatatatactagctccgcccctgctcgagccagatgatccaggtctggtttagttcccaactttttctttaaacctccaagttttccatcacatcagaactttaattttctatatacataaacttctaacttttccgttacatcgttccaatctcaataaaactttcaattttagcgtgaactaaacacaccctcattctcaattctgttgcttaaaaaaaataatcaaaagtaacttgtgtgtttagttttcaacgcctaaanaaaatttttggggggggcgatttggtgaattgaacgattaatggaaaaattagaaatttgtgttgtaggaaagttttgatgtgataaaaaagttgaaagtttgaagaaaaaatttggaactaaactcggcctagatatcagagcgatatcagagcatactctggacaaagcacaagacatatcttagacagacattcttgttttattccactaagcactaacacttctcaaagaaccgagatcgatcccaacgctatcaatcacactactaccacggatcggctacacatcgtcacagtgccagccatctctcgttgctcacgggcacttgggccgtcggctcttgggggagaccatgtcgcggtagcaggggcactcgtccttgctggcgtacggccccgacggcacgcagccgccgcagtcgtggcagcacatcttgcacagccccatgcaccgcccggccaccttcagcgagcaccgcttctggcacttggcgtcgcacacgctatccgggaccggaaccacgccgccgccgccgtctgcatccatccgcgaaatgttaacaattttagtactcatctcctgccaagatcgctggagatcagtgtgtgtgtgtgagtgaattggatggcaagtttacctgcagcgacggtgagatcctggaacgaggcggcgaccaggagggtggccaggagagccgtggtggcacgaagaggaggaaccctcatcttctcttgatccttttgagctctaacaaacacggtgaggagatgagtgttcaaagcaactgcagcactgctactacactggtgcagtgaatgggctgcagagagttgagagagatgaatgggtgtgatttatggctggtttcaaggaaggttctagctggctggtgaattcattcatcaatagtttcaattcaattcaattcaatggacacacctgccccagtagcttctttggtgtgtgagcaagtgagtgggggaatctcgcagggggagggacggccatgaatcatgaatgccatggcggacaggtggccttgtcgctatgccgcagtgttcacgcgcatcaccggcttgctttcccttttgtcggcctcgtacatgcatagtataccatgggcggttacttgcttttggatcttgtgcttatcagcgtgtgtgtgcccaatggtctatgcaatggactgtaacacagtaacacactactaatactcacgtgcaatgcacgttttttgacaaaatatatcgcccgagtacataattgcactaaaaattttagaaactacaccttctgaagcacaacctatttacccaaaatttataaaacatatcctcatgtaattggaatttgtaacaataaaaataaccattatcagtacatagttatttttagctaaatcaaaaatgcaaaaaaaaaggtatcaaagcaagatattgacttgtcattctcttaacagtcatcaatataaccactctcaggcatactaccagtatgcggaccaaaaccaaataagtaagatcatatagaccttgaaatggggaaacaaaaatattatatatactttggatttatttatgtggttatacgtcaataatatgtcctaacaaattcagatttgaattaagagcacagtcgtggcttcttgttgtgcatagtagaattcgtggcttcttgttgtgcatagtagaatttaatgggcaaatgtgtaatcagattttagatggataggtagtgagctgtccttgtgagactgagcaacaaaattatcccttgtatatgagccacaactatagaaacttcgaaaagataaattactgagtgctaagaagcctgcacaaacaattaattatgcacaaacaagaaggaattatccatgttttatttggcattgcatgtctgcaccagcataaaactatcactgatccttttcacttgttagtcatgatccagcattccagctgctaaggacttacaattagctgataagagaacgtaacaaagccatactattggatcacacgttcaacacataacccgtgttaaccaaacaaatcaagattggctcacttctatgaaaacattatattaacgtaaattatttcaaccaaaaagaaggaatagaaacaaccagtaatctctttaatgcatagtagacaacatcagatgccatggtgtcctcctgatggatttgcttcgacagcctacacgtttttcatgcattttttgtaacctgaaaagaaaagttagataagtttgctagatatgaaaaagtgatataaattgtgatagttaatctacatgttgactaagtttgctaaacatttcagaatctagaacacaccatgtatatttaaggtaacatagttgattaactatagaacatctacaaatagtgcaattcatgcaatagtgttctatgtaaaaatatatggaacatgatcctgacctcagattgtaagtccagaacctctatgctcttactcattgcaagtgcaagcagctaaccaacatattgccgttttttgctttgagtatcttgtaatgaacgtgtgatacaatgcaattaactgctgcaagttggaagtcatgatccaattttaaagaactgcaattgattgataaaatatgtgacaaacggaatacagaacaaatattgaggtgtaaaaaccaatttgagaagtagaccattagcaatatatggatttgagatctatcagacaaatatgaatgtggtacatgttcttattcagtttattacgactttgcaaatgaagggaaatatggtgtgtattacctgtctttgcatacgattatgatgtagagcatcctccgttgtctattgaagtaggccgaggcaagcagatgattgactcgaatacttctagccacacaagtcaaatagctcccacctgacaatatcggtggattatttggagcaacaaataacatcagttctaaaacctgaaaccaaaataaaaaaattctgctactgctgctaacatgtggcatttagtcaaaataaaaagattagccactaagtgtgattggaattttggtactacaaaatcaaacaatgattctttgacaacttattgcttgtattattaagaacctttgataccatcaattttcaatctgctgcagctcctgctacagtatgcaacaaagtttctccaagccaagagtttcagcctagtagaaatcatacatatatatcaatctgaccaggaaaacacatttttttattactgaaatgatttgccaggttggccaaaggattaggcccaccaaatttattaagatttagggagaaacaaagtacaaagtactatgctgtcgaacaaaggtatgaggcaaagcctcagaccacaataaacaactaacactaataaataatcactgcaggataaaaaatgctagccgacttccaaatcgtgatctccttgatgtctccaaataattgctctgtaggtctagacctctgctcaaataccctagcgttctgtctttccagattaaccaacagatcatcatgaacagaaagaatcgaaattatgcagttcaccatataaacatttggtctttgccatgaagaagaggttgtaagccgatgagaaagtaaactggccatcacctgttagctaccaccgaatggagtcgtggctattcctggttgaagctacaccatctgaatttcatcccacaactgaaagaactcaaccattgctctgttggacaaggaactctacaggtctctcacccatcagtgattcaccaaagcctgtgccagcatcaacttggatctgcctacatatgatagaaattagtgttagtgccattgccacgtgctgcaccgtggttggaaaaattgcttgacctttctattccaagcttggcatgccattttagccatagtgcttggccaaagaagtctaaatccagagttgatctgctatagagtgagcaataattaattgagcaagaaagagcctgcatagaatctactacagagttcatcagtgtatgcaaagaaattaacttctcagaaaactactgattgtggtgaaaggataacaataggattgtatccacttgaactgatagctagatcgaatagtgtaaatcaagccatagtgaaagaaaatgatgtacattcagattcagataatccacatagaggactattgggctgaagaagggaatcggaagactcactttcagctgaagcactctacactctgcactctcacctgcaaaagagaggatggcacacgtccgtgagaaccgagtgcgtggtgtgggcagactatgaaccttacaacggcggcaccactggaggcgcggcagagtgccgttggaaggcaggaccacagggccgtgacgggatggtgatacgagccgaaaggcatattcacgggggagtcgactgtgtgcggcagcggagacaggcttcatgacatacagatccacggcgccggcgagggcagggcgcggtggtgtgtggcggcggtagggaggagcggagcgaggagcgcgcggcggagtcagctccgttgggggcaggccacgatggagtgtgtcagcggcggggaggcgcggagcacgctggagtcagtggagcacgctggagcgtcgtgtagtcatcacgcgggggatggggccgaggtcggctccggtcgcggcggtggacctcagcgccggtgccggcggatggggccgaggtcagaaccggccgcggcggctccggctgcagggaagaagcagcggctctggcggtggggatgcggcggcagtccacacggggaagaatcagaggctccggcggcggcagtccatgcggggaggatatccagcgaggatgcggcggcgcagcggcagaacatccggggaggaggaggagctagcgaggaggaagagaagcgaagtcttcgcgtgtggagcgatgtcttcgcgagtggaggaggagtgaagtattcggcgtggcgtggatggatggatcatgcggtggtgaaatcaagcgcgcagatggacggtagagatcgattcgagtgatttggcctgtaggattggagggggacaactgcttctttttatattagtactagtgatcgtgcacgtgcaatgcacttatgatcaatatttgattgaaccatctacctacattgatgtgtagaatgtttaaaatgttttatgtctagttgcacacagttaatcaatgttttatgtctagttgcacacaatgttttaaaatgtttaaaatgttttattgaatcttgaacaacccaattaatcaactttgtataaataatattgtaactccatagtattacaaataagcaagtgctaactgctaaggatctaacaataagaaacaaaaactctaaatggtcatctcttaattcgtatgatccttgttttcaaccattttttatgaacatgaaaaatcctagaacaatactacatgagcaaccaaaactccatttagtgtccatagttctcacaagctccatttatcctttaaggagtgtatgcctgccattctgtcccaaaggaggcttaccttgctccaaaacagatttggtccaccaaattatagttttcacagcgttcagtgtcactgacttcaaataatagagcttcttctccttaatctctagtgatggacgacaacttgcctctcgatcactactattgttagtggacgctaccaattggacaataggactcccaatatcacttctgtcaagagtaccgatccaaccagtttattgcataaaccaacttcaaataccagaaatataatgaatattttcatgattagtttgatccggcacctcaaaaacttccttcataatctacagttaatttccatagtttagttatgagccttcatgttgtctatatcggggatggagattaaatttaagtcatctacattagaagctatgaaatttgataaaaaaaattaggattcctaaggatgatggtaactaaacttattcaagataaggtggcaactggagatttgattataaaatttatattcttgacgaaagctatatataacttaaaccaggtcacaaaaaatgattctttattagcaaaaaatctactcaataagacattagacatactttggcattccaaaatacttagtagtttcttccagattgctacatttatagctaataaggaagacataattcaatacaaatactgagagtgcacaaagtgaactggagaagtaaaatatcatctggtatgaaaacagagttcacattattccagtgctaaaaaatagttcacgcattgtgtgaaaaccataaggaaaagcatttagcaaagttgacaggaaaaaatgttttccccaaacaaaacagtatcaattggggatttaaatccaaagcgtgatcatttacttcgcttcagttattcactttgtttattaaactaatatgcatgaatcaatttcactctgtttgttaaactaatataaaggagtcaccttgcatattattattccttcaagcctcattactcctcattcctttctgttgactcttctcactgcatatgcacctgatctcccttgcacatgtaaaataaattgaccgagccaagtatcaatagcatgaatccaacaaattcttgctatagagctgtatataccgttttccacggctatggtgcaccatatattcagatggaaactaagatctgaactaaattaaaaaagtgtgaacttgcctgtgaacaaattgtacaggcacaatttaaatactttggaaacagaattgtgcaaaaggaaaaatataataacctctccattatggacacctgctctgcaacgggtaattgtctaaccagacagtaaatgcaaaaattggctgagaacatacaaatagt

SEQ ID NO: 69055 - DNA, 1992 bp, Oryza sativa
cttagttttctttaaacgaggtcgctaactgccgtgtacggatgtcacactctgttgaattttgatatgttggaaaagataattcagcatcttcttgggagtgaaaaaacaaagatgaaattccgctataatttggcaccttcttgagagtaaaaaaaaataaagatgaaattccgcatagcaatttacgggaaagcaaaatcatgttacatattgatttgtgcatcatggagtcatttgaagtagccagtagccaagtattagttttttcagattatttaccggattagtgaaacgaattatttgctccacactttataaaatagattttattttttaaaatatatctactatatttcttaaacaatttattttaagttatttcgtaagtttatttattaaattatttaatttgtttctataatttattaaataattcacagcaacaacccgctcaattatctgtctcaaactgaccgctcagatcaaaaatagggagaaagtgagtgctaattttggctattgcatggtgcctttctttgccacattttgcagggtacattggagattaagtagttgcattgacttgcacactttatgaagatttgtatcttagtacactttgcagattgcatgtgtcttccttgctatcatagtttgagtatttcttcatatggttgagcattgatagtgatagagttataactcatgaaactgaatttggagctattattatgtacagtagcctttctttatttggtttggtggcttattgcaatttatcgtttcctcacttttgtacgcaagcaccacattatatcgctacatacaaactatacatcaccttatgatgaggacactaaagtaaggatacttaatacaaaatgttttgtagtctattcaaaccaatgctattattgcacatttattttccaactggcctctatgtttttttttttatgtcgaagatttaactcctacgaaataagtgcaacactttcatatacaattatatatatattttttaaaaaatacaatggtatgactctcaacatacggttaaaaaaaagtggcttatgccatattgagatagtcgaccacatgtataaagtgttagaaactaactccatgaattttttttccctcatgtagtagggcttaggactgaatttacatgtacttggactaaatttgaactgtttgtcaaaatttgttaaattttcaccagtaatcagccgtatccaaacggtttacgtaaaaacttgaacgacctgtttggttggaaggagttggtgatggggaatgggagtttacgatacttgggagtttaagtctgtagtttggttggaagacttggaattcgaggggtttgggatagggaatttaggggtttaattcccaccaagacatgttaattcgtgagactggaagaggtttttccgaccggctgttgggttatgtttaaagctgtaaactctcttgtgtatagagaggagtccatggatgacaaagaggttaaaaccgggtcgcgccaccacatgagcccccaccgtgacaggctgcaggtccagcagcaacactgcacagtcacagtcactgtcctctcctccactccactcctcttctctcctcgcagcctcgcagtgtggaggaggagtagagcttcacgtgaagcgaaatcccccctcgctttgcttgcttccttccctcgctggctggctactggctactggcttctctccagtaaatctgagcagagctgcatttaatgcccccctcctcctttggtctctcctcttctcttcttccttcccttttttttttctcttcccctcctctcgtagcccacgacggatgcggttgcgggtagcaggggatggagggcagatgaaacccgcgagttcttgattcttgggagaatcaccccgtgctcctcctcgcattgatcgcgagaaaagttgttcttttcttggtttcttcgttctgtttggg

SEQ ID NO: 69056 - DNA, 2850 bp, Oryza sativa
gcctcccctcccgcccctgcacagagaaagagaggagagatagagaagaaatggaagagatagaggagaagtggaggagagggagccagccttatctcctcctgtgggccccgcaagtgtatgattcggatatatatatatatatatatatatatatatatatatatatatatatatatatatatatatatagtggcagaagtcatctcaaacaggctaggacttcaagccgtttgaggtgagtaaacctcacctctgacgggccgtccagctgcgacccgtcacaggtaactagtcacctgtgacggtcatcagtgaccatttcgtttatccgtcacaggtatcccgtcagagatatgagaatctggtgtagtgaatgatagttttcctatcccttctttctatacagttaaggccaaaagctcaaacctcgtgcttccacgtcatcatcaaattatgaaccgttgaatgaatgcattagattgcttctcagacgttggatgaaatgcaacatagaacccaacccattagtcaccaggtgagtctcttcgcctcctcagtatcaaatgtagcacatatgaacacattggcccctctctatacacatttacatgtatccaacccgtcaatccgtataaaagagctttacggctgaacgctccttcagttgacatgtgctacctaaattatctacaaattttagatagggctgctaaaaagaatttctccaagaaatctatttgtttcttctgtttcttcttaagattgtacttcctatctaacaaattgatgttaaccaagtcctgcagcaacgcacggggtatcctctagtttttttaatcactgtttccctgttcagtcacgatattggattttggccccccacgtaaaacattattttattgatacctgtgttgctcgcgcgtgaaaaactgtgctttattctctttccttatttctcttatttctctctcttccacctaggaattaaatgacgtggcatattttggagcctgccgagtcatccatcctattgtaactgctcttaggatttaaatcttgatattattgaatgtagatttagtggacttcaacaaaataattagtgggatcagatatacgctactggtttcactctatttgaaagtgggttaagggacacacttaggtgtgtgagcgtggcgtgcctgtgtggtgatgtgtgcgatgatgataataataataataataataataataataataataataataataataataataataataataataataataataataatagcacatgtgaatgcatgcatggtggtggtgtgcgtgtgcgtcatctgtgtataaaaaatatataataataataataataatacttatatagcacgtgataaaaaacaatctatctgttttaaaatataataatctagatttatatcactgattagtactctgaatcttaatcttgacagactcaagatatatatatggttttaatttatttaaatttgtattataatgttgttatattttagaacagagagagtataatatactatacattcttgaaatgaccttcacaatcccatcatctcttgaagcttttaccacgaaacttgattgacatggtatgtttcatggaaatacatccaacctgtggaactaggtgaagattgaagagcgaaaaatttcgtagtgttcgtaacctgaaactgagtacccccgtatgccacatgtcggaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgcatgtatatgctagttatatgtgatacttataatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatatttcatatgctacttatatatgactattcgaatttttaaaaggtttaaatcatgcatgtggcatttacatatgttaattagagtttttagcatttaatttaatataattcctacactaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatacgtaagcgaaaatcatatgcagtgctataatctttagtcccggttcttaaccctaaccgggtttaaaaagaatttcgaaatagcgggaaaagatatttacttccggttggtaataccaaccgggactaaagatcatctttagtcccggttgttctcaacaaccgggagtaaatatct

SEQ ID NO: 69057 - DNA, 7892 bp, Oryza sativa
aagaggaatgcatgctattaacccacattccttctggccttgattatttgttgcattattttgtcagggaaaaaaggctgatgcactgattaaatatttcggcgaagatcctgtacgctgcccttttgagcaaggtaagaatttttatgatcaatgtgacttatttctaaggttgtgcattcagcattttctttttccgagtacctgtcaaggatcaagatactgtcagtcgtgtgagcaccccccactataagcacaaacacattatcatgaaaatcattcttatttaaaatatttcaacccataaatatgtaataccttgcaaagaaacaatttaggataaatcattttctgtagtttgcagctgattgagcatatcttatttctgcattttttatcatcaacatatgtgtttgcttgttttggtatgttgcttaactcttatgttgatcatgatgttgcagttatctccaccctcttaacatttgtaacaatgtttcggaaagcacatgaagagaaccgcaagcaagctgagctcgataagaaaagggctgaaaaagaggcagaagcagaaaagtctaaagcacagttggctagtaaaaatgtattgatccttgacctgtatctttggcaacttcagccaacctcttatatccatcgtatttataaaattcaaaatctgctcacaggactctaaaccatcaaatccaagccggcaagtgaaacaaacgccagatactaaaacaagagctgcaagcagacgaggaaaagatgtaggttgatctccacgaccaactctgttgttgcgcttatgatctgcatgctgggcgaatgcatgacctgctcgatgcacggggagggcaagaaaagttgtgtaaatgatgcagccatcaatggaaacagcatggctgcaccatagcaactgtacatgacgccctttacggtaatgccacatgtgtctgttgcttaacaatacattgataaatgaatcgtataattttctgacaagtttttttttttcttattgcagttcgcactagcgatggccggttttttctcttcggccagcagggccgcccagtggcaacttctgactgctgtaaagaactaacactaacagcaaagctaacatcattcgttttttcctttgttttttatgttacttgtccattctttctaaccccagtggccaagtgcagccaatgcttcaggagtagagcctcgtagtatcgtagtaggtaggtagaaattgtacaaataggaacagggaaagggtagggaaaccatgtggggcggagaaattgtagctgggatctatacgagatgtaaacatgcgtgtgcttcacgaatatttttttttgtagtgaatgtaccaaggttttcataattagtgaatgcagcagcttttccatgatcatagccttgtgtcgttgagttgtgactcgatgagctaaatttcacccttgctggcgcagtcacctcatctgtgctgcattagcttccctaattactgtgggcttgtttggcacagctctagctccacccctcatagagctcagctaaacagtttcagctccaccaaaactaagagtggagttgggtggagctttcttacaaaatgtattagagttgtggagctaggtttaggcagctctacaactccattccagactcaactccagttatatttaggcagctctacagctgggtttaggctggaagtagcatccccccaccaccgcgccttgcagcagctgcgggatgaagaaggcctggaacaaccgcatcgtcggtcgcaccctaatgaacatctcgcacaaatgcgcgaagatggccagcgtcatcacggcattgggtgcgagatgcaaggcatgaatttcgtagaaatccagaacctcatggaaaaatctggagaacggtggaatcaagcccgtcatggcgaaggacaagaggtgcacggatcgctccggatatcacggccgcggccgcgactctcccgcccgcatgacggcaccgtccgacatgatcttgcggggaaggctaaggtgcctgtctgttgtgatgcgggaggaagggagcactgcgtcaccggtgtcttgggccatggcaaccggcggagaggtggcggagagcatggggcgcgagacggaatggggtggcgagaatgttagggttcgagaagcgaaaggacgagtgggcggttggcgaagggaagggggcagagtctccgcctccgcccccttttatcctcgcctcatccgcgctcgcctcctcgtttcgcgctcccatacttgcccccacgattctcacgcccgcatttgtctcttcgcatcctgcgcccactcatcacatcgcctgttgtatccgctcccgcctttagtgcgtctgttagtggcacactcgaggtggagtgcgcaatggccatgagcgcaggttgagcaaaccgtcaccactaccgccgcaggagtagcgagcgagagaatcgaggcgtggtctgactgaccccccccggttatcgcgcctcaagcatcttcatcatgagggcggtcagtggcggtcaaaccgttgttatggttggcacgccaacctggccacgcggccatatccttttggattccctgccgggcccacaaccccagcttgagaagttgtgaggcgccatgtcagaacgatctcaggaaatcgatatccgatatagcgccgggggctactgtcggagatatggactcgggggtatgtgaagtagaggggaattactttccctccggccacgtgactctgcaagttagccccattcacgcttcacgtgagtcatggaagcggcggggggagggggggagggagggcctcggggcatggcgtcaccccctcggctatcccgcggcttcgccccgaggccctcacccggctgccacgcggcggagggagagagcgagaggggagcacaggctgaacagccataaatgtgcgacgccccaactgtctctcaccgcatttaatgcggtaagggcagacgtgcggcgcgcctagctaacctctgtccaacggatgtgaccggtctgtgaccggcctgtcaccgtcacatccgatggatagggcaaccatgtcctcacgtcccccttgttcccggtggagtgggggtgggtatgacccgtcacgtccgagcgtcactcgaggaagggctgtcgcaagtcatcgttcatttatgagggaatgacagggctgtcccccgtgtcaggcggggggcggcgtcgggttccactcgagaaccggttgttgcttagcttccgggagaaggcacggtttaaagcccaggaaaagtggagtaggatccccctccgagagagggtaggtagaggcggcgcatgtggtatccccttgagctataaaaggaggaccctgcccactgagacaaggggacgacgcccagaaaacctgaactccagaagagaggaagcgagcgcgctttctagagtgaagaaacctttgtaaaactcatccataatcccaaatacaggagtagggtgttacgctccatagcggctcgaacctgtataatccgactgcgtgcaagcttgccggtaatcttagggacgagcgagtgatttccgagagacgagcctccgcccccggccgaactcacaaatggggggtctcacgattccccgctattgaggatcttccctcgacagattcttaacatgatcttcaagctcttggaaattttcctttgtgtctatcttacttctaaatcatatgttttctttgtgctccatccaaacagtttcttgtgttttcatttcttaggattcgaggtgtgataacatttgaatcatgcgtatttcctatttgtgtgttttgagaattctgagttcgaaaggaactctaaataataattactaccgccttccaaaatacaagagattttgctcatgtaattatataggcaaaatccttaatattctcggacataggtagtatttacaaacagagcaatggtaatggtgcattaaactgtcagacaaacaaccatgtagaaatgaacaatacgcattagtacaacaagaagtggcgtgagagaagcaggggagctcatgctgaccagtgtggattgtctacagtattactgatgcagtagcagacattgacgtgtagccgggacctatatatcagccactgctactgcatcagccgtactgcagagtatatgtatctcgtgctgaccttcttcgccactggtgagggtttaccttacggcgcggttaccgggcttatcgcggggtacggtaatataaataccgcggtaacctccttaaattcaaataaatttaaaaataatttaaatttttgataaattttacatggttttatacggtttttcgcggttaccacggttactgcacggtaaccgtgcttaccgccggggcgcggtaaccccggccccggcggtttgggaaacctggacaggctgcagcaatgggaggacgatgcctgcaatcagaataacttgatgatcctattactgaaaactttatcggtaggtcggctcgccaccacttctagcgatcgtacaaggtccgtcttaagtacttattttgtagccacttttaaccctattaaaatttggtaatgccaaattttgacacattttagggttggtagcattgtatatgtctggtttgaagccttactaaattttggtagattttttaagtgtgaaaacttttaaaatcatcaaattttggtagggttggtaaaatatatgttcagtttgttagggttgtaagcggcaacaaaatgaataggcactttattaataaagagaaaatggcatatctaccatggcataagaggggattccctcaaataccatcgtttaattgcgcttcgctagaataccatcgtcaactaattcaccttagccaaaataccatcatggatagaaatacccttacctttacctcttccaactccggaacaagaaaacggcggcggcggcgtcaaggcgcggcgagcaactccggcagcgccgccacgtgagcacgcgggggaggatgaagtgaaggtgcaggcactcgtcagcgtggtcccagggcgacgaggacatccgcaccacctcccatctccagcaagctcgtcctaccacgatccccgccatccgctcgctccgcgcggcgacggtggtcgtgtctatgcctgcccacgccgtccatggccgtcgtcgctcacgtcgtctcggtcgccggtagctcgcgtcgggagagggggtagcacccaggatccgtctcgcgttgacgtcgcttgcgtcatctcgaccgccagcccaccccgactcactgccgacgatgatctcgccccgattcctcacctccgctggcgcgccggtgaaaccggcgatggccgccggcaaattcttcaagcacggaacgaaggaggaagaagaaattggggcatttttgtccggaatgctattttggcaaagatatcctgttaggggtggtattctagcgaagctcatctaagtgatggtagttgagcgaatcccctcttatgcgatggtagatatgcaattttctcgttaataaaagggttctttcagaaatgtgcaccatgttctcattgctccatctgagccgcctatgcgtgatccactgatcagggtgctgagttgctgacaaccgaggtgggaaccaggtactgagctgcacacgaacgacaataagatatagtaggagggccttttcgtaaaaagttagaagtagaaaaatttggaaatatacttttttttttaatattttacgtttatacagaaaaagatttacacaaatatacctccaccacataacaggggtatatgggaccgccttgggactgtttcggcccacgtgccacctcggtgccgctctctgggctgtaagagcgaggcggtgccgcacgtccatcctgcgtgaccgctggtcccgcggaatggaagtgtggtcccgcgcccccgttatagggtggaggtagttatgccaatctttttcacacatgtatataaacctaaatatatttttcgggattctccggcgtcctccccggccatgcggccaccatagccacccgctgcggcggcgacggagcattccggtgagccgcgccgacctcgcccgcatgcgccgccgcatcggcgacgacccacgccacccacctccaggtaattccacccgcattttacgattccccagatcgggctagggctagtgtatactactagtactactgaattaccgatcgctgatgattcgatgaactgcttgcgttaaacctaatctagattccattctcttaaatccccaaacaaagcgcggattagcggaagcggtagaaaggcgtcctcgggagatgagacgaacggccggtgtcagaacgggtccatggcggcatctgcattgctgctcatctccccctccactgaaacaagccgcaagaggacaatggatttaggtgaacccgtcatgcagacttgcagaggcaggtaggtcacaggtgagtacactccattgtctggggtaaatcggccaagcaaaccaatcagcaatgtagtatcagttattacattgttcccaattgccaaatcaaagtccaaccacatgtgctcaactctccattgaaaatctgaaatccatccaaacaaaagtaaaccaaaccaaagaagttgctcgccataaaaagtcacgagccaactttttttttaagctctttggatggatgtcacacagtggctgtctcacaacacaagtgatcactcacaaaggtttggtactatcttaccaaatgccaagccctaaagacaggtaaagaactgaagataccaggggggcagtaaagaacagagactagatgttgataatacatgtggccatgatacactatttccagttaattaatatggttaggttgatgcccagcctactagtgggaatgtggcattttgcttcagtttatcaggacactacaacagtagcacttttgtggataggatatgtgaggcacttcacatttttttctcttcctcctcaaatgattgagaggagtaggttgatattaaattgccacatgacacaagattcccaattgattaacggcaagggccctttgcaatagtatttatcaataactaatttaccttttcctttcacaatcaagtaggccctgcttgctgtatatgtttccaacctgtttggcttagctaagatcagtatgcttgcattgcattttctatttttccttcttgccatttctgatcctcaccatttctgcacggttgattgtgtcccctgaagcaaaagctgttcatcaatttcttgaagcaatgcaattgtatctcgtgctcgtgcagttcatggtcaggtccacaacttcacatgcgtggatgcttaatgctttgtgtgcacaacaaagtactagtagtatgttgttgattgaggatgcacgattcacgaggtacacaaaaagttatactactactccctctgtcatgtaatataagagattttggtgggatttaacatattctaatactataaatctggagtacattgtatgagcaatcatagcgaggatgattctttgcttaaggatcattcaactggttatggtgacttcatcatggggctatttgcatcctggctaaaagggcaggcaaaatgagtagctgaaatgaggcgatccatatgtaatgtcacgcgcagttttccaaagttttcctttgtaaattcagagttgattagcactgtttttcctctgtccttgtgatcattttggttcattatggttctaatcatgtaatcttgacattttgcaggagcattccttttatcacaattcacaagctcagattgcccccacaa

SEQ ID NO: 69058 - DNA, 7303 bp, Oryza sativa
aggaggtggtggagggggtggaggaggagggacaaaagttcgtgtttgtgctccaaaagacataagtggaggtggagggggaggaggaggaatgcttgacaagcctgatgaagctggaggaggtggcggtggcggcagtggtggtggtggtggcggcggcggtggctgctgctttgtagctgatcccatgtgcattgataaggaacttgaagaagcatagggtggaggtggtggaggtggaggtggaggtgcagcttgaatttttggcacagcttgtgcacctgatgatacaagaggtgcatctttgccaacattgaatttgttatttgtatgcatggaatggatagctagtgcagctggagaactatcatatctagatggaggatgagatggcctatgcacagaggtagtttcagattctttattgggtgaaatccatctgcgtactgtcttaggtttgactgcctttggttgttcttgcgattggtcactattgcctagcttttcttccaataaaactgcctcaggtgcatggtctactggcatcttctttgagggcacaactttatcaggtatttgccttctgtcactgcttatccgtgggctcttagccctagcttctattttactttgaggaagagatatgccaacatcccgtctgccaccagactcttctctcttggttttgatttttgttgctatttcagtggctgtaggacaacaatgctaccctgcacagtggttttctttagagatatggcatcttcaagcccagatttcaatttagtttgctccattttgctatcagttgtatcagcagctttagcgacctccatcttgtatttttgttatcttgtgagtccacactctcgataacagatctatctaatttaggtgtagtgctctcttcattgacaacatttttcacttcctgcggtaggttcgcattatcaactatagttttctcttcatagatcaccagctcattgtccacgattactgtactctcggtaataatcttgacatcagcattctgcagtgctacatttggtatagttcctaagcgggtatcctcatccacactggataaagttctaggagagctgaatccagtatagtccaaattagggtatttcaatatttttgcagattcgtctggttggcactgaacttcatcactgcaacttggatctattgcggtgactaaagtttgtgcaattacacctttcatgtcctccttctgacagatggatccaaatttgtgcccctctgaatctacagaggcagcaaccacttgtatgtcctgcacagcattgtcgtcctggtcacttctgttgcttaatttgggcatctcctcattctcacacgcctgctgcaaacctccagggtttcccaaaatttctgcaggtgcacttactggtctatcactcatgcaacctaaattctgggagataactatcttcacatcctcatcagccctgtgcttctctaggcttccactgtcttctcttgatactccaccatccagttctgcatcacctattgatgttctgccatcagtcgactgtgtttctggatctcttctagcatcatgccaatcctcctctgcttcataaaactcctctcctgtatctactgaagcaacatcagtctcatctccatcatcgtctacctcctccacggtagcagcggcaggcttgaaagaaccagggtctgaaaagactacctggtgcagaaaaggaattcattttagattcattgtccataggagacactaaagaaactaagtaaaaagagtagcgtacaggcagctgaatttattacctcagctcggaagtcccttgggaactgattattagaattccatgacacatcaatatcgtcacgattcaggccaaggatgttggattgaatgaacgcagtgttgaacatgaccctgaacattatctcctcatggtcaaggttatcaccaatatgaatgcactcaagaacaacatctccttgaacacggcaaaaagcaccaacttttactgggacttccgcctgcattgcaactattcatcagagatggttcagaataaggtaaattatttcataacttaggagttagcattacctgcccataacgctggagatgtttcttggtctttggcatctcataaagtactttggcgctcttgttactagaacttgaatcttgcccatgtacacgcaaatatggcctacagcccccttcggcatcaaacctcggaacaacgtggagaactattgaatccaagatgaggggtcggctaataggaggcttttctggaccacttccttgtcttgttatatagtgcaaatatctcatatgtgaagactgaggattcaaaggaaagaattgttgtataaagtccctacgggcctgtttataaaccatctctagagttttctgctcgccagtgtatgttttcctatatagcagcagtccagccaacatgaatgcaagcacgggccacccccctctttcacagtgcatcaaaagcatgttgtgctgcccttccactgataaccaattttcacaggatttcaagaaatgatggatcatctcaagctgaagcagtgggcatccttcatactgctgcgggtagtccatgacagtcatgtcatactcagacaggatatctgaaatccgctcctcttgtccccagaccagaaattggacaccatgaaagatgcatccggaaagtagtcctgcagctgcgcaacaatgccgctcaagtaatccctgtactcatcctcacccatggaatcagttgaaaagcagcagtcgaacactgaaacatgtgttaatagaaattagccagaactggtataagcaacttttcatctttcgactagaattaaagaaaaggaaagcacatctagcactaaaaggctaccagcatctgatttttcacactgcaagtgtgctaaaattcatatttccagttgaattcaagtatttgatccaagtggtttcaatataaaagtacaccattataaccaaacattagattcgcagcaagcagaaattaaccatatgaacatgcaagcaggatatggtgggtctacggccgatttaagccaaatgcagctgagcccaaagcttcccgcagagcaaaactccacaatcacacaagattcatagaaggaaacaaataaagaaaaaattaagccaaaatgcagctaaatctaaggcttattaaacacatgcaaacccagtatcagaccaaatgcatgacccaaaatctaactcagaaattactaaatatagcgcttacgccctgcgcatgccctaaattcccgcttaaatcaacaccccagtaagcaaaaccttcccaaaattcgagccccccaagcactccaaagccacaaatccccctcggaacaaaaggctcccccgcaaatctcacacccccacggtcccaattccacccagaggcgagggcattataccatagacgcgctcggagatctcgagcagccgatccggcgtcttcttcaggaagaatttgcggaagagcgccatccttcccctcctcctcctcccccttctcctccgccgccgccgccgcctccgcctctcctgcgcccccctcgccgggcgagctgctctgacgcctcacgcggccaccgatcggctccgatcggggcgccaaaggcatggggggccccacccgcccgccgcccgccggcgagctcagcggaggagggcccgcacccacctccccacccggggatctcgggatcgacgccctcccgccgcctagggttccccccgcgtcgggggcgcgcgctccccggcggcagcagcagcagcgagcgagggcgcggtggtggtggtggtgggcgtggagagagagggcaccgtgggattgggacttcgtttcctctctactgcctcctcctcctcctgctcgcttcgtttgaactccactttagtaaaatctttttttcccctttctttcagctccccccaagtttttactgctttttttttctttttctaatctgcttctcaattttttttcgctgccgcggtgaatgttttttcccccggataacagtgacagcggtgaagccgccgcgacgacggatactcttgtgccactgccatgcggggccacttaaagtggggcccagcgtcagtcacgtggggtaggggtgggttcgttgcgagggtagaggaaggctggacctcggcggctgtgtcggtacgtgcgtgtccgggttttcattttcttttctttctctttcgttttttttttacttgagggagacgggatctcatctggtgagatagattcttttaccgccacccccctaagttcgcgggaaatgcgactatttttgggattatcacgtgttgctggtcattttctttaccgttaatttgtactgggaaggaatttaagcgcagcgcatgtttgtccatgccagtgattagcattgacagatgttttctagtaatagatgatttgtgaaattgttggcattatgttattttcagtaggaaaaaatgatgatggtgacagctgtgtcctggatgaactgggctttattcattgtgctctcataaacgagtggaagtggaatttttatgaattcaagtgatctgctgtctataaggagaaaaaaaatagcatgcgcaaaatgcactcggactaattgctgttatatttgaagtaatcattaataccctctcctatctaaaatacataataatcttgtcctggatcacacacaaggtagtataaacttagctagagtgttttttttccttttacacgaactagctagagtgttgctacttgatctgcttgtatgtcaaaaaaaacaaaaacaaaataaagaaaaaaattaatgtagcagcatgcgaaggaaccaagaggacgaaaatgtacattggatcctatccaacacaaagaacccattccaaaatgggccgtacatccgttgcccttggcgtggtttgtgccgtttgttcgcctcacgagtgacctcaattcatttatgaatcccattgccaaatcaaacacaaccccggccacactcccttctctaacaatttcgtggacatcatcgagcatgtgagcggccgccatcacaaacgtgcacccaaattaaaccaattaacaaacaaacttaaggacccatacaaagaactccttcaccgaaaaaaaaaaaagaagaagaagagagagctgcgtaatccaaaccgacgaccacgatcaccatccagcaaaaaacggacggctctcgtagcggaggccttgccgagcgcttggggacaagccgtggtggaggcccccgaaagtgaccgcgcggcggtcgcgaaaagggcgcagcggcagcggatcagcacggtgcacgagaccgttgccgaggcgcgcgcggcagaaaacagtaaaagcgcacccgtgttttcttcgccttcgcttcgcttcaccgcgcgcgcgcgaggcgacgtgggtgggtggttgactggttgcgccgcgcgcgcgcgggtgtgggctcgagtcgagcgagctcgaccgctcgaggcgacgtgcagcgacgggcgcgcggcttggacgggagctgtgcgtggcgacggcaacggccgcgggggcctgtgtctgtctgcccgagcgtgttggacgcgtccgtccgggccgggccgggacggcgacggcgacggcgacgggttggttcgaccggtctccgtggatattgttgttgctggtcttttgttttgcttttctcctatccaaaatgtttggcgccgttgattttttaaaaaatatttgaccattcgttttattaaaaaaatttaattattaattctttttctatcatttgatttattgttaaatatacttttatgtatatatatagttttacacatttcacaaaaatttttgaataagacgaacgatcaaacatgtttaaaaaaattaacggtgtcaaatatttagggaatgagagagtataaattaaacatgcgacgctagctgtggatagcgagaaatgtggcgtgtggcgtgcatttcatcagggaaacaactgggatattttctatttttttcacttttacggaaaaggatgcgcctggagtgcaatgttgttggagttttcctccgggaaaagaaaagatattgttcatggtagccagctagttcgactataaggagatccaacggttagatatttctaactggctactccttctgagtttgttcttttctgtagaattttcactcgcgaagaatactcgtgtaaggttcccattgtttgctccatatagtatctatcgttgctaaaatttgaattttcaaactcaattttaaagttttttcattgtaatttattttccagcattaacatttaaatcactaaaaacacatataagaaaattttatatataaattgttattattttgctaatacgctgaataacgtaatattgtatttagcctaatgctgggagcctagagtatctgcatggacggatatatccacttggcagccgcccaccatcgtactatcccgtatgttcggtggcacggcgtcgcgacccacttggcaataaaaagcgcggaaaatacacgcacacgccgctcggcccatcgcatcgcgtatttcgcgatttcgccgtcccataaaagcagcgtcacgtatgcaatgaatcagcaacgccgtgatgtgagcctagcgcagtaacgctcgcagttaacggcgttcaattgtgaattatccgcggcagtaaaaaaatgaagtagtaaaaaactctggacttgtaccgctcgtactctgcttctgctgcctgcgtcgtttcaacggtgcggttaatgatcgcgataaaaaaaagggggggcttaattattcgctcatcagcacagcacctggactagctagaacgtgcaataataacgacgttattactaatttttacgtcaattagtagtagtaccactgattgatttatcgatcgcgaccgttagaaaaggtgaacagtgaagagtctaatctgatctaatctaatgcatggccctgaaacttccctttctctctctttctctctctcctatcaaatatcaacagtacaatggttatttcagttctccatcatgggatcgtactctgtttagcatgggattaagctagcgtacgtacgtgcatccgtgcgatggacacaactactacagctgcaagacagtcggcgaaggccagcgatacgtgaccgtattattaattcgagcccaatttatgattgatttatactagtattcgtgcgtatagg

SEQ ID NO: 69059 - DNA, 84349 bp, Oryza sativa
  unsure (1)..(84349): unsure at all n locations
tcttcgtccgctggttagcttattagtcgcaactaaaatttaatttttaaaacataacttttagttgattttaggggtttatttttattgtggtctatttttcagtattggttggatgacatataaattatttttattactctgttcaattttatagcacttattagccgttgcttaacccattagagccgaacacaactcttttgcttgcccggcactaaaaaattgtatttctaatttctacggtgcaaaatttgacgaggtcctatttatatgatgctctgggagatgaatagttatagtctgtgagattttttcatactgagtgaggagggcatggcattatcacaaagtagctcaatattcgtgtttggaacacccgagaaaattttgaatgctctctgttttcgtgtgaaatttctcaggcagggatcaattcaagtgtggttcaccttgtgctgcaaaagagagccacacaagaaaggctcccaaagattttgtaatttgtatgcatgcgtacatgtacgtgacaaggattggaaaaatcttctactgttgtggcaggtatgtacaagagctggtagaggctggggtgcagtttggctgttcgtccagccaaccattctgtccaacccaacatcgtcaggataatttggtaaggatacctgaaagttggtaaatgccaggatctttttgttatttatttgttagtattaggtaatgtattttgtcttgaattaatcttgatggatttaatcgtcgtaatacccaaagtaaatatctctctcgcagtaaataagtggaaacaacagtgtcaaataacccccgaattttgctctatgatgtaaccatggatcatgagtttgatgactcagacaaatggcacgctctaaacagttaatagaggtatgcactcccgtagtttacttttccgcttacaagtcactgttaaattttaaaatttaaagcttatttttggacttgatttttttctcaattatagtttgtttatttttcagtatttgcttttgaactgataaaaaaactcacataaaattttcatttataaactattttttggttgttatgatcagcataatcgaaacggtgactttcgatggattatttatgattttttttaaaaaagaactttctacttcagtattggcttagacaatttcccacgaaccatttgttagctcaattttcctcggtttcataatctatccaatccaaaatcacccagttagaaaacgtccaaaatgtctaaactgatgtccccaggcacaagaagaaatcagcacacatacttcatttggttatgtacacaaacaccacgtactatgcgtgtgtggtaaccgcagaggatataggacctcacatctcccaattcccaagaacagtaaaaaaaagattttatctatttatctatctatttatgcatggacaagggcacaagtctaacgagagaccacgcagggcgtttgtggagagagacgggcggcgctgccaagtagggcattcccgccaggtaaattcccgggctttttttcttttgcttgcttcctttgcttgtctcctttggttgcggcgggaacaaaaaaagaaaaaaaaaagaagcgcaccgcgcagccgcgcgccacctccacctccactcgtcctcctcctccactctcgcaatctcgcacatatgcgatgcccgccagaataaaaccctcctgccctctcgccaatggcggccgctgaagctacctcctgctcttcttcctcttcgtcttcggcgtagctccatccctgctgttgcatgtaggattcgatcgattcgtggtggaggtaagtaatatccaatctcttcttgagtcttaatttcttggtagatttatctcttctcgatctcctgttgttaatgatgatgagttgccggatgcctgccgggacttcgcttgcaagcagctgctgtgtgcgtttcttgcgtgggagtcttccttggctgccttcctctactacatctagcagattctttctaattaagtttcgatcaatatgtgcctttgtgatttgtgatatatatttgaatggtagattaattagttattcggttgattttgctggatgcatgcatgtagctaggtgagatggatgaacaattgaacccctgtcagtttgccaagtttaattagtcaccacctgcaaatcagattgaaatagaggcgaattaaggagatagtttcattctgctcaagttctagactagaacatgaggattaattagatttttacttaacctggatgaatccaacaagaaaagattctggtattcagaactgagttcggttcaccaacgtgtagtactctacaactatagtcaaaaaaggaggaggaatattgttatgcaacgaaatgaaatgacagccagaatactgtagatcagcatattccaatattttttttgaacgaacatgtgctaattttattgaatataggagaagtaaaagttacatgtataaaaaagaaagaaccgtacaaaaggacaaaggcctaaggaattaaaagcactaggtgttttgctcccgattccaatgttttgaaacaaatagattttaacaaattatgtttgaatatttaaactattccaaaccaggatcataaattcataacagatcggcaaatagcgtgcccgagatagcaggaagatactagcaccaacgcaatcaaatatctgaaaaaaaaaattctctgattcttagctcacacgtcacacaagtagtagtactatcaatctatcatttctcaggggaatttaacccaaccagacccttttgctttccacattccacaccatctcataatatgctttcatagctttactgctttactctttttctacatacatccaaggctgctgctggtcatcagaattcagaatgagaaacatgccaatgttgtgtccttctcattcttcagtgagtgcagtccatggagctatgctgatctctttttgtccatctttaatcgtcctaatcctgctttaaagccaaccatgtcatcaagaattgatcaatgttcttttgaaaacctctttttgtttagtatgtgttctttcatgtccctgtcaagacagataaattgcacagcacaacgtgtagccttctgcatgcagtccacaggccttggaagaaaaccctttgatgatgagtgatgttgattcttgagcagatttacacacaacccaaaaatactaatgatgaaaaggagtaagattaagtaatccgttacacggctttcttttattaaacacaagctttcttttcttgcaaacattgttctactagtgacataagttagttactaattactagttagttaatggttctagtacggatttgatgtttttatgtaatggtcaatgcgagtcaaagatgatgaaagctgcaggcatttgcagtgggcttgcctacaaagcaagacacggacaaacaaaaacaaacgctctcatttgggagttcatgtctttggtgcaaaggaaacacacgcatgtacgtcgcgatcatgcgtgctcgatcggcgagctatagcgcgctaacggacaatctcatggtcacggatcgagtgtgatcgatgcgaaaaagcagcttgcgggcgcgatttctttctttgtctgcctaattcagttgatgaatcttgcatatggtcttttgtgttgtgtactgcaggagttgagcttgtcaggtgttcgttcttggggatcgatgacgctgggcagcggcggcatggcggcggaggagggcggcggcaatggcgaggcggcggcgaggggggagaggtgcgtggtggtggcggtggaggagacgtgctgcgcgtgcgcgcagctcgtggtcgggccgccgaacccgatgatggcgaggtacgtgtacgccttcgtgttcctggcgaccaacctgctcgcctggacgctccgcgacttcggccaccccgtcctcgccgagctccggcgactccgcggcagctgccagggcgccggctactgcctcggcgccgagggcgtcctccgcgtcagcctcggctgcttcgtatcctctttgcaattcaattcagatttcagtctcagattcagcttgcattttgtgaggtggatttttgtccctggagggacatcccctcgttttatacatgtcatttaaaaagttatcaaaaaaaaatttaaaagcaattgtcaagataaattaatatatgatatattttttcacaaacatgcgagttaaaatttgaccaatacaattcgaaacaaaaataacaaatttgaccgtatattaagcgttctattcatacttaaatttgttatttttgtttctatttgtataagttgatttttgaatttacatgtttgtgaagtgacatcacatattgatttatcgtactaattttttttcaaattttcaatgactttttaagtgacatacaaaaatgaggagttatcatcttaagggatgaattgagttttcctgcattttgtgaatttgatgtccttgacgacggcgatcaccagctgttcttcttcgtgatgttcttgtcgacggtgaggacgaggaagacgcacgatcgccggaattcatggcactccgagtggtggccggcgaagatcgtgctgtggatgggcttcaccgtcgtccccttcttcctcccctcgcctctcatccagctctacggtcagtgttgccattgtcaccctcctcagctcctctcacccacccgttcttgattcctctttgctcatggtgttcgtctgaattttcatattttcagggaagatcgcgcatttcggagcagggtaagccccgcatgcacattttcttttttaatataaaatactataacttccggcctcttgcatcaactagagatgcatacacgcaaccaacacacgtttttcagcacgttcagctgaatcgggtctcgttatcgacgtaaaactgatggatcatatgatgcgcaattttgacagggcgtttctggtgatccagctcgtcagtgtcacccggttcatcacctggctgaacgactgctgccggtcagagaccaacctgaagagatggtacgtctactgatcaaagccgctgatttctgttccataaaaaagcaaatccagttccctccgtcctaaattataagacctatattttttttacacggtcttcaatgatatattttgatcgttagtttattccatgctatatatttccaataaatatgaaattagcatcacatgaaagtattttaaaatatgaatgtaatgatataatatgcataatacttagcatatatatatatggttagtataattattaatcaaaagttaccgagtttaattttccttaaaaaaaaggtgcccaaatacgaaggaagtactatgatatgtcacatcaaataccgagtacagctcacctgcaatggcggcgtacgtctgacatgggttgaggtggtggtggtgcagccatatgcaggtgcaggtggtgtcgatcgcggcgtacgtgggctccatcctgggcgtggtgctcatgtacgtgtggtacgcgccgcggccgtcctgcaagctcaacatcctcttcatcaccgtcaccctcgtcctcgtccagatcatgaccggcgtctcgctcagctccaaggtcttgtgcgactaatttgcttacttctatccggatcgatcgatctcgattggaacaagtgttctcgtgtctgaatctctgaatctgaaatctgcatttgctctgttcttggattggttttgggtttcaggtgaaggctggctacctggcgcctgggctgatgggggtctacatcgtgttcctctgctggacagcgatcaggaggtgattattttctttgaaagattcattcggatctcagttctgaatttgtgatctgatcatccatggaatcgaatccattttataacacaactttggttcttttgttttttttttgggccatgaacagtgagcctcacacagagatttgcaacaagaaagccgaggttgcaacgagtgcagattgggttaacatcgcggtaatcatccaatcaactgttcagaaatgaaatttaacaaaatcgaacaatgtcatcatctgcttaactgctgctgtataaatctgaagaatgaaatgtccaacatctgcagagcttcgtgatcgcggtgatcgtcatcgtcacggcgacattcgctacggggatcgattccaagtgcctccaggtctgtcacttaactgaactcatcagtgatcagggttatgatcatatcgccattgatgctgaaattgctcgagaatctgcagttcaagaaggccgagagcgagcagcccgaggacgacgacatcccgtacgggttcggcttcttccacttcgtgttcgccatgggcgccatgtacttcgctatgctcttcgtcggctggaacgccaatcaaaccatggagaagtaataatcccagccataacaacttccactggtctttagcttaataacttgataatccattcaaggagatcaagtaaccataatccggtaactgattacaatttgttatgatccggttgattgattgcgtcaggtggacgatcgatgtcgggtgggcgagcacctgggtccgggttgtcaacgaatggctcgcggcgatcgtgtatagtaagtgaaccaaaccatgtactcctttcattccaaaatataaaaatggttagttttcaaaacttatataccataatatataagtatttatagtaccctgattgtgtgtacacacagaaatccaagcattttgaaacaatcagaattttgggaagagagcctaaccaattcaaaacttaatcaatgatacaagtgaaaataaatcttttttccgccacaaaccttaatctttactaaacaggctagaaatacttacattttaaaacggagatagtataacaatatctagccgcgcaattgcacgagctacatctgcactagctactgtatattactgacaaaactgccgttgcacctgcactttcagtatggatggtgattgctccaattgtctggaagggagggcaggtcggctcatcgccagagggcacatgacacaaggagaacaaatcagaattcagaaatggagcttcgtcagatgatgcagcgataaatacttggtcagcgacaaacacgtacgtagctgcaggctgcatgatcagggagatgtacaggatgagaagaacagttttgctttcgttgcagctgctgcagagaggcatatgcaattggcatccattgcccatacgagtgtagctagctagctaagctagatatttgtatgttcagtttcctctcctgttactggagagggcaatgcatcgaatcagcaaagcatattgtcaaatgacaaactgctgctgaacatgcaaaaggggcagcaacccttggaatatacgcagacttcctgaaacagtgactaatttctgtcatttggaatttcagttctgatctgaaactgggtactcattgcctatctctctctctctctcatgattcaatatttatgtagggtactcctatgatgtaatctgatcaggttacaaagcttgaagaaatcttgtttgagtgagagggtgactgagatctctcatgtgatgcatgcatctgatcgattctgatcaggtcggccagggacatgaaagaaatgatttactccctcacttccaaaatgtaaaaatatagtattggattaaacattttataatactacaaatctggatatatatataaaatgtctaatctggtacttcctccgtttcacaatgtaagtcattctagcatttcccatattcatattgatatctatctagattcattaacatcaatatgaatgtgggaaatgttagaatgacttacattgtgaaacggagggagtaagtaactcttaaaaaattaaatactaatccatacaagagatcaaacaaaaggaatagataagcatcaatcgttggagtaactcattttctgatattgccatgccctgatttctgaaattttgtcctatgaacaaaaaaaaatgtgtatatgctctaaattacgatgttatgatggaaaatggatcatacttcgccttttctgcggcttcctacatgcctcctattcgctggttgttgtttcctcacgctactcctactctatacacatttgcatgcaacctaatgacccctcttgtttgcagcaatattgtactgatgtactctcccgtccttaaaaaaaaacttaacccaggagaggtcatacaacgaattagacaagtgtcacatcccttctagatacacatttcaatactcgtggtacgtttttcaaactgctaaacggtgcgtttcatacgaaaactttctatatgaaagttgctctacagcgcggaatattagtttgagcactgcacaacgccctctccttctggttttcctgttttttaccacaccacttttcctccgcatcccacatttcctcggtttgttttttttcgtttctttaccactccactttccgtgtttcttttttctcttttccatctcatccgtgcttcatccatgggcccagtaaaatattaaccatctagattttttttttcgttccttatttgtagtttttctattttcgcgttttagtaaactatttactgtctagtttttctttccgagttttccgtttttctagtatctccgcacgtttcaaaagtaacaaatttactccatttactccgtggagtttttcatttactccgagcctcccacatccgctcatttaaaagtaacaaatttactcgcatgaatgcctccatacgcaatacctagatggtcgtaaaagaattactaccagcttacaacgctagtaattcttttaccaatattataaatattgtttagatttcatggtctgtgagtaaaacaattactaccttcctttcgatatagcccatgatctcgtagccaccctatagtaatatatttactgatgtgttcaatacacaatataagagtaaaaaccgagatttcctggtatgcgactatgcgagtaaaacaattaccacattcctctcgatatagccatgatctcatagccacagtgtagtaatatttttactgatatgttcaatatacagtataagagtaaaaatctaaaactaagagtattgttgatctgtatcacaaaataatcgtataaatgaaaaaaattactggctcaatcacacacaagcgataaaattactcacaaaattactcacagctgaatcaaactagaaaaaaaaatgattcagccaaaaatccatctggtggctttgctggatcttgctataaggatgaagagcacggtctatgtcttgtgactggtagtggagagggcaaccgggtggcgagcagtagtcgacgatggaatcatggaaggatgtagcggtgtggtatagagatgagctcgacgttgcgcagtagcagccattcatcatctagcaagcacgaaaaaatgcaaaaacattctcgttcatgtcaatacagatgacgagcaaaagaaaaatagcaaacaacttccatcaccggcggactccaccctatcctctgcagccagccacatggagcacgatgtgcaaatgtaggacctgtgcagcccatcaattgagatcaggtaatattgaagattgcacgttaatttgatttgcaaaaaaaattagggcttcatgcgtgaagttgaaggagagtatgcatatgcaaatcagagtgtcatttccttgcttgttctatcaatgtcgccgatgtggagcagccgctggttgttgctattggcccaggtgaacacctctttgctggttaaggtgatacctagcgtccggcagcgaggcccgaagcgtgccttcgcctcaaccgtcgccggccactgccatcaaccaccacggtgtcatcctcctcctccatggtgtgtcgccgatctgtggggtgggatggtggatcgatccagatcccaaaaaaaaggaaaaaaatgaagtaggggcgagagtggttggttgggtacgggaaaaatataatatataccggaagcagagaaattgtttttatcgcagttaatcatttactccgataatggtgggagcacgatgcgggacgtggggtgggatcggaagcagtggagttgtttttattatcgaagtaaatcgtttactcgaataaagttgggtggttggggcgcgcgataggagtaaatcgtttactccgacaacggtaggagtgaaatgacggaacgtggggtggggtgggcctgggctgatgcatgtttggcgcttagaattctatcaaattaatctatgtttcaagtttgtaataattaaaacttaattaattatacgttaatattacctcgttttgcattaaaacacttaatttttatctctaagagaaaaaaacaccacctaaattaaattttttaagcatggagaaagtacatattttttgtttttacacagctggtagatgtgtagcaaatccaaaataaaatccacgaggcaaacgcgtccgtggagcagtcgagccgaagcaaacgccgcccgcttccgagttccgagtcggcgcggcggacggtatatttatcatcatcctgcccccctgcaaaatccttcctacttttacgacacctccccaccccccgtctccttctccctcgtctccagatccgtgggtcgaagcagcggcggcgcccgatccacggcggtcactccctccgccatgaatcccgagtagtaagcactcccatccctcacctcctccttccttccttcctatggttcgtgatctccgcccccggtttcgccgtgctgctcgtttggttaggttgcccggatctgagcgggatcccttcgcatggtttcgatccggatctcaacttggtggctaggtttttcgtcttcttcacacgtggttttgacgacgcgcgggttgttttttttgttgacgatgatctcctcattatcacgtcaattgcaaaagggggaattcggcaatcgctcatcacaccatgatttgctgatgtctcatacatatttggggaatgggaattggattttattctaccaggaaatttagtttataatgttgccttatgtgcgtgccaatgtatcatatcagctcatgtccgtctgctctgtagttatgtgtaaaaacattgccatagttttgaatttggatatcttccacaagtactaatactaggcatattggtcccgtttggatatcaacatacttttggagcagatgtatatgcatcattattcagttacttttacctgcatatataagggagtcctaaataatacaatggtctctattgacatttattcatgccatgatttgatagttacctataagggaagttgacttttgggatatggaaagataacattttattgtaaataattcccactactgtaggagtgcattactacatgtgataaaacactgtgttgaaatgaagaaggtagcagttgtatgcatgtaattgttatttcattttctctatgtactgctactgtaacactagttttttcttttggtcaatttcagcgactaccttttcaaacttctcctcattggtgattctggtgttgggaaatcgtgcttgcttctcagatttgcggtacgagtttaactcattgtctcattctcctaattgtgtttttgtactaagtcattctggaataaatagttcttatatgtaaatgtgcttcagtagaaacatgcagtgtaggatcatacctcactattgcaatagcaaagtggttatgataattatgcaagggattccttccattggtcatctttttgttataaacatgaactgtaagatcatgaatccacaattcactcgtattaaataataaagaatcaagcatgaagcttgactaaattttctgttacgtagattgtgaatgttattgatgtacttgcttcctgtgattaggatgactcatacctggacagctatatcagcacaattggagttgattttgtaagtaatatattgttgatttacttgagttaagtttactttttgtagcacagcaataagttgtgcattttgtttgcagaaatacggacagtagagcaggatgggaagaccatcaagcttcaaatcgtaagattactgctaccttttcttcatcgcttttgatcccgtattgttttttacttgtgctagacaaattcataaataaggatgtccagttatgatgcaatggttattgtgaatgaatctagaaagatatgttctgaaggttatgttcccatatttgtgaaatattggtgctgctcatcggtgaaatttcattttccttgctcgtaatagattctatagattcttgagagtaagttatatggtgtgccctcattgtcaggggtgaaaattgttcagtttatgattttttgcggttgtggcaagatctggtctcagaggatttaccatcttaattgtgttctctttatccaaagggtaaagtctatttttgggccttgaactttgctaagcccatttatcaccctgaactacaaaactggttattttttcaaaacattcaaagccagacacaacaccctgaaccatatgttatggtggttgtcatgaactttaactaggtaagtttcatggtggtggaccttaatatgcataataagagtctgaattaggaaaatcatgtctatttcaaacaaaaccactaacaaattatgtctcagggtgtcttttggctggtttaaaagttgagggtgaaaaataatcgatttctttgtagtttggggtgaaatagtttgaacaacaagttcaagggctaaaaatggaccttacccttatcgaaatatgcatatgatatttttttacccatatttgaatgtgttcgaatgctgaacgttgtatcgacacctgaactcaattctggcaagtatatactttataatattaaaacccagaattgaattcagatatgggctatggagtgctttggtatgtccgtcattgttattgcaaattgtgccactgatgagaaatctttaaatttgtttagaaactattcttttttgagtagcaaactttgagaagtacattaaacttggtgaaatgtgatccatatccatagagtaatctgaagtggagcaatagtccaagtgcatcatgaatttagtatttgaaaatattgttaagactgtggtatgagtatactcttttactttgttacagtgggatactgctggacaagaacgtttcaggacgattacaagcagctattaccggggagctcatggaataattgtaagttggccacatgatccaaccgctattttctgcaaagtattggccatcttgtccctttcattaaactaattcatcctatcttgtgcatgcagattgtatacgatgtgacagaccaagaaagcttcaacaatgtgaagcagtggttgaatgaaattgatcgttatgcaagtgacaatgtaaacaagctccttgttgggaacaagagcgacctaactgccaacaaagttgtgtcatctgaaacagctaaggtaagctctccagagtcatttgattgaatgtgtattggctttgatcgactgtgtattggctttctcaccattgtcatgtgatgctcttatttatacgcctttaacatatctacaatcgttaaaatatcccgcaggcgtttgctgatgagatgggcatccccttcatggagacaagtgccaagaacgccactaatgtggagcaggccttcatggctatggccgcatccatcaaggacaggtacaactttaaatccacatgagcagtgtagctcttgtattaccctcatatctgggtagattttagtaacgaacatcccacctgtcatttttctcaggatggctagccaaccggccgcttcaaatgcaaggccaccgaccgtgcagatccgcgggcaacctgtcaaccagaagacgtcgtgctgctcgtcctaaagataaccaagtctttccttccatgtaaaattcgacgtatgttactactgtttgctcactacaacgtatttgtgatattcatttgaacgcccttgataccatcttttctttaatcagatggttaggcagctgcaaatatatatgtaaccttgctttgttgctctttgctcacgaatcgagaggagcaagcagaaccagtgtattgattcttttcacgcttacatttttcccatttcattgcatacaagtattctgtgttgaggtttagttagaccggaagcggactgattacaacaattttacaacttgtcacaggtgttggaaagttaattttgcatcggtagaaagactatatctttcattgagtgattaggtccaattattttgttccttgccgtgagctgggtcccatatttttatatctaatcccatgaacgtcagtgttgttctggattccgaacgtctcacacgatcgcttcgggcctcgctgataacgcttaggttcacgacatccgtggtgccctcagtagtcatctcccaattcttggcagtctgggacgccgtgcttcccacctagctgaccctaggaatggaggaccggcttgtcagacttggatgagcaaccgacaatattcggcgcactctgcctaccaggcctaccttctgggcctccactcttttgcttgcgccgacctgcaatgggatgctaaagggcctacctaaatgcaagcttttcctctggtttacactccagcagtgttgttggacagctgatattctgttaaagtgtagagtcgacatccatttattgtgccccttgccccttctgtgctcaggagtttgagacgacaaaccatatcctactccactatgtgttcgctcaatagatgcggcaccgcgtgctatccacggcaggctggactggtaccctacctctagagctcgccttctagagcagctttgtcaaggctttgactccttgatcttgctggtgtcctggcagctctgtaaggagcggaactccaggattttcaactccgctcttttgtccatccaggttgtctttgactcgattattcaagattttcaactccgctcttttgcccatccaagttgttttttcaactccagtcgaacgctggatggcttatctcgacattttgttgggaggatagcagtgctcttttacttgcttgctcgtgtcttgcctagcttctaagccttagtcctctaagtcccttttcgccagatttttgtgctagtttttttttctcttgtacctcctccgcaatggcctctgactgttgccttaaattccacattcttataatatattgatgtgtaatttttttacgcgttagttaaaaaaaagacacgccatggcgcgccccagcacatgacacaaggagaacaaatcagaattcagaaatggagcttctcatcgagattttgaaagtcacacgaattgaatggcatattctgaaaacggtgtgaattggatggcatatactgaaaaatctcttcgtcagatgatgcagcgataaatacttggtcagttatacagacacgtacactgctgcagttgcatgatcagggagatgtacaggagaacagttttgcttttgttgcagctgctgaagagaggcatatgcaattggcatccattgcccatacgagtgtagctagctagctaagctagagctttgtatgttcagtttcctctcctgttactggagagggcaatgcatcgaatcagcaaagccaaagcattgtcaaatggcaactgctgctgaacatgcaaaaggggcagcagccttaggaacaaacagtgactaatttgatttctgtcgtttggcactgtatgtaatttcagtatatatttcagctctgatctgaaactgaatactactcatttgcctatctctctcatgcttcaagatttatgtagggtactcctatgatgtaatctgatcaggttattttggagtattaacatatctgatcgaatctgatcaggtcagccagggacaaagaacgaaatgatttaactccagtgttgttgcggtgagctggagcgtgcgtgcaggacaaactaaaacctgaaaccgtggggcgtagtactactgtaggagtattacgtatcgtgcgattgtttgtagcgccgtctaaggtgagtacactaggtgacaggccaggtacatcgtcatggcaaacgtcagagttccagacatacatggcccagaaaccaatccaatcagttgttcgcttgtcacttgtggctgtaattcagttgcaactgacctggctgaacccctcatcgtttggctttatgttctctctccgcaaaatatgtacacttcatccgttctaaaatataagaacctagaaccagatactacgaatctagataagctgtctgtctagattcgtagtaataaaaaagtcctaaactcttatattttataggactgagtgagtaagaaataacatatgcttaaagaaaaaatgtcctaagttcttatactataaatctgaataaagagaggtatatcgtttcatgtctacaattcgtagtacaagatatatctcattcaaccaaagtcctttatattttgggacgcacggggtaagaatcatccgctgctaaaatttaaacctaaagtttattttaggatattttaatgtagtttttaaattagattttaagtcatcaagaacatatgtatgtaaaagtttcatctaaattattgtgacttgcatataataattagattttaaattattgtttttgcatatatatatatatatatatatatatatgtgtgtgtgtgtgtgtgtgtgtgtgtgtgtgtgtgtgtgtgtgtgtgaaagtttcagctgatagtgaatcgacggggaccttagcctaccaagtcacatcggtcacatagatcgacaatgagtgtatgcaactgcaatcgggattgtgcatgaatgaatgattggtttcagatctgcatccatgtcaagcttcactcttcttgtatgttttggccacagctctgggcctcatgctaatccgttttgccgctcgcagttcacgtggtttggcaatacatcaatttggcgtcctgcttattgatccggaagcagtactgctcttgttgtaaagcgaaccgtttcaatactgaaacttgcaagcaatgattgatttatcgatcaccacctactatagttctctttatgatgagattgctaataaaagcgggcaaagtagtccctcggtaagaaagacttatgagaaaggctagtaatcatgcacgtgcaatccacgtttgatagaatatatcacacacaatatgcatctatgtgttttaataactgacaaaactaagaatttgttggttttatatcaattacaatagactggagtacataattttgcaaaatattattgcatttgtgatttgcaggggattggagctctggccaaaacccacttcagtccatagctttgctaataaaaagatccaaaattttggagaaatgagttcacgatagtgaagtgagttagttcatgaacaaaatcactaaactaaatatattttaacgaaatttttgagcatactttacctcaacggagaataaaactctcagcatagtcatataaggatatggtgtatatgctgagcactcgcatattgtagctacaaaatgctttaccttggggaggaggcctgccctttcggtccaaaagcgcttcaggctgccaagctgaaaatataaaatatcaattattgaatcaatttatctacaatagtgcttcaccttggggaagaagcctgcccagaaaacttcatctcttagttgcaaaatatagcatttaaaatttgtaaaaaaaaacaacttcttcgtctactttatcatctcaacaaattataagtatctcatttaatttattcacctatttactcaactcaacttaatcataatcatcatatcccacattaaatttgacctctcctttaaaacccataaatgtttttattttaagacaaaggaaatcggtaagggcaatgttaacaatagagcaaactgctagttctatctttagctagatcatgtaatgtcaatataatgcatactatatcatcaatatatgatctaccttattatctcgtaacactcatttgagtccatgctggagttgaatacagatctatggtttctcttttctaactcaacaaaaatttaatatactctataacaattattatagcacgctcacatcatgtttacttgctccaatgagatagttggagaagtcctcttttacgagtagaactgcgggcataccactccaaggctccaagctcacaccaatacacgtgcatacgtagtcatatgtgtccgttacttatagtccaaaattgtatgacatagaagatgtatagcatactcatcactttcttcgagttgatagtgcttgtcattttgaataaagacatggtcttgaccgctattttttattacaatatatgtaaaaatatcaataaatatatgattttattgaagtactttttaagtacaatctacatatatggtcaccatatttctaagaaatattttagatattatttatagtcgaattttttagagtttgataatagccttgtcaaaaataacaaatactatcaattcgtaggtagttttacacactacatttactgtatattttaacccttattaaaatcctagcgcacatatgagcgtaatatttatgtacaccaaaatttaaaatttcatgtgtaaagtcatacaccatgactctacaccgtatcatttttttgtccctgtaatatggtaatatattcttaaaactagtgtaagttagtgctaattagtgggacacaagacccaccagcactaatcctggtaggttattaagcgtacacatgtacatttagccatctggtcacatatatattagcttatcaatggatctctttctctccaaattcgacccaacctatttgcaattggcaggttgacagtaataaccttataccatatatcataaacattagttcgcattggaacggtgttttaataagttaacaattaaggtgaagagcgagaggtcgacgaaggtcagaagtagatattgtaatacgacggtgtagtatctatcttctaattatctccatctcaagatatgtggtaatttttaacaatgaatccagataactattatctccatatcctaaatatagtaacttttgattattaatctggactggacatataattatctagattcatagctaaaattacttatattttgggatggacggagtattaaatatgatactcttgtataatatctactacttcctttccaaaatataacttttaattatatatgaatgtggatgggtatttgttcatattatagctaagagctgttatgaatctggatgagtagtggttcagattcatagctaagcgtttctatattttaaaatggagataatattgttggtgacaatggtgtgcacatcaatttcaaaaatttatagatgaacttgtgttaacgaaatatcacatcatttcctctcgtgtatatataacttataatgttacaaattgaaaatataccgtcaagattgtatatgtttttcacatcccttaagcaacggtgttgtgacgtggagttgtgcgtgtacaactttactaatcagagattaaaattccctgagggcacacatattacatataccctgcactatacttcctttgtcccaaagaaaaataacttctgaaaatgaatcgattcatccttaaaagttgaattttttttaaggatagaggtgtaggattttagcaaggtccaatatataggttacggatttgtcattggtcgttgtattcttttatgtatgccagagaatgcattcgcggatatatgggttttatattgcacgtttagcaatgacataatcgggaaacatattgaatactccctccgtcccaaaacataagcatttctacaaatgaatctagataactccatgttcatattcgtgttgtttttttaattaatttagctcacaacatatgggcagatctgagctggaccagggagtcaggtcaggcgagaggcgaggccaccacacaaaactgtagcgagtgtggccacccatgcatgcaatgcagcctcatcgcttacgtcaccgccgtcctccccccccctacataaaccatcagcatcatcatcatcagccgcaagccactccacctcgagctctcgcaatgccggccatggaggaggaggcggtggccaacgaggcgcatcacttcctcgtcgtcacgtaccccgcccagggccacatcaacccggcgcgccacctcgcgcggcgcctcgcgcgcgccgcgccgggcgcccgcgtcaccatctccaccgccgtctccgcctgccgcaagatgttcggcgacgccgcggctgcgggcgccggcggggagctcgtcgacgaggggggtgtgcggtacgcgccgtactccgacggctacgacgacggcttcgacagggcggtgcacgacagcgccagctacatgacccaggtcagggtcgtcggcgcgcgcacgctcgccgccgtcatcgaggggttccgcgccgccgggaggcccgtcacccgcgtcgtctacacgctgctgctcacctgggtcgccgacgtcgcccgcgaccatggcgtccccgtcgcgctgtactggatccagccggccgccgtgctcgccgcctacttccactacttccgtggcacgggcggcgtcgacagggacatcgccgcggcggcggcggcgcgggaccggatggcgcccgtgcgcgtcccggggctcccgccgctccggctgcgcgacctcccgtcgttcctcgccatcgccgacgacgacgacccctacgccttcgtgctcgacgcgttccgcgacatcgtcgccgtgctcagccgcggcgacagacccaccgtgctcgccaacacgttcgacgccatggagcccgaggccgtggcgtcgctgcggcagcacggcgtcgacgtcgtccccgtcgggccggtgctctccttcctcgacgccgccaagagcggcggcggcggcggcgccatcaccaccaccaccagcaacgacctcttcaagcagaacgacacgggctacctcgagtggctcgacgcgcggccggccggctcggtggtgtacatctccttcgggagcctgtcgacgatgagccggcggcagatcgccgaggtgtcccgcggcatggcggcgagcggccggccgttcttgtgggtgctgaggaaggacaaccgcggcgaggctgacgacgtcgccatcgacggcggcgtggtggtggagtggtgcgaccaggtgagggtgctcgggcacccggcggtggggtgcttcgtgacgcactgcgggtggaactcgacgctggaggcggtggcgagcggcgtgccggcggtgtgcgtgccgcagtggacggaccagggcaccaacgcgtggctcgtcgccgagcggctcggcgccggcgtcagggccgccgtgagcgaggtcgacggcgtgctggaggccggcgagctgaggcggtgcatcgacgccgccacgtcggaggcggtgcgcgccagcgcggcggcgtggagagagaaggcgcgggcggcggtggccgacggcggctcgtcggagaagaacctgcaggcgtacgttgggaagattcgcgccaattagatgtgtcttattggattttgaattgggatgatgctccaattttatatgtaattagccgaatttcctatgtaattgtggaaatatatgctaatgcatatttgtatttcattttaatgtagagttgtgcggttgtgcctactagacacactctagtactccctccctccaaacaaaagtaatcttggtgaggatttcacatcatctagagcaagtctaggggcctgtttagttagttaaataaaaatttttgggtgtcgcatcagacgtccgaccaaatgttggaaggggtttttagacacaaatgaaaaaaaaactaatttcataacttgcctggaaaccgcgagacgaatcttttgagcctaattaatccatcattagcacatgtgggttactgtagcacttatgactaatcatgtcctaattaggctcaaaagattcgtctcgcgatttacatgcaaattgtgcaattagtttttctttttatctatatttaatgctccatatatgtatccaaagatttgatgtgatgtttttagaaaaaaaaaatttgagaactaaatagggcctagattcattgtcttatgtggtatcaaatcatcacctaggttgtttttttttaatggatggaatacatgtttatatataatcctatcagatcctaggttcttgtattttaagatggagggggtactagcttgttgtctcgtttgaatgaaccttagtttgataccgttttcgacacatatcaagtggttgaattggcctatcgctctaaataacacgtcacataatcaaatcaagtaatttgatcctactggatagagtcattacacggtactccaatcaaaccaacaagtgatatgtatgtatcaagatttaaactcctatcggcagcaaaatcatcaagcttagggaggagataattaaggaggacaagtcttgaaattaatcctgatgactgcgtttggttcacatccgtttcttagagacgcattcgagtaacatagcaagaggaaattgagaaaacatatgtaaaggcgccaactaaaatgggtctttgaggcgagatgatgttccaatttatataaactaaccgaatttcatatgtaactatgcaagtatttcgtttgaatgtagagttgtgcctactataaagcttagacgcactgtatatccttatactcaagtacatgcttataatggctagggatgtaattatcttcctttttctttttaaaaaaagtgtagctagttgtttcattggaatgaaccttaatttgtcgccattttcgacacttctcaagttgtttgaaagtcatcgagttggcactattcaccctggcctgccacacttaagtacatgtcacacaatcaaatcgagtaatttggcacttatgttggtggagttatcacacagtactccatacaatccaacaggtagcatgtctgtatcaaagttatgaacttcaattggcagcaaaatcatcgggtgtatagtatagccaattgctaactatagtataaatattgacacatcatctataatcaatttaatagtatacttgtaataggtagctataaatatattatgccatctctctttctacacaactagagtatgtgatgcagttggctataaatttatagcccgcgtgttcctctatttctctcctttctctcctccagctaagcacaaatccaatgtgataattattatatcatatttatatcatcttattgtactcactcaagatgagataaggacaaatccaatcctcgttactgtgtttggttcacatccttgtttagttggggaaaatttttaggtttgtttgtcacatcggatatacagatacacatttgaagtattaaacgtagtctaataacaaaacaaattatagatttcaccaggaaactgcgagatgaatttattaagcttaattaatccatcattagtaaatgtttacggtagcacgacattgttaaatcatggcgcaattaggcttaaaagatttgtctcgcaatttacacgcaatctgtgtaattggttttttttttgcctacatttactctatgcatgtgtccaaacattcgatgtgatagcgtgaaaatttttgttttgggaactaaacagagtaagagaaaacatacacagctacagtagaagagtatcttggaagaaaagttaccaattcagattggagggtagccaagccagtaggattgagggagtttagctgctttgaatacgccgacatagacaagaaccagaccagatgatgttggcatttgatgtatcaccattgtagttctctctttgtccaagaaaaataatttttcggccagaatgtagaggcgtgataagcaaccgagcaatggccaattccctggcaaaaatggcgtttggttgtctcatgtgactatgtgagcaaacaaaaattaggccgagtttagttccaaacttttttttaaaacttgcaactttaccatcacatcgaaactttctacacacacaaacttccaacttttccgtcacatcgttccaatttcaaccaaactttcaattttgtcgtgaacaaaacacaccctacctaggtgtggcagttttgctagcaataatacttggtcacttttgttttggaatgatattatcatatatctgcatgcaatttctactttgctgaccatatggcccatatctttgcctgacaccaaacagtggttttcctcagaaaccaaacagtgaccatattttggatgggtacaagcgagcatcaaaccaaataccaattttaccaaggctaatgcatgtgtggtgtgtatgtagtgtgcgtgccaacatctgcatcacactatttttacctgtagcacaatctctatgtacagttgaaacattaaaacaacacagctacacacacgactatgggtgacacattgggacccaattgtcaggctcattatgtaccacttttctctctctctctctctctctctcttttttttttttttgcagcagagaaactgtcaccatctttctcccaggaccagctctcaaacgtcacaacaatgagaagacatggatatatcatcgttatgcagaaaatgccgggctgcaccaacagctgcctatcattttggcccatttcccccaacaatacgttaacccagaggtctaaataagaggggggaaaaagaaaaggagaaatcaacatatgtacaaatgatgaagaaaaaagagagaaaaaaggggggcaagatgctatctactgacttggtcggatggagcagatgagctcctttctatcaacaaaaaagatgggtagtcttgcatcggctcaagccggaaaaagcgttgtcgtcagtcgtccctgaaatctctcctcccatcccgggaagagtccctgctggacgccttgatcgcgtcggccatcatgagagcaactgtggccttgtggagggcaaggtcagccttgtgcatcagcaggtgggccttctctctcttgagcttggccatggccaccgcatgctgcgctgcactggaggcatctcgctgcttgagctcctctatgtcgacgcgggggctctgggacgcacccgggagcaggtgctttgagctctgccattcgtggatgaccgcgttccagtgatcaggcgcgcctcgcttcactctctgatgacggaaggaaggtgatggctggtgatcctcagagaatgcaaagcttgcagtccttttgacactgttggttctcaaaaaccttggtgtagaacatctttccaaaccatcaaatgcgcgaggggattctgttttcacagagaacctgggagagtaccctgttggtgaatagatagaaccaccgtcataggattcacatgccctcccatcccccacatattcgctgtattttctccctgatatttgacagaaacctcgtatcagcaaaatataatgacaaaatatggcactggatcaatgattagaaaaaaaaaagttaagaaaacgaacctggtcggtaaaagccatcttgctctctcgaaaagcttcctgaggacataagttttttatgggaacgctgcttcggtcccttatacggtatttggggttggagtcctcgaggtctcaaacagaaggcgaacaaggcaggttttggaggcaacttaacttggtaaccatttgatgaaccctgtattctgagtgctgttgattcccattcctgtagctgctgctcgtggatcttccacatagcggactgaaaatggtacaaatacaaggttagaggtcgtaagtactgaacatttttggtgcactgccctttatccgtttagttgtattcaaacatagtaactgagaagcacaaaaccaatcatttccccagaagcatcagcagttcaacacaatccatgcatcctagggttcaagttaaaccatgactagacacttgctctacagtcactcttattagaaccatatcccaaaaagaaattgtatgtctagttccacagcacataagctacttgaaagttgaaatcccatgataatacactcactcatcttaatatgactgctcaatggcatccaatactcttggaaaagaaactaaaagtggaaaactacctccgctcaagtaaacgatgttttggtctaattaattggtggtcttaaagctgggaataaattatgttaagcacacacagtgctctgcctctcacatagcaaaaataaataagcatgaccataaaactacctaagcacaaaactaactgaaatttagtttaaagcttggacagatcatggagacaaagctgttcactaaacacaaaaatatagggtaataacttaaactagattgaaatctacccaatattttgaacaaaactagtagaaagctatcggcaacaaggcaaactcagaaatggcaatatattgttcacctgaaagtgtcgaatgagtggcattccctttttcttcctcttgtcctgccaataatcatgtatcactttaatggtgtccagtggtatgttatcactatctagttccttcatctgatcaatagtgagttcattgcagttgtggctataagcaagtttctcgaatttgtccatgatcctctcaaacaagtcatctgtcacagaggtgctgtccttgcctagtttcctccatcttgaaacccacacttcatcatcactgtccatgtcatatatcacacgagattcatcaagtgccatttcaacatctgttccaatatgaccaatataatcttgagagcgtacaaaggatacagcatcatgatcatcatgagcttcagcaaagcagacaccaggaattggaatattcttaacagatgcagctctaatgttatgactataacattcatcatgcatttgcttgaaaatcaaccactgacttctgtcaggaaattctaagcaccactctgtcccccctttccatatcattgcatgtgtatagcggtttgtcgccccaggctgcaaaacttgaagaactttgtgagcatacttagttccttctgcaagcttcacacaaatcctccgttcactctgcccatcagagtcaattgtgatctgagtatcgtactccctccatcctctatcaccaactgtaactaggacatttgcaacacaagccaatgactcaggactgctctgttcacttcttgaattatcaggaagtctctttgcactgctatgagactgtatcttgcggaaatgtcctttgtgttttgagccaggttcatcacttctaggagaaaccgagtacaaaacctgagtccttggcttcttagagccaccagcaaagcctgtcaccataatatcttcttgccataattttgaaccatcaccaaaagtgcgtgatagggatgtaaatcggttccgatggtagggagtcctgggggcagttggtgtaacacgaccaataggatactcattcagttcctggaccaagtcagatgtaggctgcatggccttttcttctttgttaagtagcttatcatctggtggatctgatatattatctccaggaatagatatagaagaacacctcttttgatacttctgaggagggcaaacagcagaaaggcttccatccataatttgatctggaaaactcctgcttgttatgttggcaccaccaatacctctgctattacaatccagacttacagtccttttagcagtattgagcttgctgctagcagaaccagaatgattgatgcaaccagcggtacccatatccaaggaaccagtattagatggactaacataaacagaacaaacttcagaagcagaagcagccagatgaaccagatcagatgtgtgctgtggcagagactgctgatcctcttctaaagtaatcggcatgaattccggaagacttttagaagtcaagttgctttcactgcgcaattttaagtggtgaaaaaacaacagtgaaggtgcagctgccacatccagatgattttgaacagatttacttcgctcatcaagacaaaaaatgatagggtcgacatttgaatattttgattctgtgaaaaacagagagtcctgagcatcgagtgatagaccctagttaacagaagagtaattatcagtaataagaagattttctataaacctgtatttcagcacaatatgttttgcaccagcgcattcaacatgtaaaatacataagaaagcagatatttaaagggaaaaggctaaataatggattgatcgagacggaagagatgaacaagaaaaacaacagttcagatagtctgtttatttcaaaagttcaaatttatgattcccaatgcagataaacataacagaaatcaagtgaggcatctgcagaaaattataactgcatataaagtttctgggaaaaaaaatgtgtgtccagaatatctcacaggagaaaccacagatcaagaaatggtatagatcaagagaagccttttcattataaaggatagctaacaaagagcactaaagtcatacaccagcagtccagcacatgaaatatctgacaacattcggcactaagtttactgtaggaagccacgtcccacgtgagacaaataaaagaagtattcagtcagatgtctgtattttaggatactgtttcaacagtactgatgcaacaaaaagtgcatcagaaggtttagtgttaaatgcatcagaaggtttactctcaagttattggttgacaattgacaaggtcgtataaatgaaccgagcacataaaaaactgcaagactagtaaggaatagtcgttttccaaaaattcaactaaaattagcatttacatatccttggatcaagagtaaagcaaacatataggttccagtagcactaccaagaaggaatcggttcattttgttgctagttagaaaacaaaagagcaaattcagtatggtggtttcatccaatttatctaaacacatgaccacattgagcctctcgtaatgcaaagaactattcagtaaaccagcctgagcgtccagtatagtgccaagcactgaatgaaatataattagccggtatatggtttactcacaatctggaggaaaagcattaacaataggaattttctcaacacaaaaaagaccctagagttctagctctatatggctcaatgataataaaaatgatttgatctgcataagtaaggtgggtctggtaccttagagaagtgttctgttgaagtacagactctttgatcagttccatttgtaagttgctttatgtcagcacatgcgcaattaactttagatagccccctttttatatggtgatgctgcagctgtccttgcaggtgcttccatttggggtactttacccccacgaagctgaacatcaaaaacacaacttggcttctaccgtgcaaaccagatatccgaactctgactgaggtgcatagcatttttgactcattgcgtgtactcgccttggaatacgaattgaaacatccaacaagtaaacagaataaggatacagctgatcttaaggaagtctcaagaagcaagtgtttcaatcctaaagtatcatcaacaagaagtatctccagatgtacggcaggccacaaggaaaccattgcaccacggtgaaggagaacaagagcattgagaagccagacatggcatgcttcagacatgatcttataaatagattttaatggctggctcagtactaatatgccatgtcttctcgaagtaacattttcagtaacagacccccagccagcaactgaagcaaacaacgcacctgtaacttttctgtatttaagatcagaatcttgttctgaagtgttgagaaatccattctttctcctgcaagatcgcttccttgagtaaacaaagcgaaacctgctatctttaagcgtagtcctgtcttcagggatctcctcacccgcatttgcaggtgaaccaccaggtctatcatcagagcacagcatagactgcttttgatcaaacataacaggagaaatatctgaatgagtgtgattctgcttattcgtattactggatgtagcagaccttgcatggtttgatctagacagcaatgagatgatggggcctgactcagaacttcctgtgctgtttctatcaatgtcttccctctcatccacttcatattttggtttgaatatcgaccttggattacgacgattagatttatgccgagcttcgctgggcaaaaggagaagcttaatcctctcattttgaagattgatccattcctcatctttatcgtcgtatctgacatgatgcaaccttgtcatgggatcatattcctttaccaggccaaagtaccagatctcatccagaggccaaaacacccggattctctcttttacaatgcaaaacggatccacatcatgagggctgacttcataaaaatgccgacgtgggcgacgcttcttggatgaagctttgccatcacgattccgtagcaacctagcaggacccgccatgcccttgtctttgttacatgaatccttgaaatgttctgaatgctggacaaagtatgcttttgatgatctattcagtgattttgcactcttcctcagtgagctagcacacatattatctgatagagaacagagcatcctagcagcattttcttccaaattaacattatcctcctcttgaacatgcacggagctttccttggtaggatggacatgttttgatggttcacctgaaagatttggctgcttttcgactgagacatcattttcagaacagaagtttgtactgttgtcctggtcacaagtgccattctcaactttcaagcaattgatagggtcattactaccaactctgttctccttaagagtctgtgatttcctccgcttcctcctctggacctgagtagctttcgtaatgccattggatcgcagaaccttgcgacctccggtaccactcttgatactaacattctgagccagcttccttaacctcaatacaccacgaggctgcctgatcactgcaacttcacctgaattaactgaatgctctaagtggccatccttatttcttggcaatgaacgtccgtgacggccattgaaactatcttcgctccatgtggaatcgcctgagctggttcctgccgcatctagcccattaagttccactctatcagaactcaagctagtacgcttcctcttactccctgcagatgaactgctcgaaggctcctccttcccacccccattctgtgaacttggtccttgccccgctccaaccgatgccctctcggacaaagtctcctctccatctaagccttgtactgattcagttgcatccgttgcactaggcctgtcactaccactggattccattcacaagcccagaaatcacaagggggccagactcccaaaattccaccttccatcatacgcgaagtcccacacacagatcttggtgcctcatcccgaccacataatccacagattagagcaaatgcagaatagaagcctaaacaaaccaaggaaaaacactacggtcgcatcaaaaacggaacatttcaaaacagtagagcaccaatctagatcggagaaataaaaaaagaacaaaaaaaatacggggggaaagaccacgcacctgagcaggagcgttgatccgaccaccgaatcgagcccagaaccaccgccggctgcagagaaaatccggatcacacaaaccacctcagacctccaatctctaacaactccacagatttcacacgaaaacacacagctttaggggaagataaaaaaaattaaaaacagctcacctcgattgtatcgtgcggcggatgcgacccacccgcggatcagcgccaaattgggcggcggaatcgatccggcgccgagggtagaaccgatctgcgtcaaaagccccttcccagggccgatctagcgggggtaatcaagcgcctcccctgccgccacgggaagctagggtttcctcttttcgttgtgtttttttcccctttctttttttttggggggcgttttgattttttctttttgcgaattgggggaaggggaggagtggtggggcacagctaagtggcggtggatggcggtgaaggggggtgcgggattgggggccgtacgatctggatcggacggccaggatgagcggtggctgcttccgaggtttgggcggggcttcgaggcacatcagtgagcgaagcaaaagcttattggctctctttttttttgttgaagatttggaaaagtgaaaaacaaaactgatgtgacttttcttttcttttcttttcttttttgcatttttgcttgttcttcctgctttgaggttggtaagaagcttccagtacgttgttgggctgcatttttttaggcttttagtggcaaaagcatactaagctaaaacaatgtggagttaactcctccaatttgttgaattggaggtcatatattatactctctctcactcttcagttataaatatttgatgttttggacaaagattttattaaagttttagaactttgacaatcggtagttcccagctgctagtttaaaaagaagaaagagtggtatgcgtatatttatcttgaatataattactataatatcataaatgtattctaatacaaaaccaatgatacaatttttaaattttttaaccgaatcttatcctaaatataaatatttatgaccaaagggaatagcaaaaatatcaacactatattacaaaagaatatgaggccatacatgttacatgaacaatggtgtggctgtatcactgtttcctaaagtttcaagaaaattatttttttaaatgaacatgtcctataaaaaaccataatcgggaatgcatacatctcacatataagtgcaatcaaagaaaaactgagcaaataaataacatgatcatatcaataaaacacagcgtattcatggagaaatatggaaggaaagagaagtgcatatcaaagaagagagacaaagaaggaaagttgcacctgtagatctggatgtatggagatcagtggagaagacaccatacaagcggagagggctcaatccatacccgagcgatgggatctcgggaaatggaaagaacctagattggttggagaagggatctcgatagccagtggacaagatctcaaccgaagagtgcctaggttggttggcaaacctccgcatcgtctactcttacctccacgatccggagagcaaagggagcgcaatgaaagagaaatctcagcaagaaaacacaaacctctgtaccgtctgtccttgaacctccgtgattcaagaagcaaggggagcgcatggaagcaaagaacgaactaggggatctacatgtgccaatggtgcttggtggcggcgctgtttaggagaaaaggggataaattgaggaggagaggaaagcgtctatcagaaaaaggcgaaccattcgggttccttatatttcctattttactataacaaattgggccttgtagcccaacctcttgggccttataacccaatctctctctctcgcacacatttagagagagaagaggagaggtgaggaagatgatcgaggaagtggttgacatgtgagtctcaccccttgacttagcaagccaatcatgatcggcctgccattccagcagaaatcactccctaaaccactgaaggagttgatttgcaccggttttcgaggatggagagatgttatacctagttttacaatgaggaggcgattcaatcagaagcaagagagtgaggcaaatacacttactcctttagtttgcaatcatgcataatgactcaggagtgagccgaacgcacccaaaatgctagaatctgatggcgtagttcagcccaatatctaggatacaaacgggatctaacatgaaacaaccaatttttggtacaacgattaaacatagcgatacttacatttatgggaaacagattagaagagaaatagtttgtgaaatgctgaaatatcaaaaaacagtcgcaccaagattatcataatttactacaataccaaatgaagccatgctatacctaccatttgagaatgctctcaccacacatccatcgactccacgagattggaaattttcatataatttatgcaggtagttctttacatcttacgttaactagctaaaggagctaaaatttgctacctatgtacaaacccagaaactttgtttccgagaaaaagaatgtagatacaacaaagagcaaaaacatcagcaagtctacatgtacaactgcctgcctatcaaaacttccattatctacaagaacaattgatcggtgtcggtgcgccacatctttgtacagaccagctgccattccacagctcctgctctgtgtagtgggcaaaaatgaatcaaccctgggatgttgcagagtactcgaagagaagtcgattggacggcgtagattggaagagaacacggagcctgctggttagctgatatatgagtgaccactgcattgccatttctgaatctttcatctgcctgacaacagaggcctgcagaacgatgtgagcgattcaggtcggatgatattcatacagaacattatgccagtaagcttaaaatgcttcggttttcaaaaatgtaaaaaggctaaatacctgaaggcgttttccaagttgcacttcgacctcagtagcaaaagatatattgtttgccagcgatttaagtgggtcaaccgttggatctacagatagtaaactcggaatctgcggtgcataaaccagtcgccaccgtgcttgaccaaattcacccttgccttcaatccttggcatcaaagtttcgagtgttgcagttgcgagtttcttgaacgcgagctgtccatcaccttccaatagtgactccgcaagctgtgactcaaaaacctttgcagcctagaaacagcaatgaacaaaagaatatcaaagagttaggcatgataggagaagcacacatattaaccaattgtctaatatctttatgtcagtcttggatagagtgctggcaatcaaccagtaaacggttcaccaggcagtcaccttattatacagtaataaaattctgaaaactagatgaaaataaaccaagaaactatcagacctaaagtaaagcttagctacaattcattgaagaaagtgccttacctcactaggtgaaagaacatcctggtccacagagcgtgtggaggttacaacaagattgtcttgccacatgcttgctcgactttggatcttaaattgccactcagatccaacaagaacaagatccagaataggatccaaaccaagatctggctcaaactttgctacattcaaatgatcatttttaagtcttacctgcataagaataaaaatataaaaccacagtaaccatgagaatgtatatttaatataaaatgacaaagaaggtatgccacaagggcttaagaattctcatgcttacctgagtagcaaccaaattgacctcaccattttcaaaagttaagacacccttaggtcttatgtacttcggatgaaccatgccattaagctcaaggtcgccactcacagcaaaattcaaaattaaaggataaacaatccttaattcaggtccaaatgtgagcttcagatcattgagtcgggcatcaatgtttggcttaaaacttccatgttcaggagtcctttcagtttctgattgttggcctaacacattaaattgaataatccagttgacttgttgagtaaatagacaaaataatagaaagagacaagtaaaggaaaaaaataaatgctgctttccaatattttgtgtaatagcaagagttaggaactaactgtgaaatgaaactactaataagctaagcaaaatgtattggtaaaagggacttgctaaaatactaatgaagatcgaaacaaatgactacttaccgtctggactagttgatagtgatcctagaaagtgggagacatctcgtgagactgttctttggtcaaaaccagcaggaacagagatggatttatttgaagacagcctggtggcaacagcaccattgcctttatcatgaggcaaatacgcttcaccatggcttagccgaatcattccagagacatctggccgcaatattgagcctgtaacctgcagctggctgtctacttggccactgcacaagttaagacgaaagcatattagacaataagaagttatataatacggggtcctacacattgcacagtcaaatttaatttatgacatgtcagatcagcaacatttctgctaaggaatatgacttttttttaatcaaaggaacaattttagaagacaatcaaccagatcacaccaacacccacaagccacaggttagcaaatctgcagcataagaactttcaacatataaaaggataaagtaatggtaatgacctcaaaatattttttgctcgtatgtccagaacttcgcatttcagttcaatcttgtcattggctgatggctcaatattgtggagaggtagagtccctttcattgacaatctccctttcctcccaactctgctttccatggaactgatacatagtctgttagatataacatgaacattgccagcgaaatttgtcagtggtgtccgaaggaaaggagaagccacggttgcacggtgaaatgaggcagacccatcaacaacagggtgatcaacagtgcctttaacctttcatccaaatgacaaacaaggggggaaaggtcatcttggagtgcacaggcataacaaaagaactagctatttaaactgaacttgatgcttaataattcagtttcatcttacattttcatcaatttgaattaatgctatgaaaaaaaggtgaaaatgagtaagcctatgttatttagtcatatatctccttaatggaattatggggattaaataggaatgggcacctggagaagaacttcagcatagccttgaagccagtttgagtaaggactcagtgcagttatcagtgtcatacccccatcctttatatctgcatttattctcacttcgcctggttctagcatattccagcttaaaccctttaggctttcagctaattgaaactcccaaccctcatcaggcttgtctctcatgattcttgtttcgctgatgtcatttgtcaagcctctgtctttcgcccaaacagggattcttattataccttgtttaccatctcccccttccaggtcttcctcaatggagttgctgtctacataagtaacaggaacactaccttgaatgttaacgtgcccactttgtatggtcggttcgaagtttgcatcaaaaacaaaacggcttgttggggttacagaagctaatacttcagctcttccgagatcaatgcctccaatggtgccatcaagaagtcttatttgaacatcacattcaggctttgctagagtacctctcaaatctccctccatatgtagaatgcctttgattggtgtcaaccattgcctcagaaaatgaatcgagtctgtggttgatgattctatagcctgaactaatgcgggtataagaccaactgggaaattaagcacagcaaagtgaagatttgttaatgggccaagaattgatccatcagcatgaagagtggcattatccttctgaataaataacttatcaagacgcaggccatcattattgctgaatgaaccagatgccagaacacgctgtgtcttgtaagtgccccactcccaatcttcaccattgaaatcaaaatcagcctgtagtacataagagtattacaatcaagttcaaatatatggggcatatatttggctcttgtataggaagattatcctgatgatagtttgattgtaatttcaagcttctgtagagttgttcttcaagagacataaaaaagaatgcaaaggaattggaaactaaccgctaactttaacactgcacaatgtcagggacaaagtgaataaagttgaacaatacaagcagggaggtccatatagctaaaagatacttgtatgctcaatccactgtgcaactgtttgcaaagtctaaagagaaagaccactgtaagggagttatcaatagttactgcctgaaatgcttaccatagtatcgccgttccctccaccactggcatcaagagaaccacgccaataacctctcagttcagctaagccaggaagagttatatcctcaattgtatcatcatccaaccaatcaggatacatttctaatgcctggtgcaagcaatgggataggtttaatacaaaagtagcaacctatggtaatggtaacaacagcaatgataaaggcaaccatataacattatatatgatgccaattctatgcatctgtttccattttcataagattgtttactttagtgtacctttagctggtcacgaagactttcagcattgaatccaacagaatgcaaagtttgcataaaaagttcctgaaaagaaaaggaggataaaaatggctctgtcatccaagtctccaacagaccacaaataaacagaatattttgtccctccaaagggaatggcatgcacctttgatctggaacgaatagctgggtctgtacttcgtgatagaagtcttgccaacggaagcatttcagctacttcagcaccaggtacttctaatctcatcctccacctgcccatcgaagacatcatgctaccaagatgccctcccatcgctttctctatgaaaccattactctgactttccatagggaatctatcacgtgttccaggaaaaacatactccccttgaagttcatacttgctattagcttgctctaggactgatttttccatagtaatctgggtgttgaaaagaaaatacaaaagaatagctcaagtgagcacaaaggtggtttatgtctgatgagtaaaagaagataagaatctcactcagaaatcagaatatataaataatgtcaggaaaaacaacatatggacatgcagacgcattgttattttctattttctactgggaaacacaaacgatggagatacatctgttttctcaaaaataaaggagaacaatggagatactagagaggataaatttgctctgtgccaccaaaattgccgccgaagtagcaaaataccatcacaaaggtaaataggaaaacgtcatagcaaagaacaaaaatggaaaacaaaccatcaccatcacctttttttgtccaaagtgttcaacatgaccattctaaccgtaacctttatttcccttgccttcattaatttttttgttagcatcaggtccacctgtcatttgccctatcctctcccctccctattctccagtccacacatgcacatagtgccacagactagccatggggtgaattagaaatctagaaattttctttctaatgaatgggcattaactgcacagaccaactggcatcttaacagtgacggtatttactggagttctttcttgcccattttgtgtttgccaaggtgttttaaagcccagcatcttcatcacagcacttcccaacaccagggcagtttggatggcacggagacggagcaaagttagtctgctagaagccataaataacttataaattgtgacagtgagtaccatacccttgcaactacactcttacggtatattctactaagtgccagacatggggcatgactgtaaagcaaacacgaaaagaatatatgaaaagaagaactcacaacatcaccactccatcgagcagctatatcaagtgattccccaagcatgccactaaattttgggcggataactgacagcaaaccatgacctcttcttttctggaaattaagctggagttctgcctgtaacaacaaaagacccatgtgtaactgttttacataagcatcacaactaactacaacttacaaatacatgggatatagtagaatcaacaaaacagagctagatacagatatgtaaaaaaagactgattcaaatgtgccaatgggctagctaagagaaatttaaaatcataataaaccctgttcttatatagcagtgttaccttctgaacaaacccacgtaatgaagcaaactccagctcatcaagtggcaaatttcgaacctttacaacaagaaaacaaggatagagaaaattagacattcatgccagcagagtacctccaagcaagatcacaatgctctagaaagatctgttggataacatgcaagcatgccagtagagtacctccaaactagtcaaattttcagggtgatagcagatattagatctcagctgccccttttggaggaatattgacaacagccttccgtcttgaatggcctcgtgtgtgccaaaaaataatggcacattcacttctatggaaaaattttcatcgggtctgcctgtagcatttaactgcttggacatggagtagaagacaaaatgaaaagagagcataaattggagcccacacaagtacactgaaatgcaactttaataataaatgcatatgtgctctcaattttgctataatctgttgagagtatgttctcattgaaatgaagtctgtgaagcagtataaactggaaacaaaagtgaatcaaattgataagaaaaatataccttttgtgcatgcatgatcctcaaaccttagttaaaaggcgaatggttgatatagattatgtaaaatttctattttttactattatattcattacttggttttgactttgttttgaggtaatggagaaatacctttagtgtttaaaaatgttaaatgtaggagatgttttaatttataaaatcctctatatagactgaggtctgcctgcagaaacaatcattgttgccagttgtgctaagtgcattgcaacaaagaaatttacaaacaaagggaacataatatggtaccaaatcactttaagtaaagaaatttaaatataaaagcgtgggaacaagaaaaagagcatgtaataacaaattaccattatagaatctggtgatatggaaagaaaaccagtagattgtggtgccagcataagttggttaagtttaattcctgacagagaaatctcgccaacaagccttgatacatcgttctcaagcttactttggtcaatggtaccttgtatagcaccatggttcttctcatcaactaactggctatatttcaccacttttccttgaaatttaaaccttccagatgctttcaaatgtagaggccgtggtgaatcaaaaggtatcgaagaagctatatgagcaaactcaaagcccctcatgcgtaaatccaaatccacaccctccacaatcagtggcataatttttttcctttgatacatctccttatgcagcaaataatcatcaatatatgatgtttgaatatgagtattcaaatcaaaagaaactgatgatgagttgaccataatatagtcatgtgcaataacaatattgccacgcgcatcagaaaaagaatcttctgcatttggtgcagcccatttgatatcaaatttcctgtcagatattatccacagttagatcaggagtaagaaaaagagtcagcccaataggatatttggactgcagatggcacatctaaggtactcacggcctaataagggaaccagaaagtctagtctctccattgagctctccaattttgagtggaatcaactggatgcctccaggaatgtagcgatgcaaaactttgtcaagtaaaatgctcccagacaaattaatatccatagcagaatcatcaccttccccctgcagagatctaaatatatattacacttgcataaggtggtaattaattaagtgcagtgctagtagtagatacttaagcagagactttcttgtaggcccaatttgtatgtatgcatattctttcaatggaatagaacttgcaggttgagaatgcaaattatctagtgggttggtactgaatgtatacaaaattacacatatgtacttgggtgcattattgcacttattaggaactttaatggcacagaagaataggagtagttggctatttgcaggaccctcaacccatttagcggtaaacattgctgtaagcccagagaaatgaacaatgcaatacctccactaggcttcagccatatttatggcataacagaacactgttaacaatgaaataatatggaagaaatgatttgcaatgtttaattcttatactaattttcattttgaaaggatactgatgtcattatatatccatctactctttacacatcacaacccaaaatcctccacttaactctctaaatagattgagaaatcaacaaacatgggctattcaaaacaaaatgaatacactatggcagaagtagaaagaagttagcgaatgcttaaatttaatacagatgtgaaagcattagtgaccaggggtgcaatcaataactacagtacctctgggcaaatccaaacattaccagctcctcgaatttctccaccatccaaaaggcatgctctaatgccatataaatcagcaacctgtagccagtgaaaatacaaaatagtaaagggaaaatcactgccaaacatccataaacttcatactggaaataatggtggctatatttgtactcacgcagttatcaaggttgaaagtgaaatttgctgaaacatgagtgaagggaatatgatcaaaagcggccactgcaccagactctttgttttgcatcacagcttcagaggctgccgatggaagcataccagatactgaaagagacttccttgagacaatcccacttccaacaaaaacaggagcatcaagaggcccttgacagttaaatacggcagtaacagcaccagccaactgaacgaattaagatattgtattaaaaccaaatcttaaaggatgaacattaagggtctgagccataacccataaaggtgttttggcaaacatttacaccatcattagaccattgtaaaatattaaaaattgagtttgacacacatagcctatccaaaagctatttgcacaattgcatgtactaacaaagaaggtaattttgagataaaccaccgcccattgccatgcaatgcagacaagagataatgggtatcaaatgatgcacctagataggttagccagttaactaggtgtttccataaagacactagccatataaaaacacttcctatacaagaagtcacaatttttcattgtactagatatatggactcaatgtagctgtaccaagttacaacttcagaacttcagatggaaaacacatttttctttatcactaaacagcatctcttcatcttttttatcagaatggattcgagtttatttctaatgaagtatagttaaatcatctgtgatgtgtccacatatagtccagcctttatgcaattatgtggaaacaaaccaactcaaaatgataaaggaatccagtatctccagaggagttcagcaactaaatatgagaggaacagtattttgtaccggaaacattaagggtcgcattttcattgttttcataagtgcattaacttcaactgatggaacctggaaagaagatcaaaattatcaagtttatcactgttatgtaaaggaatatttgaatgataaatcaaatatgcacttcgaaagtttaaagatacctggcacattagatgaaactctccatcctcaggatttagaccaaaatcaccagaagcttctaccggagcatcaccaaaccaaccacttgcattatgtagaaatactctttgaccacgaaaagatagagttgccactatatcctgaatgagttcaggctttagttaaaataataataatcatttcgaaagctaccacatgctaacacttcaaaaaagtaccatggatggcaacctagctataatccacagcaagatgttagtgtccaaaaaaaaaaatatatgatacttggaaacattaatggacaatccagttcttgggacataactgttccccacaccccattcttaagtctactgattccatagttattgtttccttgaaatgctaatgaccaattcatttctggcgtcactgcagatcggcagctctcaccctgatgacactaataaccaatatgcacatcatattccttatctccctctttaaacccattttggttgcgtgcaagaaatttatcacatccaacatcggtgaaagttaaggcactgtaaacctataattgcaatatgttgcttacaatcaagtatgcccaattgtttctcagatcttgaaattcaaattccaggttagcctttatgtatacaaatcaataagccctagatgctctggaaatgtaatcacattgcttacacaagtatcaatgtttattggaaatgtaaaaggcatcaatgacaaaaaaaaatatattggtggtcaagttacagcaaattaataagaaagcatcagaccatgctaatgtgtctcataacttgagggaaataaggaaaatatgattctctagaaatatatgcagagtacgagaaaacatattattgggttaagcacggacatactgaaaacgatgatggagcatctaaaatctgaaaagctaggcccttcacatcaagctggccatgaatgctcgggaaactatcacccttcgacatacagagatgcacctgaaggaataacaaggtgaaacgttgctgtaagaaattcatatgttcaaggctgagacaaaaaaaaaagggtttcctcgagacatggatgattttataaagtttgcaataaagccccggataagtccactaattaagtgaatatggaagtcacatctcaaaatttgtcttcagaaacatgcatgtgtgaccatacaaatagtgggaaaataacatgtaagagatcaagtttagaagatcacctcgccagtagctctccctttattccaaacaactggtatttcgaggatccgctcaaacagctgcacatgaaaactacctttgaacacaaagatcaagaataccaacatcctatatttgcatcaaagagaagtctagtaaaaaacacagtagcagaaaaatagatgcattaccggagcaaaagcattgactacattcaaattagcatgccatgtttgctcagctatatcaacaaaaacatcagtagaaagataaccccctccttgagaagtccggtcttgcctccactccatgcagttcccagtgacatgcacatgtacacgattataactgtttttgaacttgatgtgtccattagcatgtttcatttccctacagttggatggcaataagtctacggaagtagtggaatcatttaaatgttatagatggccaatactattaaattgtggcaactgtaagctgagaaaataagatcaaataacatgaatcagaaaccaattatgagaatattctatattttgtaacactgaagggtgattgctattcaatgcagtacattcataggctgctgtaaatggtcaaaagaaaataacatggtttttgtggctgatacaatggacatataaaagcatgagaaagaacagggatttcagtatttgtaatggaaatggagaattacaaggtcaaaccttggttcttggtcaccatatcctagaagcatcagattccctccattgaaatatacagaatccagggtgatgggaagagtttgttgaacagcaccaggatggatctggccaacaccttgtgaaagttcggcagaattgtctcctggaccaatagcaaacaatgacctcaacttctggatctgaacattcagagaagctgatggtgcattgaacccgacaggaaaccccttcaattggaagggccaaaatgatagccagttgtgagcatatgtgcatgaaccaaaagccccaaaatcgaattcttgccggtaatcatcttcggatatatttttacgtttcttcaaaacaggggcttcagatacttgctcattattttcccaagagtgtgaactaatctgactaggttgttgattatgagaacttccattcaagacatccgtattgccaatcagcattgtactagcgaaattgcttttctctggcggtaattcaccataatccatagatgttgtctcagagtattcagttggtccatcatttggactaccttcctcaccaccaccatttgtatgacctccatcagatgagctttcaccaggaccaggcaaagagtcatcaggattaccactacactcgttttgaaaatatgcaacagcagcatatgcgctacgcctaaggatcctttgctgagaagaattgtcagtgtccgatatcaacttgctatgagccttcctcctgtacctgcgcctgctagggtttggaatcatcctagaccagaagctgatccctggaatacgagctttcacgccgaacgatttctccaaatcggcatgtttcgagctggagtcaatgcccgcatcaatgtgatggtccttcctgtgcatttcatcaggacataggtgtgggctggatttcccagtatcaacaggtccatcgtcttccatcatctcatcgatcgaaggcgaaatcgattgggcactaggaacaatgtatcccatttcggcggcttcccttgcagccttatccctctcctcattccactgctcggcggccttctccctcgcgagccgcctcgttttggtgcggtaatcgatcccctcctcccccgaatgcctcttgggtgagccctcggatggcgcggggagccccagccatgagaaatccttcctctgggccacgagcgccgagggctcggacagcacggcgtcgacgacgaccctcccccgcctgaggctggcgaatggcctgaccctgatcttcatgacgggcacctcggcgcaggagaactcctccgcgtgcgggccgatggagcaggtgtggagggtgatcccgagcggggagacgctgcgcaccctgccgaggtggacctcccgctggaggaattcccccagggcggcgcacgcggcggggaggaggcgagactcgacgaaggagcgggcgcggagctgcgcgtaccaggagagcgcggcggcaacggagagcgccgccgcgaagacggagcagcgcacgaggaagagcccctcccgccatagcggcgcgagggaggcgacgagggcctggtacggcggcggcggctgctgctgctgccgccgcgtcgggagcagcggctggtgctgcgagtgcgggtggtgcggcgcggggcagtcgctggagtcggagaccttgaggcggagcagcggcggcgggtcgaagcgggcgcgcgcgacgaggggcctcgtccccggggaggtgtggatgcagcctccctggcggtggcggcggcggcgggacgggtggaggaggggaggcggcggggagaggaagggcgacgcccggaggcagtgggacattgcggccggcggcgagcggcggcggcggcggcggcggcggcgagcctaggtgaccatttgattttggcgttgcgtgcggcgaggggagagatgcttggcttggctttcgccggggggatcgttttgcgtattctcctcgaggtttttttctctttttcttctatctttgtctttactttgctttattttgtctctttgaggatggcttttcagtcttgatttttaagtggaaatctgaataaatgtttataagtacttgttgttgaattatgatattcatcttctgtacattttgatcacttcttttatgaatgttttatatacttatctaaagattatcaaagtacttcctccgtttcacaatgtatgtcattgtagcatttctcatattcatattgatgctaatgaatctagacatatagcattaatatgaatgtggaaaatgctagaatgatttacattgtgaaacggagagagtatgtaaaagtaaagtaaaagtctattgcattcatgctgcttgcacatacgacttcaccatcacatttgcttgcacctaggacttcttcaccatcacaacactgatgcttctcagttccaaaatattttttcaaacttccaacttttccatcacatcaaaactttcctacacacataaaccttcaacttttccatcatattgtttcaatttcaaccaaacttcacacttccaattttgacgtgaactaaacacagcctgtatgaacttgcaagaacatgcagctttgtccattgtggctagactgtttctatcacaaccagggcagcttccattcatcagaatagccaaacaaatcaccagacgccagccacaagaacgccagacactcagtaaaaaatgtccacaggttacattaacacactgagctagcaccacaagcagctagatgatcagctattctactccagaaacacgaacaccgccataaagaacactggagaaatttaaattcgacaccaacaagatccttgctacttctggctcacaacgccaattccagcaacatccccattaaacagcttctaaagtaaggaacaaaagatatgacaacgtaagaacaataactgtcgaccaatttcgacacagcaagccacagcacaaaagagaacgagagtacccaattagcccccactggccatgccgtccattaagttccaccgggtcaacaattcaaaacacaattacatgaccgttttgagaccagaaaggccttcaagaattcgaaatgaatctcagaaaggcgctcaaaggtcataaatacaactcaaaaaagtttattgtgagtccaaaaacgaacaaggggatttttcaaactcagaacatttttcaaaactttggcggccatttaccgcacaggttgctggttgtaatggttcttctctttcttcttggctgccgcgagcctagcgctccttgctgcagcctcagcagctgcaatttttgcagctgtgtctgactctttgcctgatttctttttcttcattgaagccatcttctttaagcgctccttcacatcaacagaggttgtgtcttcatcaggttctgcactggcagtctcctctgtcccatcagctggttcttgtgattctttagcctcctttgctttcttgtttttcttcttcttggaactcttgctctctgaaggtgctggtgcatctccatcaccagtttggtttgaacctttcttctcagctgcaagaaaacaaagcacatgaacaaataaattccataaagacaaccaaccatagagagacacatgctgaggaacacacaaaaaaccatcaagtacaatttcagcatcataaagaaagcaaactaaacaaacagggtatacagtagcacttaccattgttttcatcctgtgcagcattgcttgaaccaccagaaattcccaactcagccagaacagcatcaagttcggctagctccttctttttcaactcctttttggacagctgcctctccgtatctttaggcggtgcaacaggaactgcagctttcttaccagcaggttcagcagaggtatcatccacttcatgctcaggttcatccacagcaccatcatcaacctcatcatcgaggtcctcatcttcactctctacttcctgcagtgcatagaggcaaacacaaataagaattccaccaatcaagcataaagaggcaacagtgaaaatgcagcacccacagtttctgttgagctttatattgtattcaacatcagtcaattatttgttcacatgttttttttggcaccaattatgtgcccctaaaatctaatcataaagaattacatacttatgggaggaaaagaaatttaaaaacatactgttttttataattattcatgaaaaattatacatcgtattcttgttcgataggtaaccagtatattagcagccaaaatagtgtgttcttatttgctgtgtcaattcagtgatatagtgcaaaaagtaactccttgtcaatttatcagctcagcatatgctgtcagacaaacaaaatcacgtcgttggacaaaacaatccacagtataaataaaataaaatcacatcattgaaagaaacagtcctaataaatataaataagcatagcagacatgatatcatatcaagtaatcaataatgactccacctgtgatgttaggttattcatcaaatattgcactgtgtgacaaaaggaaattgttttgccaacggacaaaattaataacgtagtaacaaatacgatacaaacattccaatttaccagttcggtatctaaagcctgttttgaaaactaaccatgcagaaataaatacacctgagatattcccttgtctcctcttaccgtttcatacggatgcattcgtagtttgtaaaaactaataatgcatgcacaagtataactaacgcattctaacctcatgctacggtttcaatatacctacatataaatccaaattatcaccgagcatgtgtttcgcaattccaaaaactaatcttgcagacatcaccactaccattacagcctacataatatcctcctacctcaatccagcaattcctcgcgctacacgagtgcgaaatctattattccaactataatcaaaacgttgcgcagcagaacagcacatgtaatcaagcgaaacaaaaaaaaatccatgcacatcacagacaaataggcatggtacatggaggagagataaataaacctcctgaagggcggcgtggacggcatcgtcgtcgtcctcctcatcctcctccttggccccatcgtcgccatggccggtgccccagacggggcgagggggagcggtggtggcgaagtagtcgtcgtcgtcgtcgtcctcgacgtcggcccaggacttggtggtgaggggcgcgggcgcccagaagacctccttctgctgctgctgctgctgctgagacgacggctgcgccccctgctgctccctcttcctccccgacgacgacgacgagccgcccttggccttgtccccgcccttcttcttcttcttgagcgtctcgagcgcggcgaacacgttgccggtgctgagcttcacctcctccgccgcggcgcccctcctccctcctcccaccataatcaacccccctaaaaaacctcccgaatccgctcaccgccggggaaatctgaatctgggaaacacgcgggccccgcgcgacccccgcgggcacaggccgccgccgatctgcgggggagggtgcggagcggaggacgcggcgatcgggcggcggcggcggggaggaggaggaggaggttggggatgcggcgcgggctagggttttcgtggagaggagacgccgccgccgcgtgcttgcgttgcgtgtggtttgtttagtgagagagagaagaggaggagagggaggggagagctctcccgggttgggcgagttgggttatctgcacacacagaaaagaaaacctatccgcgtcaggtcagggcgcgaggtggagccgtgtgcggcgtactggtgtcacgcacgcgacggacgcgccacctcccggcgtgccgcgtcgcgcacccgcgcgtgcctgggctggggggcctcttgcgttgcgtggctaatctgttggctgttgctagctcagcctaacacgaaaaaaggctggtatattttatatgatggccaaacaccagttcctccgtcccaaaaatataaaagattttaaaagaatgtggtacattttagtactacaaatataaatgtgtacatacatatctaagggtcttttggacatgacacggtttataaatgtttcatcacactatggcagtgtttagcaaatgggtaatggaaataatttcccacccatctttaaatcctaaccattcattctccctctttcatttaatcctagccattcatttatttcccaatcccaatctcacctcccatttctcattatctaaacacaccctataaatatgtcgttaaattatgtttattatagtgataatatgaaggagaatagttctggtagcgagcaatatagaaagtagtatggggtagcttattttggatatgacaccattactgttacattacgctataaatatatcgttaaattatgcttatcttattatagagataataaggagaaagagaatagatatgctagcgagcaatatagaaagtagtacggggtagctcatcatgaagtatggtctataaattctggacttaactacccacaggtgccatatcatctccgaaagttccagttaatctggaattctggatactacaattccttgaacacgacaatataattgcttcaatatattgttgatgtaggagaggatatactcctgttaatctaaagaaacacgcaaataaaagccaagcaaaagaaagcacgcacaaatgaaattgctttaagccatactagtgaagttcagaaacagcgggtcgtctgctatggagcaataggctgtcacatgttcagatatcacaacaccatcaccacctgaccaccccctcctaggggttcacccgttggcagtgacagttttcttccacattgctaccaacgtgtgtcatcaaatggtacatcgaacaagtagtgaaaactttaacataccagttctggagcttctcccaatttacatgaccacaaaaggctagacggctgcttatcatcccgggtgaaaattgtgtacatgttgtagtttggtaaaaatcaaaagaatatactacgcatagcagacaaactatgcagaacattcatggtgacattgcaagtggaaatcatgcaacgaagaatataaagatcatgaggaaaaccatcagcacaaagaatatcttcatcatcagccaccggttcgatgaaatgctgttgagatacttcagtagctggccctgagctccctcaacattggctagtgtgtcatccatgttctcatcaattctgttacggattgtgcgaattttaaacacaacataatctcaggaaaatagaaaagctagtatgtgaggagataaacaatttgacatgaaacagctactccttcctcagccctatgcatgaatcctaaatgtagtgcactgagagaacaagacatcaacatggactagaaaaattctaagagtgaagaactggccaatggccataataattgataaatatatggaaacctattcttactctaaatcattgctgacatacaaaatctagttggaatttaggtcctcaaaggtttttcaactattctcaagttacgccattagtggaaattttgagaccaggagcaaaacagtctattcactgaatttcaggaaaatgttcatctctttatcgcacaatgggaatctccccacaatgagatcacagcatatcttgaagcttataacaattattcaaaataatgatatgaacttgaccataggcataagacagccaactcatgaattaaatggaacagacttttgtaaaagagtgttaacctgattgctagctctccctgctgagaaaccatagttgccagttgtgtaaaaatgttgcttagctcatggatggttgattcaacattttggagagcctccgctctactctgcatgtaactgtcctgctgtactaactgctgctgcatgaatggctgagaagatgatgatgatgctccatgatctccattagtcttcttcctggtgaacagaaccacaaaaaacatttaaaaaaaaaaactaaaaccacactaccaactgaactcggcaaagtatcattgagttgttcttagtggatagcattgagactgtacaatgagttgtttaaggaaaataactggagtaacaagcagtttattgcacatttgcatgcaagtgctaactgcagttactagcctagataggttaaccaaaatctagcaagcaagatggtaggctaggctagtgtgtttttctattggatatgagcacattccccaaaggaactttaacaattgcactttgcataaatatgagcaaattttatacctctgaaacaatggagtagtggcagaatcactggcccatggtgccgggggtacagaggattcaggaccatccctggtaacaaggggacgttgacgaacaaatggatttgatgcattgttcgcagctgatgatgagaacatttgccttctattctcatgaactttcaagttctgcgcattcaaaaataaacaaactaagtaatatatttttactgaagactatcaaaaggaaacaggaaggcatatatttacctctgtccgcatggtaagaacttccttaaattcttttgttgcgctcatcaggcgattttttagattgtccacaactgtagtggaatgatttgttgtatccttggaaaggttgccgctctcattttgtgaattgcagagaacctgtaggtctacaacggcagaattcaaagcagtgatatctttcttgataactgcagtcagctcttgtatctctaccgtagggtcatcaaaaacagatgtcctctttgccactgcaaacaatccaagtcatagattagcaaggtctacagtgtcaaaggaaagcctaaatattagcagagcattgaaataagtatttgtacgttcaagcgttgaggctgtgtccatcaaaggttatatccatctaattcttagtgaagtattgagacaataacactaggtcgttgttgaggctttatggtaatgaaaatatcacatacaacatcattaatacctatgtgcttaactaaatctcaaggagtcaaagatagaaccaatgaatcatagctgagaaaaaatctgcagatgatgatcaacacggtttaaggcaacatataatgtgccaaataaaaagggattacataacttggattctagaaacatattatttgcacaattaataaagtatgaagaagtcatgtgcatcaatgcttatttgccagctataaaacaccatgtgaggaaagtatgcacgaacaagatacatttaatttccaaatccatcaggagctagaacatctaaaagcaacagtcactatcgcaagagctccaaccaactattggccctcgcagcgcatctttgagcagatatgattagttcacgttgaataccattgtaccccccataacacatgcaaactaccgatgcatccagttcaaagagaagaaagaatgcccatattagcttcttgagaacatggtgatgaatcaatcagcagcctattagcaactgtttgatttagtaatcccccaaagtatgcaattcatgacatgatggaactcattgtttataccatgggaacacgattgcagaataccccatcctgactacccacaaaacaacgtgagcaaaatcacaatacccactaaccgcatgggttgagtgggcaccagaagatcaatcagcatggcagaggaagtatgtaatcaaaatatcacaaaataacaagcaagcacatttttagagtatctaactagtcctatggcaactacaagcacaaacagatagcaataatcggctgccacggtactagctaatcatccatacacggtggcaacttcctaggttacaattccatcgagataagatctacagcatgggcatctcgagatcccaacccaatagtatgccaggaaaccggcagctgaactaattggcaaggatgcaagcataagagagaccaacaggagggtagtgaagagccatacaatcgggccgccaacgctgctgtagcgcgccacgctctcgacggcggcatggaactcattggtgcgatcacggaatgacaccagaacgggactcatcaggttcatggtcatggcggacacaagggagctggatcagtatctgaatctaggcgccttggtgggcgtgatggggcagagagtggcggttggttcggtctctgtgggggaggagcaaagcggtggcggaggaggggatcgtgatttggtgggaaatgttaataaggaacaagaaaccagaataaaaccgggaattctctagttgggctccattgcagaacaccacatcgtgagttcctgactagacaggagacaacactagagaaagcaagataccccctaattgcatcggctgattgggcactggaagaacaatcaatcaccatagctgagagatgtaatcgaaatattgtagctagaaaaaaaaatctaacgagtcctactgttactgcaactctggaagcaagcatacatatatagttcagaaaaaaaaatctaactaatcatcggagaccgcacatacagtaataactaatcaatcatccatacatggcgacgacttcctcctaggctacgattccatcgaggacgagatctacagcgcgcggggttcgagatcccagcaacggagagagggcaggcggggcgaagaggagggaggcggcatacgtttggcgaggcgggcgagcttctgcgaggtctggtggatcccgagcccgatcttggaggcgcggcggttgaactccgagtgcgccgaggccgccccccgcgacacgtcgagcgggccgccaacgccgccgccgctgctgctgctgggcgccgccgccgcggaggaggaggcgtagcgcgcggcgctctcgacggcggcgcggaactcgttggtgcggtcgcggaacgacgccggcgccgggcgccccgggttcatggcggcggatctggatctggatctcggcgcggttgggtgggtggcgggtcgacgcggtcgcggtgggagggtgggaggcggaggaagaaggagggaggagaggggatggggatcgagctggaaattgggggagatcggcgagggaaaagaattggcgtaaaatggtgtttctctgcgagtttgatgaatttttttgggtgtcggttgccgggcttgtgtgacttcgtaacgaggtaatccttcttactccggactatacgatggaaaagaaagaagttgtatgtagtaggagtatattccaaaggatttaatgatctgtatatgtaccatttatttttgtaggaatgtaaatatgataaaattaaagaaagaatatatggaaaattttccgttggtatagattaaagtgtgcatgcgttgaaaaaacaggaacccggtcccctttgagttgtgctcaggggcatatccactctccgggtgcagcccctaatggctatgcttggggcacatcgacccctatggccccaaagtgacctactagacctatactttaaagtgtgccgccgcatgagtgatctacatcttcaaaattagccacatcatatggaagaagggttcatcctctcaaacttagaaattttcatcacccctcatagttgtgaccatcatcatcatcaccatccaccaatgatcccacgagtagggttttacacatccggtggggcttcgaaattgtctagaaaagcttgcctctctcattttcattcgcgcaaagcatcacctctgtggaattcaatttgttgttgacaacgatgtgttcattggtgtctttattagtctcaagatatatcggcataatctttttaatgtgctcatataaatagggtgtgtgtatggataatctaaaagtaaaacttcgatgataaaaaaaatgagcaaagtgaaatttaccaataaaaaacaattttcataacgttcccaattgaaaaaaaaaagtaggtggcacaataaaaatagaagtacgattattttcctgtgcttgtgtccactgggccgcaggtgacgcaatgactgatgatgttgtgggttgtggccttccaggcagaccaggccgacagcccatttgagatcaaaaaggacccaaaacagtacactgaacggaccaagatagaggataggaccaaaggggaggagaaaagagaagagagatgaagatagtatatgatgacttacatgtgggtctcgctttttttccttgactatgatgccatgtagacgttaagtgggataaataccctatcaatgcgacactcaggacgaaactgccgttcaaaccgttcgaggaggtaattggtttggtttttatagttgaaggagcctatatacccgattttacggttgagggatacgattcgacctatggcaatagttgagagacgcaaaacagacttattcttagagtccgatattgggtgacacagaattgcagcccatctaaattcagcacccaattcttttgcactgccatttgccaaagaaatatcattttactccctcaaactatttgattagatcatttaaccccattaaaatacgtttggctcattttactcctaaactattgaaaatgatttaccctacttcctaataactttgatttttaaccatttgatccttttgaaaaacttactccatagataaacccttaaaaacccttattataagaatgaactctttgcgcaacgcattcatcgttgccgtggtccactatgtcagcaccaatgacgttggcatcatccccctaccgcttggtggaagccaagttacttgtgtgaaggggaacagtgctaatgccagtggcgcggaggacctatttattaaaaaaataaaaaggacatatttataataaatatttttttacaaataggtcttgcctatttataataggtccatttatataataagttttttttatctatttgtagaatgagttttctaaaagaatcaaaatgtgaaaaattcaatcctaacaacatctctttttcctctctatgtaagctatattttaaactacaattttgtagagccgtagatgacaccatcatcaaacttcatcagtcgttttcttgaactttaaaatcatgatgtttgaatcaattcttaggtacttccaacctaggcaaacagtaacaaaaaaaactaaaaaaatgctgagacgttaagttatatacatgcatacatcatcatcctacaaaaatcattgcaaaacagggagtattataaaaggagtaaaggataaatacataaaccgttttagggtaacgaaaaatggtttagaggattaggtgcttcggtgaaataacttgactaaagcagaatataccttttttccaaacatttcatcatgcttataagtcaacttatgagaaaaaccaatatttttttcgtttggcttttttaagttataagttactcatacactgtcaaactaaagctagattggaataactttttttccttatgtgaagtggaagtataactccatcattaaatttaaggttttaaagccaccatcttataaaaacatataatccaaaacgttagcttaaaagcgtaaggctaaacaaaaggacctcaatgtcaaacactcaaatttaattactgtacatgctaaacgctgaaacttttgactgaacaacaccaaaattacgctgtacatttatacatgcattcacacaatcatttaagttcagtcttagacattgcaagcccctgtgttaggggcaatcttgtttagccttttatataaatagcggctgcttttcattgtgcacaacaagtagttagttgggttaggcagcaatccatccaaatataaacacaacaatatgtgcatgcatgcatgacatatataagtcattggtaggcaaaggcataaagtgatctcacgatcgtcaggagccatcagctacagtctctactaattgtggattcagagcaatgaacacatgcatgaatgaataacaataagcagcctcagtgccatgacaattttcacaggatatatgcatgcaccaatacgcatacactgaattatttgagcctgaatgattaatgttctctccactgcatgagacgaaatgtcaaacaatgtcctaactcctaagtttgtgctgactccattagcatctcctctttgcatatgcatccatgcatgtgttaaatggtaaagtgattagctagcttgagaatagctagtgggtgtgtggatgtaataaagtgaatggctaagattagctagctagctaattacctttttgcagtgggagattgatagatagatctttcttggcaactgctactacttatccgcaatatctgtattcacaatggtcgatagttcgactaaatcacatttctctcgaagttgcaggttttgcagtgttaattaacaacgaaaaagtattctgaaagtgcgaaatataatgaaggatcacgcagaccatttgtttaatcagctgaccagatagcaagcactaacacagctgcacgtactttatgatgaaaagaaaaggagaggtgacaattttatacacaaatatctgtaagcgtaagctaaacgtaatacacctaaacctggctgtatttaagaactacaaattgattgatgactagatatttagactatcatatttttgcaaaacacaatctatcaatgattagattgcggttcgtttcgttcgttcagatgcgccatcatttcagggagagaacaggtggatggctgcatatatatgcaactagctgcatttgccatcttactatctcaccaaccatttcctcaatgtgtctggctctcacgtgttaaatatgaacaaaaaattaaaatgattcgtatcttgacccttagcctgtaatagcagccgccagcgccactgatcattcggaggttgtttggtctaccaatacattattcagaacatgaagagattacacaccaacagtccaatttgctactccaataaaggagggagtatatcgcatagttcaattataaccagctaatcactaattaatcagtgcagactgtgtgcatgtttagttcaactcaaattattacttactgatgaaagatcaatctgtaacatgctgggtcatcaaatattcacaattgactatatatgcagccgacgacgacaatggtcatgagactactgaaaacatgcctgaatatgacaaaaaggagtgagagctcaaaatcttttgtcttctttggtttagttattttctggcccacacgttgtctgaattctttatccagctagcttcttcagagctgaccattattgcatcattggatgcttaaaaagaaattgaattgcatgcatgcatatatccgaaaacgtgtgagtttatctgttcatccaaccactttcagggaaaagctgcatacatgctccatgaaagacaaagcgaaaggtttcttgatccaaaaaagcttctgatatgatggcctccatctaccgaactttcctgttcaaacaatcccttttgcagtttcctttgctctttcccactgtttattcacatcaagatatctctctccctatgcactaatgcttaatttccatgctaatttatttgatgcgttataattgtggagtcagacatgcggcattaaaacattaaaatactgaaaactatgatcataattgataaattacgatcaaagttacacctacatgtcgataaattttgctgctacaaaatcagtccaccggctcaagctggctcggtttcaaaaaaattaaaaataagtcaaagtatatgtaggacatactcacagacctgaaagcatttattatgatcagtattagctattggaccagaggaattatatcagtaatttggtggagttggtggactttacgcgtgtggtatatataaatctcgttaagaagaataattaaagacatgtgaaattggtacaaataaagaatctggagtaattcaaatgttaaaaaaatatattctcgaagatacgcccaatccagacaggaggttaatcagaactaataataattaagctacgcaaatttaattccgctgtcggtcagtcaagctagatcaaagctgcgagcttactataagcatgcactgcagcatatctgcaccaaactagaccactgctattcctttttggttttaaatttgttgtaagccaagttgtctctctcgatcctgattaggagtaactaattcaccacctgctgctaattgacaagttgtctaatcagtcgatctgactgtttatcggtttagcactcgctaatcagtttgatttgatttgattttggatgacctggtccatggacctggtagctttcgtgctctcaatgtgaaggaacatgacgtacttcatcacctttggaacgcgtctctgttcgatctgagtctgaatcatgagcttatgcctgattgagaggtttcatcggattgaaaaagtgaaatatgatgatgaaataaatctatatttacccctgttttaccactgggcgatcagatttttttttttcacatatcaacggttgcaaacagagagtattttagagtacatttttgttgcagatttattagactgtgaaatgtgaaatcatttgtcatgctcactgatttaatttgaaatcgttgctccatttcacaaaaaaaggcctttatccagacaattatgagcataaaacaaacataaattcaactttatagtacaattgcttgtgataataattaatttgacctattaaaaaaaacactgctaatttggagatagagtccagagtctatggagcaggaaggaagggttcagacttgcttggaaagcacatcttcccctacctttgaccacgacgctggaactcacacgagcaggaaatctctgacaatggcaggtgggccccaccccgactccttcctacccacggccgactcccctcctcgtcaccacgttgtccatttgatccaccatttcccaaatccaaaacacctataaataccactcaccctccttgcactccaaacaagtcaaatcaaaccaaccatttcaaaccaaagcaaagcaacgagctagcaagggcaacaacaaccacccctctcctcgtcttcgtagttggttattcctctcagctacaccattttgttaacaatggcggccgccaagtccgtcgagcggctcgggcagcggcgggtggtgccggccgagccgacgccggccggtcccctccgtctgtcgtggctcgaccgctaccctacccagatggcgctgatcgagtcgctccacgtgttcaagccggctctcgatagggcgatcggcggcgatgacgtggcggttgggccggcccgcacgatcgagcgggccttggcgagggccttggtgcattactaccccctcgcgggccggctcgccttctccgactccggcgaggtgtgcgtggactgcggcgacgccggcgtgtggttcacggaggcggaggcgagctgcagcctcgaggacgtggactacctcgagtacccgatgatggtgcccaaggacgagctgctcccgccgacgccggcgggggaggaggagcgcgagctcgtgctgctcgtccaggtcaccgcgttcgcgtgcggcggcttcgtcgtcgggttccggttcagccacgcggtggcggacggccccggcgcagcgcagttcatggccgccgtcggcgagctcgcccgcggcgcgggcggcgtgtccgtcgatcccgtgtggggccgcgacgcgatcccggaccccgccgccgccgtcatcggcagcctccccgaccccgccggcgccaagcgcctcgagtacctcgccgtcgacatctccgccgactacatcaaccacttcaagaaccagtacaacgcggaggcgcacgccgccgccgcgggcgtcgccaggtgctcggcgttcgaggtgctgatcgccaaggcgtggcggagccggacgcgcgcggcggggttcgagcccgacaccaccgtcaacctctgcttcgccatgaacgcgcgccccctcctccacgcctccctcccgcgcggcggcgccgggttctacggcaactgctactacatcatgcgcgtctccgcccccgccgggaaggtggcgggctcgtcggtgacggaggtggtgaagatcatcaaggacgggaagcggcggatgccgtcggagttctcccggtgggccgccggcgacatggccggcggcgacccgtaccagatcacctccgactaccggacgctgctggtgtcggactggacccggctgggcttcgccgaggtggactacgggtggggcccaccggcccacgtcgtgccactgacgaacctggactacatcgccacgtgcatcctcgtcaggccctgggcccacaagcccggggcccggctcatcacccagtgcgtcacccccgaccgcgtcgccgccttccacgagggcctcctcgacctgaactgacgccgccggcggcgaacctggactcgccggaggccgggaggatgggtggattagcgtcgcgtgattaggtgggggtgattactactgatgattagatgggtggtcgttgtgtgattagtgggggttggtaactgaattggattggattagttattaatacggaagctcgtgggtggagcgtggtgtgggtgtgggtgatgtaagcctgaaaataagcagctcaactcctgaaaatcgggggtgtttttggttcatccattcaattgaatttgggttgcatttgataacaatcttcgaattgttgtgtttacgtttacggcgttgtctgaattgtgttcccttctgtccgaaagggacaaaagcggcagaaaattctcgtcagtcactccgttgtcacagggagattcagatctattaaagttggattgcatttcatctaaaagttggattttttgttgcatttggtaagaagtttcaaattctgaattgctccattctgtgcagcagtttgtttgtcagtcactttcagacagattcagtgtctcctggatcttcagacttcagttgcttggtatactgaaacatcagctactgcttcagatcagctggcatgcaaatgcatgcgtgtgttgaggaaaaaaacacgagcagcaagcatgttattggatcgtgattgcctcctgaatttgacctccaggtttagtgggcacggaatccaatctgactgaacccattttttcttcttctgatgaactgtcagtccagttccactggtctccctctttgatattgtttcccaagtgggcttaatatcaaacacttcatgaagagatattatgcacatatatttggtgtaaaattcttaagctgatgagcagcatcagcaggctggcacactgactcacattcctcagcagatgagtcctatacaaatgataaatctgtcagctaaactgttttcagaaactatattttgcatgctcttcagtcttcagggttgcagacttgaacacttcagctcgctggctgtattctttactacttgacaggtgctatgccatctaatttttttagataatagaagctctgttgaacgatcaattatatccaggtaatacaaccgtatcgagaacaggctgtttagaaactcatgtattgtcaagtgcactaaaatggtctgatcagttttgctccaaattccagaaaggaaccaaattttcttgggaacgcctagctgcctgcagagaccgaaacaaaactattggccatttaaaacaagaccgaattaacattcatgattagaaaagccagtttgaattcgattgatctactagcatagagtatagtactagctccactgattacaaaaagaactgatcatgatcaagcattaaaagatgttatctttcatgtgtttcccagcattaacggttctgcaggagcagcttctggagtatggatggctcatccttttgtcagatagtgtccggtctctgggttggttgatcctgcatttcttcaggatcagcagctgcctactgtactggtttagcatttgaccgccacaagaagcggatcaagattccaagaaccaacgtaaataaggaacacatggaacaaaacatcgccactgggatttgtttctttctgaccacatagaaaaacatcaagttgaagctagcagcagccctagttaattgattcatctatcggctgcagaaactaaataattcactttattctgatgccagataatgctagtctagtatagttagtcagttacactatctgaaaaatctgaagaagtgcttcactgcagttcattgcttaccttcgcggcagtcagcaatccttctgcatctgaaagttcagaggatactgcttctatcaaataatcaggtagcataaaatggatcgaacggcatatcttatttactaaagaaatgtctaattctcgaaaattatatggtcatggaggggagcctttctcatagatgatttggctagttctttcatccttttcgatatatggaaatctgcgttcttctgaacaaagtgaagtgcacatactgtattttgttttcgatgatagaactgaatatagcctcacatcgaagatgtatctggacaagaacacattacactgcacaacctgaaatactcctagtaaatatgagcacagaaaaaaaattatagagttgctttattactgaaagtaaacatatcaaaccagtagtcactactcactacatttgttagaggtcattggagaaatcaatgctatgccaaaattgtttccctgacatgtgcgattttgtgctggtcaatcccaccttctacgcacttgtctctcaacaggtcacatccagcaatgaacaacctttccagtgatcctggcaatcccaggtgtggtagggagtctatgctctcacacgatgataaatgcaggctcttcagggaggaaatctggtgcagcgttgcaggcaatgagcggagatatgagcattcactgaacacgagtgttttcaatgaagtcagtgtaccaaatgcttgctcctgctctggagttaggcatatggtttgctgatccgtgtcaatcatcaaatattgaagatacccaagtgtcctacaaattggcatggtaaggaatgataaatcatcaatatgcagtcttttcagtgaggcagtaattctgagatgtgatccctctgcctcttcgacgagatttttccatccctccatgaacttaggacttcttagcacagtcagttctgttagatggatgagagttttcatacatttcaatgtcgtgagctctaggcaatcttctataatcaggtaatccagtcttaccattgggttcagctcaagggaagtaacctgggggcagtcctttattgacaagcagtcaagaatgccaacatttgataaaatttcatgtagtacatcctcagatatcccagaaccgcatatcttgagttcactgatgttagacagtgaggatccagaatcatccatagtcgtcgatacctcagaaatatcatgctttccctggcctttcaatggtagtaccatgaaattatcacaacctggtatgctgaaactcttgaggctcctcaagttatgaaatggcagaaataattgtctttccagcaccaaatcagatatgccagaaattacaatctcttcatcattcaactccatgagagagattatccctgcatttttaaacttatccttgacaacgttgaagaatgtggaagtggaggcaattgatccaggctaggacagttttggatgtcnagcatttcaaggcaagggaaccatttgtagttgacttggtcagaccattgctcaacaggtagcatctgcaagctgggacagtccatgatggtcaatgtcagcaatttaggaaagaagcattctttctcaaccccacaccatgatcgccactctagcatgttctcaaaatgcaactcttctaaacaagggaaacccattaaagagccacttccatagagttcaggacctatgcttaggatggaacccataccagtgaaatgaagtctccttagataaggaagctgtccaagaggaggaagcatttcccatccggagcaatcatgtaggtagagggactccaagtatttggtatgtaaatccgtagctagccatgttggtgatgtagagcctctataatttattatcctgagatgtctgagatttggatggggttgaagaccctcaagaacacttatttctacgtcactgcttctacttttcaagttgctattccaaagtaaatttaactcaaccaggcggtatttttctcttactcctgaattacttgcttcttccttgtttcttacgttctcaagatccccaatggcaagagattgccccatctcccgtaactcttttagctgctcgatactaaacccatttccctttccaacattgaaacagtccaactcctgtaggctggtcagcttcccaatgtaagaaataccagcataaccagcaagcaacttgcttgaagcatcaactaatagatgtctaatgctaatgagattgttaacaccagttggcaatttaacaaggttcttgcaagatcttacatccagtacctgcaaatggcaaagcttgcgtactgattctggcaactcagcgatgtctgagaacctgagatccaagtacctcaaatgtatcaagtcaccaattgttaccggaagggcttcacagtttatatgatgtaagcatagcatgcggagattaatgattcttctgtagttaatagacatgttccaaaatccatcatcagatgcatcagacaatgaaattgttggagaatccataaaccatatggtccttagattattcaactccaggggacgaccaggtggtcttctctcaggtaaactttcattgctcagtgatccatactcgatcagcgagaacttatggcggaaaaatttagcatggtccggagaaaggaaatacaagtggcggaccacatctgggataccttcaggcaaattatcactggtagtgaagcactcatctttagataatgaacttgcaaggtcatgcaataagtcgtgcattctgtaaaggttgtcatttgatgaaacttggaagaatgaagcagatgccaattcgtataggtattcccgtgctgtatcctctagtgttttgtctctcctcatgcactgaataaaaccatgtgccatccaggaaaatattagctcctcttcacagaaagaatagtccttggggaatgctgagcagaatacaaagcaacgttggatgtttgcaggcaggtgttgatagctcaagagaaggactggcatgatatcttcaggtccttgtctcagctcccataagttgctgtctaatatactcatccagtgctctgtagtaagttgcttgtgcaacagctttccaatagtctttgcagccaaaggtataccattcagcttgcttgctattttcctgccaatcaaattcagattatcaaccatatttgcatccccaaatgcgttttgtttgaagaaagaccagaaaggactgtcttgtaaccctccaagaatgactgaaggaattgtgccaacagtattagctatattgtgatgccgagttgtgattatgattttgctccctggtgtcccagatgataagggggcacacaacagttcccagttactgcaggaccacacatcgtcaagaacaattaggaatttcctcttcttgagcttcttcaccagcatggtctgaatgttgtttaaactgagcgaactgataaactgattatgtccttcttcatctattgattgaagtatgtctatggttacctgtttgacatcaagaaatccagacacacatgcccatgcccttacctcaaaacaagtgatggtagctagatcattatacacatactgcacaagggttgtctttcccacaccaccaatgcctacaactgggagcaccaagaagctcttgtacctattttgaatatttgaaaactttgtttccaggagtatctttacaatggtgttcttctcctcatctctgccgtacacctctggttcagtcaagagtgagctggtttgtcttgagtttggaaactttggttgctgcatatcatcagctaccaacttcttgaactgagcaacacgctcaatatgggcggtagctctttgtagacgatcggaaatggatttcatcttgcaagagactgaatcccagtcacatgacacataatcaaaggttggtctggcttttttgaatggagggaaaagggaggaacctgaaattttagtaatgcatgttaaaaggtgatatatgattggaattgtatatgataaatgaaaaggtgataaaatcatgagctaccctaggtcatcctaagcttaaatggaaagaatgctgcaactaactgaataatcacaaaactgtgcaccttattagtcagcaaggaatgttaaaagttttctatcggtttagagtcgtcttctcatcagctgttagtcatcctaggctgcaaaatatttttgcagatgccaacttctccaaagaaaatgaaggacatatgaaatcagtattatgtgttgtttacttcacatatcgccttgctatagtcctttcaggcatgtttggcaagagtccatcctttcatttgtactgaacattttgtttcttattaaagaaaatgacatgcagtctgccttcatgttctcaaaagaaagaaaagttgtgaatagtatcacacacaagaatctagaatagccccaacatttattatgtctgttcttgcagtaatccagcacttgtcttgctcattgcctagtggcccataaagacctatataatccaaggtaagtacttgtaaataagtttcatctagtccaatccagtcaataaattgtatgatctcagtatttccactatatgctacaaaagttaccaaatgattgggctgtactgctgtatagttagagaattcctagtcttttttaagcatagtgatagttcctaagtttcaagaaacatatcgaaaatctcgaacatatttacaattcaacccaattgaatttcatccaaaaagttgaacatagatgcctgattctaaagaagttcaatttctttatctcacatctaagtttagtggagtcaaaagttctcggaagatgagtacctggctggtcaaaagtgttccgaagagctttaggaattgataatccaatgctagcagcaagcttgttttcgcttctgttgtccactatttccataaggcgaaagtagtctaactcatcaagcacatcctctgcatcataagctgaagacttcaaatcccaaactagttgccagatgccctcctccatcacaggactgcctttcagggtcataagtattgccttagccatatcaagctgacgacagaggttttgaaattcacctcctaagtttgcacgatctgcccactgctctaacttggagcttaggtacttgtcgaagattacttgcatgaatatcccaattgtgctcccaataatccctgaatccatggcaggctgaagcgaagagggctagaagatgattcctttatctgtatgtgttgtgtgctatggagatcgagtttacaagataatcattgcttgcaaccatgtcgagcaagaaaacaagtccactacccaagtcaacaaaacataaggtagtatcataaagagccaaatagtgataagacagctggctagttgggtggttggatctaacttgtaatagaaaactactgtgctgacatggacttatgctgagaccatgtagccaaacaggcttgtgcagtatgctggaatttaacaggtgcatgcatgacagtaaccatcaactaatagaaacttctgccgtattcaaacttttcaagttaaaaagatgtttttttccctttttttaataatgccatagtcaagctcgtcattttcatttgctcctcagtattaaacaaagtggacccccttatccccaatatggactgcctagtcgatccgtcgaagtaattcgaactcaagaacagaaaaaaaaaaggagagagaactgcaattcagaatatctcccttatagtgttttttttagggaatacgcagaagactacttgcacacctttgtattaagaagaaattgcaggatacaatggtcgaatttgtcgggatcgacttacccgaattgatttaactacgcgccacggctacagcgtgcaaatctcccctagtatgatacaagcatgacattatggtgctactaacagctactatcgtctcctctacactacgccaggcgtacgacacgcttcatgaatgaaactgaggtaataaatggtgaagaaaagccatgcgaaaactcatgagctcgaatgcgcttaaatctgattatctgaagatgacagaacgatatccgtacctcatcacgagtcgaatcctgcagaaactccgcctgaaaattagcctcgaaaggtctttgaggcagtagcgcatgtgaaccgccgccgcagatcgatctggaccagctgtcctgctccaagtgactacgaatcagggattccacaatggaaaatgcagccacgcgcgcggcgcggggagggagggaatacctcacctcggaggggaggtgccacggcggcttcgacggcgacccccccctcggcgtgctgctcctacgcggcggtggccggcgggaagaacctgggacctgggagcgtacctgtcggtagccggccgccgccgcgccgcacggcccacggggccgggggaaggcccattccggcgacgcggcgtcggccttccacgtgagggcccacctgacagtgcgagaggctttcttgtaggaatccgtatcagctgcagtcgctactgggactacaagctctgttaggtatcccattttcccgttttctgtgcgcatgattttttaactgttaaacgatacgtttttttacaaaaagtttttatacgaaagttgcttaaaaaaatcaaattaatattttttttaaaaaaagctaatacttaattaattacgtgctaatgtaccactgttttcgtgatcactgttccatatgggaacaagaatgtgcgaacacaggcactaccagtttgcatcaacggatgcagatggaacgtccagatcagcgaggcgtactgttcatcatactgtagcagaaacactgcagcacataatactgttggtatggtcactgtatcactagatctgagccgttgatcacagaaatggaaggctgaaattgcatgtagttcttaagttgcagtcatagctataactgcacctgatctgaatacttcttgtagcttgcagggtccacctgtcggggctagatctagaggaaggattgagcaccaaaatccaaacgaaatcctgtaaaaaaaaatccaaacgaaatggatttaagggtctcatatttttgcttatgcttatacttattagctaaaatttgatttaatcttaaatttggagctgatttttaggtcttctcatcgaattttattttccagcctttgtttttagatcgttaagaacacgtatataaaaattttattcataaattacttttcgtttacaaatataccgttttcgattattccgcgaataagcaaaatgatggttacgtaaggccccattcgaacaagggacaagctgccatatttttcatctaaaattctgtacaattgtttttacacacaaaaaatgtatatctttatagaaaaaattcaagaaatgtcattgacaaatacccaaatcatggaaatatcatcgataagtgcgagtttcataaaatgttatcgtacaagtgattttgtccaaaaatgatattatcgttaaggttccgtccaccccgctcagttaaggatactaacggaacgctaacaacgatgacacttttagggcaaagttgcttgtatgataacatttcatgaaacctgtacttattgatagcattttttggaatcagaagcttgtcaatgatatttcttggattttctcatatttatactgtaaatttcaaagttacattataattatattgtaccttttctaatacacaacaaaagatataaagagtaaagaacagatttatgaataggcacacatgtaagttccaaaccacaaaagcaaaggattatatccgtgtactcacaaattaagggctaaaaatttgactctaatctaacgaaaaatctgttgccacttaaataaaaaaaagaaaagattgccataattttgttgaagcaaataatttgcgaacaaattttgtaggattcaaactctattttttttcattttgtttctctgaaacaaatggttggggctttccaaatcctaaaaacatactaattaaatagggaaatctggatgaaagttaacaaaagctccaaacctcttgaaaaaaaaaacttttgagtttatttctctcatccaaatcctttgttttatggaatagtacattatgaggctgagcttgaatacatttcttccataacaattgcctctaagttgttactcccgccattttggagtaattgtcgctgttgactaaaattatctcactttaatcataaattacttttaaataagtatattatgataaataaaagttgcatggttatatttacgacactatatgcttcaacaatatataacatattttgaagcatttttttctgcacaagaatatgagcacatatatttttaattaacacccttaggaaaaacagatgaatagacaataagggaaatgagaaaaggagtctttgatagtatcgcagtaaacaaataaagcaaagaaaagttttaaagaggttagttgatctcttacttgttttactatgaaattaaactatagaaatgcaatcctttagaaaattttctatcctttccaactaactaaagagttccataggaaataatcttaggaagttgactcctccacaagatatatatatatatatatatatatatatatatatatatatatatatatatatatatattgagtgggacaatcctccatttcgaagggccaaaaatcagtaggaatttttttccctcgacacaacgcataactgaactgttcgtcagtaccccaccacaaaggtgaccctgcacgtaccattggctgggcatgcatcacaggctcacagcacactgaaataacaactcatgcgaacttgtccccatatatatactccttccgtactaaaatacaataaattttgggtggacatgatattttagtacgaatggagtttatggacgtcaacaataacagaaaaacaacatgaagaaaaaaaatgatagatcaattaattgaatggaatgcacacagacaattgcttgcagtgcatctgcaacgaaaaataaagaattcttcagaggagtaatatacatgcagtttcagttcatgtacacttgagcaactagttctgttcatagttgcatcagctaaccaattaagtaagcatacacactgatcgattctctttctgtatatatatactgcgcattcgcctcactgatctgtatatatatactgtctcgttgttcgatctgatgatggaaatgggcaaatggccaagaacagcagaattaagatcgagctttcttcagtcggagtcatggttgtgccaacagaggagcatggagacgcacctcccgaggatgtacagcctcgtcttgtgctccttcagcaccgcgttgcaccgcccggcgagccccactccggcgcagccgccgccgactaccttccctcgccgccgccgccgtggcgttggccccatcgccgacgaggaggacaggtggcggtacgccgagcagactgaagaggcggacgatgagagctccatggagaagagatgaaaacgaacgaagaatgtgtttggtgtgtgtgggggtttgcgaaacgatgaggtcgcgatccggtggtttaaataggcgaggtgatgtggcacaggtggaggtagcgagatgacgattctacccccctgggggtatgagacgacactgcgggctgtttagatccctcgtaaaatttttcaccccgtcacatcaaatgtttggatatatgcatgagtattaaatataaacgtaaaaaataaataattacacagattgtgtgtaaattgctagacgaatcttttaagcctaattgctttattatttgacaatgtagtgctacagtaaacatttgctaatgacggattaattaggcttaataaattcgtctcatagtttacaggcggagtttataatttgttttgttattagtctacgtttaatacttcaaatgtgagtccgtacatccgatgtgacacgctagaactttacacctatagatctaaacaccactgagaagatgtgatagtagcaaaggggtaggatggtaaaaatggagtggggaataagagaccggtcgtcgccgtcgccgtcgacggcgtcgagacagatcggtcaaaggcatgcatatgatatatacatgcaccgtcgtcgtcaggcgagcggcggtgcaagcaacgcatgcacgcgcgtacgtacgacgtccggtccccatcccgcgcgcccgccaccggcgtggcgatcgagctagctggcgatcgatcgcggcggggcggcgggcggcggcccacacgggtcggggacgggagagaaggggggggaagcaagctaagcgtgcgtcgtcgtcttcctcgtcaccggcgacacaccacgttgccgcgccccagctagctagatggccccgcgcgccttatcgcctcactgtgcacgcgcgcgcgcgcccactgccacactacatactcgtacacgctataccgctagcggtaggctagcgtatagcttactccctccgtccaataaaaaatcaacctaggatcggatgtaacacatcctaagggtatgtttgaaggagcttctagcaactacagcttctcctagaatttccagttgccagaagctcccctaaacagtctagcttcttacctagattatgagaatctgtagttgtagaatctgtagttgccagaagcccagcttctccaaattctcatcagctagcttctcagcagctgcttagaattttaaactccccaaacaggccctaatactacgaatctagacgtccagattcgtagtactagaatgtgtcgtatacggtactaggttcgttttttatgggacggaaggagtatgtaggtaggctgtagctgctggctgcctgctttcgcgttgttcgtccaagacgtttatttttttactgtactttcagttttttttttcttcttcgaatctgcgaacctttatatgatagattttttttaacctttctagggatatagttttaattctccccaagttgaatccgcgctaaaatacgtaaaatattccttctccagctttgaagaccggcaatgattaatttaatcggttagaattaacgattcgggggttaattaaggtcagggtgagagaaaggaaagagctaagtttattgggtttagagggatagttgtggaagatggtgagcaggaaagggcgaggcgaagcctcgtggtcagttgagggcggatccaaaaaagaaaaaacattatagggtgactcatctccctcttcctcccctctccactttggtctccctcttttccccttctctctccttttataaatggtgatccaacgggatagaaacttgagtatcccaacacccacgttagatccgtcgctgtttagttactagcggtgaaccagggttgaaatggggagtggggtcccgaccagtttggaggtagggatggtggtgcccatgagccatgaggccgattgagggatggtaagctggggcatgaagaagcttagcaacggtaatgcgggcttgagtgaagcgagcaacggagaggaaaggagaagggaagggctagttaaaacgtagttgcacgaattatcaaagcgatattactgctctttttttaatagatgacgctgttgactttttgtcacacgtttgactattaattttattcaaaaaatttacataattataatttattttgttgtgaattattttatcatttaaaatactttaagcatgatttatatcttatatatttgcataaattttttaaacaagacgactaaacgagtgatcaaacatatgtttaaaggtcaataatgtcatctattaaagaacaaatggagtatttagaattcacatgatttatttctcttttacttcctccgtttcacaatgtattaatgtcaatatgaatatgaaaaatgctagaatgacttacgttgcgaaacggagggagtatttcccaagatctctgaatcgatttcgaacacgcaatgcatgagctgtgatcattctcctcctgatggaacatctgtcgtcgtgtgctcactgctgcgcacgcacgtacgcaatgccctgcccacacgtacgtacgtacgtctgccagccagatatactacgcatgagtgcatgaccagcttttgcatttcgcacgagagatttggacgtatcgctgctgcctggtggtggccggtttggaccggcggcagtgagaggcgaggcccagtagcacgttgcattgggcccatcacgcactcatgtgcacagagacagtgtcacactcacacacacatgcctctcttccatctttgaccagattcagactacaccctctttgtcacctacctaacctcggctcactgctcaatgaccaagcgggagattaggctctctctgctctatcctattttcttagccaagtgcagttgcgtttaagtagcacgccccccccccctttctactctaccttgactattgaattgaattcaaactttaattgccctgcttcattcttgccatattgagattctatggaagaaatgaaacgttacccgcctacttatacttcataagtgccaccaatctcgttcaggcactaaactagtttcggggaggatggatggttgtcccttcttctcaatagctgcggcacaacctgggtgtggagacagtttgcatgggttcgtgcacagatttacgttcaataatccctggggctttcacttcgacacgtcttcgttcgtgatcgcttagagccccttttccatcaataggtactcccaaggcgtcgaccacacggcctaacatggcctttcccgcaggaacatccacaatagatccagtgcgcttgacaagatctccttctttaatagcggtatcactaccaaagacaacaatacctacattctcattctcaagattcaaggctattcctttcacaccgctggcaaattccaccatgggtctattctgagaagcagctggttggtagcctgtttttgagaatctaggaagggttgggtttctagtttctaacttctaatttattttctggattatacaactacaacttatcagaatctgaatctaaaactggagaagctcccccaaacaggccgcccatgcatgtaagctgatgtaacgaaaatgtatatcatctcttgctattctcatttggttattcttctttagttccatctgaaggaaaacaataggaaaaagacagtacatcttcattcattcagacatacgacaacatgatatgtgttccatcccatttgattctacattgttatatttttgaacaaatggaatatttttttctttttctcggtgattgaaatttggctcgaaatttctgaaatttaggaaatcccgggggacacagaacgatttcgtatggaaatttcttttttttttaaaaaatattcaatctaaatttgttcaaatttaataaaaatcccattcgaaattcctgagatgcccccgggcataaatacgcaaaacgaaattgcaaatgtatgcacccatagttgccagttggcatagaacccggatgttttcatcggggatatatatgatacagctactctcttcagtcttcaggtttttgtcatctgatctctctgcaccaagatgtgtactacacttcttgctgatcttagatttgccttagaagatcaacaagaaggtgagagggacatgatggagtggttgccaatcgtcattagctgtactaccactgcctgcctgccctgcaaagtctctctccatcagagcaaacaagagaggaccaataattggagatctctctctctggaggatgaacagacaaacaaccatgcattaatccatagttgctttaataattcagtcaatgaataaagttttctcccagctaccccagatacaagttgttggatctgcatgcaagcatgctactaaaaacataaacgtgggagtttactcttctgttcttccattctcatccaatgattatgtgggctcaaatgattatgtcatggtaatatcatctataagtgttgcattacagtagaataaactcaactgctaatctgtacttgctcaagcacttgatgagtgctgggagatctctgcctactaactgaatttacaaaatgcaggcaaaattgatctgatatacaatggagatggttgttttctatacaagggagcagatacaaaggggaggggattttttcctaaacaaggagataattacattgaacctccccggttgaaggttaacctcaacaacctaatatgctcaactcaggtgatcatcatgataactattccaacaccatctataatctgttacagccttacaggcaacttcagttcagaacaaactgcaggcagcaactcatagccatagcctcagcctcataggagtttctgggttaacaccagagagcagtgtaggcaaatgctctattcaagtctgtctgaaaaaaaaagggacttgagaagttgcatgccaatttgtagattgtcaagaatgtgttccatccccatgctcatgggaaagggcatgagagcagctactgttgtgactcgacgtcgttcctgactctgctgttgttgctgtcatggctgctcctggagctcgagtccggagcattcgtcgagccgcctaagtcagccttgcaaagagggcacagtgcgtttatcttgagccatttatcgacgcattccaagtggaaaacatgattgcagggaagctcccgtagatcttcgttgtttgagaactttgacaagcagatgcagcatacctgcagagcccagagatccataggtgtcaattgcatatgtggaaacatgctacagacgtgtaaacatgagcatagtatatcccaggtttggtaaagtgtaaacaggaatgcaggaggacactcacagcgtcttctgcagaaatagttcgctctttgtctgttccagctgccaatactccaccattatcttctcccgcttctccatcttgaaactttttcgattggaacttgtatgccaccaaggcatcgattgcttctgcagtagcgcctctgttaaaatccaaatcctcgtggatgcccatcatggagataatgcagggtaggcagcagcatatcattgtacataggatgaaaggcagggcatagccgatgaagccgaatgcaaggaatactatgcacagcctgaaaaatgatcactaacaaatgagtaaacatctaagttgagaagcaaggaacacattgtctatggctgcttagcatcacagacctgtacaagttaggagcgtcatggagagaagtacggcccccgaatatccacacattcccaacaacaaaccacacagcaaagaaacaatccagagccaatttgaagcacgcaaccaatgcgtagaccctataaagcacagaaggcattgttacctcataaatgaatccaaatgttagttagaagaaagaactcagatggtttcatatgatgttgaatcttctagtatccagataagtgacctaaagtgttagaaatactgaaagcccaactgttttcaatggctaccaggtagacagcaggtgcaaagacatcatagtaaaataaattgctaaagatcatatgaaatttgataacaaaaaacagatcttctcaaatataggcggttgctctgccatagcatatcggtggttgatggttccacttaaacaaacttatgagcctgagagtgagaggtagtgcagtcaaatatactaaagataaattcccaagaaagataatgctaccttggacttgcaatccttgctactccaccattattaccactgtccacaacttctgatccatgagcagacgaaactactacataagaattaggctcatatacgtccctttcagatgaaacctgatttgttgattcttgctctgtgttctgccgattgcggtggagaaatcgccaataaaggtgaggaagagtagcaacacaacctatcgtataaccaataagccactgagccaaaggagcatgaggatgctcgttccttgatactgacaggacagtaatagctgctataatctggcttaaacttacaataagctcaattgagatccagaagccagaattcaaaggatttggttgacggtgtccttgatctcttcttgcaaaagaagcgtttcgggagatagatgcaggagttgcactagcagaactttctgggacatgaggaacatcatttagaggccctctagtttggtgcaactcatccaagttattatgattatcctgatgagatgttgatgggaaagttgcatcatttctcagtatgtcgatcgtgtgatcacgatgactggcatttccagagtcccccatcagtaatggatgactatctgcctgaccttcgcactgtggcccaacaggacggacagcaataaactagaagtttactccacacattagtttcaggacattcctagatatgtagatgttttcaattgaagttgcctttttcacacccttgcttttagtgtaccttaaggaaaggaaagtaaacaaggtgtcaattaactgcctgcctaaacaaagaaagcatgtgtgcaaggtaagacatcatatattgttggacaggattagactagaagggaagatcatagccagaatttaaaaaatactccctcttaattcttatttactacttgttatgtagggcattgaaatagtatgacatgtttgatcattgccttctctaataatatatctataataattatataactaaatgaaattattttcatgataaatctaacaatgtcatttttacatataaaatattaatgttttcttaatatattagtgatttaaaagatttcgagatttgattgcatgtattctaaaatgattatagcctttcccttaggttagaccaatcatctattctcggtttgcattttacattacaagttacttatattacagaatcaattatttcatcaacatactcctgcaatcttagaacttgactgcagatcaatctttcaggagtaattcaacaagtccattaaaacaattccagtggtaaggactcgattgcccccgattagaaagcaacctagttaaaattggattagtagaccaatgcaaatgcaacacaatagcagccatccattatttgcaactcaagaaccttacggtgatgtcagctaatacacaaatgaagcactcagcatggagaaggaatgaacaccatacctcaatgcctcagcagcaaaggtccctctaatcaccaaatctcagcaattcatcaattctcctatttcacctgaacaaacaagaaaacaatgtggacagacagcattggggagagaaagaaaatcaaacagaaccccatcccacaagcatttctatgatcctatcccattggccaagaacccaaatcagcaagaacataggtttcaaaaaaaaaaaaatcagcaagaacatggcagcagctcgtggggatcgaacagttcaaccaagaacgcaagcgaaatcggtggattcggtagcctacgctccactgaattggaactcaccgaagcaagcaatcaaccaatcaatcaatcaatccccaatccaacggagcgagaggaatccggagaaaaatcaaccataccaggtggagatcgcagcttcgattcgaggtagctctcttccccaatttctctattcctttttctccttttatttttcttacgctttcttctccccaatttatctcgcgcatttgggggctctttacttaagtaggaatccccccaggtcagcggtagaggatgaacaggtcgtcgtgaggtcagcgagggaaatttcaacgacacgtggagctcatcccggccgtttgatcagcccgggcgacgagatcggacggtcggggacgggctaagttttctcagcgcacgcgtgcagaattagaaggtttctttttagaattttttttttgttacaggcattttgattttcatcaaaagcgtgtgggattaggttgttgcaatagaggttaaaattacaaaaggtaatatttgcttggctaatgttaggtgaagctttttggctcgtggggaaaacacattttcctcgttttgttatgagacaaataaatacgtgctggtaaaaaagaattg

SEQ ID NO: 69060 - DNA, 1381 bp, Oryza sativa
gaacggctaaatggtgcattgcatggtgcatgttattcaaatactttctatatataagtttcttttaaaaaaatttcatttttttaatatttaatactcaattaatcttgtggtaataatctatatcatttcgtgtgcatggataagctcacttaatgagctagatcgaacgaagcctaagtaggacattaaaaacatggacatgatatcaaaataatatagttgacctttaatttctaataatatataaataaataaaacttatactatatgaaaatacgttcatgataaattttgtaatattattttgatgtaacattattttttttatagtagggagtgagtaattttaggaattaatgttactcacaactggagtttttttttttgaaaatacaaatctaattcaacaaaacatgttattaagtgatatacaattatataactatataatgtatattattcatttatttagattatggatatttcgatgacatgagtatagtacaatacaactgaaaaaaacttatatttgtacaactataagctggaactattaattggtttttatctcatgtgagtgaaaaaaggaaaaaagaggatggacgtggggcactttgtgagaagtacatactcctatgcactcctaagaactatatgggctggaaattatgtattttgttttttatgttaattagtgagaaagaaaaaaaaagaaaatgaggggcatggggcccacgtacaaaatatgtacgtgcatgcacgtacgcgtatcgatgtacgggagctgctatggctttttgaagatatatatagttggtttcttcagctacatctaacggttaaaaataatggatccaccagattaaatgaaaatcaatggttggatgttttgtcttttttttcttataatttctctaaatttctctaatttataagagcgacacatggcggtgtaggagtgtttgtagggtgccacatggcggtttgggagcgtttataggaagtttaatttacttttagtagtatataatagatagatagatgtgttgtggggttaatatttggtcttgctagtgtagataacatctttatcaaaatcaagataggaaggtatatctaattaaaaatctcattaatgaaaaaggacagctcatatttgtatcttatttttttaaggacaaagctttaacctggtatgacctaagaagaaaatgggatgccatccatgtcgtaatggtcatccatgcatcttttcccctgactctaattctaagttatacccatagatattattatatatcggatgttttttatctagggatattactatatgcccgacatccgactaaaacgtatagatggttaaaatatttcaata

SEQ ID NO: 69061 - DNA, 558 bp, Oryza sativa
actaaagatattttggaaagggactcaaatactaaatattttcatttggtagcaaatggtaagcataggaaaacaaggatttataagctacaggattgtgattgggtaatttatggtgatgcgaatttaaaggcgcatatcaccacttattataaaggtctttttggctgtcttgaagtttcttctttaacgttagatgaaagccaaataactgatattccacaagtttctcaattagaaaataatgctttagtacaagatttattttttgagaaggaaattaaagatacgatttttcaaatggaacataataaagctctgagtccggatgaattcctagctgagttttatcaggttttttggaattttattaagtccgatttggttgatttatttaatgattttcatagtggtagtttacctctttagtctcttaactttggttactgcccaagtgcaaagaggccttgaaaattcaaacatataggcctatttgtttacttaatgtcttaatgttagtttgaaaatttttactacagttgctacaaatagaatttc

SEQ ID NO: 69062 - DNA, 561 bp, Oryza sativa
agggccccgcgtttgcacgatataaatatgtgtgtacaagtaaatggcgcagcactgtgaagagcgacttggaacggttcctcgccgagttgctaaccaacaaaaactggcggaatgcaaattaaagcatgggagattctataatgcacaggaagtaataatttcgcggcgtgattaggcaccaaggaagctgctgtagatcgttaatgtgacagtgaaattaattagattaaacgtgctgctctccggtgtttggccggaacggcgcatgacgcggaccaccgaaacttggggatgcagtcggcactcgcactggtgcactgtcacacaacacgtgatggaataaacagggccaacaacttacctccctagtacagatctacacattattcctgatgaactatccatgtcggattaatgactacagcagatgacccatcactgatagaatgtcaactttgttggatcctagtctaacacgtctcggataacatttgatgggtcacaaccatgctccgtcatgtataacaagtcatccgtaacgggtgtagtgagatgatt

SEQ ID NO: 69063 - DNA, 9958 bp, Oryza sativa
cctgacaatctgggcatattacccttatatttggatcctgcagttaattttctatgagataaacctcagggtctttagggctcaatatagacagatgattgtgctgatattaaggtaatgatttgatttcatggtgcaagtcttttagcctcctatatggtgtaagctccattattctacgaatcatattgtaacctctacattgggtcaatattaggtctataagtcaaggcagtaatcacaaattatattgtacatctagcaaacaaatatttatttggcttgattgaggatttcagtatttttaagaactttactagaccctaattactacattttaaaatcagttcaggtcctatgtataacaagctaacatttttcttgtgctatacccatttctatatctgctactattatttaatatgtaatggaacattgatttcataggttagcattgtttgcagggtgtttcagtaacactgaaaccatggttgcttgagaggattaaagccacagatacttctaagttctaacctgcatagtaccatcctctgttgatctgtgtagtccataccgattaactgtacatatgtgctattccaaagaatccaatccttagtatctctagctatactgtgttattctcttttctgctttgatcataaagtattgtttcaatttattggtgtgtgacgaagtgacatgcacttcaaacaattttagatgagacatgtcatatgttccaatagggcacactgccacactggggtgtaattttttcttgacaagcattattcctactttctttctttttttttttgcagcgctgcactgtattggaattttctaatgacccatccttccagattgaatttttgctttacaaatacacttgtatagttttcattatatgctgacttcaaaatatgattttattacttcttttaattcatgaaatattatgtttgccccttatccaaagccacggagatatttcaacacagtttcttagacgagtatttgtcctacctgccatatattcattgtgtagcaatatatggatgacatccaaacatgccctgtattctgtaggggatacttcaaaattctgtgccattatgcaaaggaggtaccactcatctactaatctgttgtaagtacatgatgtgatgtactgttgtttttattgagctaaagcactaaattgttctctgtactgcagtgctatagatgagaaaagattcaattagttcatgacgaagatatctatgagaaaatgttgtcccaaatcccctaatgattgctgttttttctaacctagcccacatcatgtaagatccattgtcctctgtcattgctacttttctgtaagtgtacatgattgtataaacaattatgtgagcaaacagatcatattcacatttgaatcttggtgatagtcataatgtgtattagtgtatgcatatgtgggtatgcttctgacataaagttcttttagacgaatgtttatatataattcttaaaagttacaattatagatactgtgttgttttgatcttaataacacagcttgaaacattcatacccaggcacgcaacttagtgcgtgattcttgctagttacttgtaaagtaccagcgaacagctccacgccgcgacgactacacaggatgtccagggatggacatggacgcaaggtggagcacgacagcaatcaacggaattttatcggtggaatcagacacttcaggcagtggttgaaaccgttcaatggctgcaatcaatagggagaagaccagatgtggtgccggggttgatggtggtagaagcgattggtgatccaatcggtaggttggacacttcgggcgggtagcctagattttccattgagctactctcacccagggagacgtgcggccgcacgcttggggttgattgaagctggaggcaatcggcattcttggtcggtggaatcgaacactccggatggggtggtccggacttttcgatgagctgcgttcgacaggtagatggttagacgtagcgcttgggtcgttcggcggctgggaagacggcatggtgatttgttggctgactcgcgaccatctaattccactacccgcataaaaattcactagtttatttttcatatgatatagtacaaaatttgaaagaaaaaataaactagaagtaagataagtgggtaaaagaatcccatttggcagccataggtctggccttagatggaagaacctgacaatggtgttttgcttccttgttgagggtaacgatggtgcgtaaaaacgtcgttgcctttctagaggcgttgttttaggagagcctcttccacagtttaagtattgctttgatggagtttgagattgaggatcactcgtggttgtggtttgggtttgcggcgatttgatatttgttgtcatgttgtattttttcttttgtctttttaatcatcattagagttattatatcatcttggtgtaattttctaaaatcaataaagtttccttttatcttacaataaacttcagaatctccggcccaacagggtctatgcttataactcagggagccatccaactgacagcaccacctttgatttccttgctaagataatccaaaattccaaatagtaatagaatataaatatacatactctccagggtctaagtgcaatgttctccatacttacaacagtgcaagattttgaatcccctgaacgcgagcggcaacaaccaaaattcaagtgaatggatcaacccatgtatacatgggtaccagtggtgtaccagacttaaccatgaaaccaatcagatcaatcagtgtagcataaaaaaagaatggcttggtccattggttaaacagtggctcagtttttctggtaaattttcccatttcttttgtccgtaacaacagatcatgtaatctttgctggagtaaaaatctaaaaaaagaatggctacggaagctgcattgttttctgttgctaaagggactgacaactgataactacaatgacagaccaaagtttcgaatgatctatcttgaagagtataggcaagataccaaacctcttgttcaagaactgcatttgaacagtaacgttttcatgactagaacaacttcctagctctgctgtcagttctccagtctgaatcttgcatggggagatgttcatcagggtatggtacactgccttgcctgcgaagttagaacctttcgcattatgtactgattcttgctcagcatcaggaacaagatgttgtcaaaaccaagagacaccagacgacgatttcgggctatacatgggtgcaccagaaaacgcagggtatgaaaaagggcccctacttggctggtaacaattccttctcgagtaggccaaacatcttcttgaggcgagaagatgcactggatagtacctcttgagcaatcttctttctgttcttgcagctctttaaccatgcgatcccaatagacacttggacattgcatgccttgggcttggatgagatctgctccaattggtatcgcatatgcagctgtaaaaaagttaagagggagtgctgctcagtcatgtgagaaggaaagtaacactttcagttgtaataagatgaccaaaaagatgatttttcacttgaaagtagagaccaattcaataaatctgagactgccttcttttctaatttcaggtgaaatgcatatttgtttaatgagatcttctgtatatggtaatgtattggttttccagaatctggatgaacctctttaccatagtcaccattagtaattggacgtgtaaataaaggtgttctttgatattatgaaatggcaatgaacaattctccacaaccaggatgacatttatcagttactgtagtactccctccatttcatattataagacgttttgggtgtaagtcaaacttcttcaagtttgatcaactttatcgaaaaggatagcaatatatacaacaccaaattagtttcattaagtccacccttgaatatatttttagagtatatttgttttgtgctggaatgctgctatatttttatgtaagcttggtcaaacttaaaaaaaaatgacataggaaaaagtcaaaacgactcataacatggaacggagagagtagttcaattgaagataccacagaaaaccaacaaggagcaaacgaatggtcaatactgcagtagttattggcgtagcgctgggtttcagctgacagtatagcttctcagatagtcagatgaaccaaaataggggaaactatgtacagttgtggaaaccacaccttaggtggaaacttggaaactatcagtattattttatgtaaaatctaaaaaaacaaaatatagagaagatggtattagacagccatataaaatttcaagagcaaactcgacttagtttgagataggaagttaacaaatggcgaagaagaaatgctattcctggttgtctttttcttcactactcacaaacaaagacggattttttcttgaaattttgcatggttgtctgaaatcatcttagctatgtgatatatattctttttatttttttaaatattttttttatctggtttccatggttaccacgtggatagtggattagtggtttccactatatatttacccaacaaaagagggaacttgtcttgttctgctcactagtttaatcaaaatttggttttagttactgacacccatattggaagtttatttagtacggactaaatcctatttttatgtaacctcgttttcataattctgagacccaaacagatctctaggagacacacaactctcttgtttacatgactacaatactaaattaagggcataggattgaaatgtacataataaaagaaatagtataagccatgaaattgtcacttacgttgaagtattcaccaactggaataccttcaagcgtcatcacttcttcaacaagccatccatttttatcaggcaaaggggatttctgttgggtgctcattacttccccttcatggcgtgccaatctcttgtcgaacttgtaatgaatttgcctctggtaagcatcagctctgacggactcccatggtgaaactgagtactccatacagccaattttctccatcacttgatgctccaaaggaccaccctcaaatatgctcatgagtgttgatacctaatgaaacatacaagttggctacaatgtaaacttatgtttttctttttcattctttttgcagcatagagattgattgcagataattctcaggatggaataagaatcttacatcaaaaggttttgtagatgaaaatacttctgacatttttgcatcctctattcctaagaaagaatcactttcattattctggaggtctttcatttctgattcttcttctaccagctgtactttttgttcaggggtcaaggaccttgccttccagagcgccattattgttctgtaaaccgtgcaaagggaaatttgaaaaacaagttaccaaaaatagtacttaataggtgagtaaatagataaaaaatcgggcctcattgcaagaagtttttcatgtaatgaacagacgtgcttgacaagacaagttcatgttcgtcacccaagaagcagaacttacttatgtgccacattgaacgatacaaaagactggaaatgaaacttgagtcggccttcattatcaagttgctttgctccatgccttgcatccattcctctgcccttgtgaagaataataagcagagatggacttcccattgaatatagtgttgcaggcatcacttggatgtcctcgatatcttcccaaagaaagaagaattttgttttgtggccaaaaagattagtgtagaacccaataattcttggagataaaaacaggcggccctgcaacagacacaagcgtcagctaccatgcaagttcacagacaaaaaaaaagatcttaatgtctaacttggttgtgcagtaatatggctatgtgacaaaatacaccagtctcgtaacagaaaggctactgtacactttggtgacctatcatcattaggctgaaacagtaatgggagatggattaaattgaatatattgtttaaataggggtacaagttgaattatttaaatttaaaagggatgcagaagctgaattatttttaatgcattcctttttacaacttagtaccgaatagtgggtgaaaagtgtgactaccttctgtagacttttatatttattattgaaaaagtaccaacagctgattgtttggttttacgatactctctccgtcccacaaaaaacctatctaggtggggatgggacaccacatagtccaaaatattcatagtcctaggtgatgtcccatccatacctaggttggttttttgtgggacggagggagtactgacttcactttttcagctgtcagcaaaggacagtgaaattttatgaaacaaatgaagccatccccccaataaagaagaaaactaaataaggataaaccaatacaagagtgttggacacctttgttagctctctgtgtcataattaaaagacagtttacctgtgtgagcattttgcgctttagatgacaggtaaaatcattgattagaaattcttctggtggcaaagaaaagatcttctggaatgctgagtttgtgtgtggagaccttacagcaatctgcatggtaaatttgcataagaaaagaggcaggccaagataggatgacacttcacctcactcaaaaatagagaagataagtgcattacctttttgccaacctctttctccattttgtctaggtagtccttcatgacttcagtaccccttgaattattcaagataattctcaaatgcaattttgactgacatgcttgagccagcttacccttgagaggaatccaaatgtcggaaagctcggatagattagatttcaagaaatttacttcagcatgaccaagagactcaacttcatcaaatggtccatcaaaatcgtagacatttattttcataacggatggaggatcttccatggcatcaaattcaaaaatttctgcaaattttgagaagatatgttgcaaaattatgaattgtaattttatatagcagcaattataacataagataataagccaaacttttaccattccaccgaggttccagagtgtgaaatttaattgaactagtcttcgtctttccattgcaggtaaatacaacatatggatcagagtaaccagatgatttggttgctgctaaattggtaccatcaatcagagcgacagtcagcaaccaaccattcccttgtgctttgactccatgatcacttcctatatactcccaaataccatgtaagcaaagtttagttcatatgtgcataaatcacgggagtatatatgtccagaacaagaatagaaggtttttctaaagaaaacagaaagtaacagtatgtccagactccacaataataattaataagcgaagattttgttgaggaaaacaaaaggcaacagtaacatttttccatatcagggaaagattatacaagcacctgtatagaacactaagtacatgtaacatgtgccgttgagtgccatgtactgtaggattatctactgaactttcattttcaatttccaccaaggaaaaataacagcagcagcaaaaggagaaatggacactacctctctgcctcttagcctggatgaatcgtgcaatcatatttaggacacgctgtccttgcagaacaagaactccacaaaccacgacttcaccaacagaatctggtaggtccaggccaggaaactcaagaccttgaattatactggggcttgcaaggatgatgtgtgaaaaaacataaatgaatgcaaccagtgaggatacaacagtaaaatttccaaatatacggaatgctagtttccaatcagattcttgctctggttgtactgaagacaaaactttatcagtagctgctgcatcttttgaatcaactggcctgatatttcgagccaggagttcagagaactgaatgtagttatccttcaacccttgtttagccccattttctatcatgcccttcatcattgtactctggataaaattcaagcgccaggagactacaagacgtgaggatttttcattatcaggtagttcaggccctggcattatgcatgttaaaacctccaccctaaaagaattcccaaatggaacatctggagtactaacatcagctaaagttgcatatatatctccatctgccttcagatatgacacatcctctgttgctttcacagccttgactagtgcagtaggagcttttgtgtagcttactaccctcttcaagacctcaccatcattttcaagtctccattgttggatttcaagaccagtagttccttgcatctccgctagtgattgcaagaaatctgaacttggtgagaaaagaagtccattcaagtcactgggtgcaacagcataaacttgatcaataagaactccacctgacaagttttcaggtatttcattcccttcatggcaagatccaaaggcttttagttgttcatcaaaggacatagttacaccagtttcataatcctggttatcaggaagttctgaactagttgatggtgtttcttcaagaatatctgaattaccatcgcccgtagtgagaggtggagctgaagctgaagcttctgcatcttttggtttcgctgagaaaaattgatacagacgattgacaaatgatgggacaccatttgatctatcctccttgatgatttctgtttcatcaccccctgatactgacgtgggtatttctataggaatatttggcaaagaagatcctttctgtaattcagttgatttgtcagaatatgacgcgaggtcatctgaaacgcaatgtgcaagtgtcgttgtctcttcagggtaatttagagagagagatattgtaagacgaatttctcctacagaagttgttgcctgttatcagtatataaattacttgcatgcataaataaaattggatataggcaaacaaaagtgggctttgttatggaaagagaaggactggagacttggatgaataaaaacaaatagaaaagcttgaacagcaaacaatagtgctagtatatcatccaggcgaaaacatatccatactagtacatcacaaccataactccaataaaaacggaattgtgtagatggcttaatttcttgtttgtcaataatgctattaattatttcaatggtttccaatgcgtataaaattattggaaacatacctacatgaaagtgttttcgtaccaaatatactaatggcttctttttgaataccaaatcttaacatctttgcctatatgagtggtttaagatttcgatgtttgattgcacacattaaacatcatctatttgagaagatggaatagtaaataaagacatggtaggagactattgccaagaaaaaagaacaataaggaaaaagaaagtgagaaactagtacagctactcatccaacactctataagtactccctccgttttatattacaagtcgcttcgactttatttcatagtcaaacatagtagtatttttcaacaaaaaaaaacaaacatattatcaaattatattcaatgttagatttaatgaaactaatttggtattttagatgttggcaagtttttctataaacttgatcgaaaattcaaactaaacaaagtttaactatgaaaacagtcaaagcgaaacggagggagtaacaaagctccacttcaaaggtaaaagcaacacattaccatcacgaggcaaaccatccaaaacagcacaagctggatgaatttgcaaaacagcagcataataccttttcatatcttgaaacaagggcaaattcaagaactcaagataacattagggggggggggggggggcatgaatttaccggaatccttgatcttggacttcttg

SEQ ID NO: 69064 - DNA, 7975 bp, Oryza sativa
atctcccaccaatagccaaaattttcccctgccatcatcctagttttttctcatttttttagtgggactccagtacacattgtgaattctcttcttatcaattgggattcccaaatatttcatgggaaaagcacccctttacaagttaaaatatgacagtatatctcttctttttcttgggcccctcctaaacaaaacacctcaattttattgaaatttaccttcaaacatgacatttgttcaaagagacacaagatatacttcaagttttttttgcatactccaggttatcctccagcataaagatagtgtcatcagcatactgcaaaatcactatctcatcctctgtatattccagccctagccctttaaccatcccctgttccactgctctattcattaaaagaggtagagcatcagctgtaatatcaaaaagtagtggagacaaagagtctcctttctcaaacctttataggtttggaaaaaaatcccatatctcatcatttaccttaactgccactttaccctcttcaacacatctcatgatccaatcacaccaaacactagggaagccttttgcttccagcatctaacatagaaatggccattttattttatcataggccttcccgaagtccaccttaaacagaactcctgattgttttttcatatgaacactatttaaaacttcatgcattatcacgactccctccatgatgtttctttctttaagaaaagcagtttgtgctttctcaattaagtcagctatgacataggttagcctcttcatcagggttcttgttatgattttgaaactaacattaaggagacatattggcctaaacttctgaatttatgctgcatttttgcatttaggaattaaggatataaccccatattttagtcttttgatatccaaaatcccctgatgaaaatcatcaaccataacttttagatcattttttatcaccttgcaaaagtgtttattaaaatcagcaggaaaaccatcaggcccaggtgccttgttacttccatttcaaacacaaccttcttcacctcttatagagtaaagggtttcaacaattccttcttttgatcttcagacaattgtcccatctcaaaattttgtaatcttatattagatctttcaggtggcccaaacagatctttataaaaatctgttataaaactcaacatctgctcttgcccatcaatcaacacattctcctgttgcaaagaaaaaaaatcatatcttacctccttctcccattagccttggcatgatagtacttagtgctattatcaccctctaacacatctctctcctttcacctttgtaaccattttagcctctcctcctcatagtaaaccttagttgatcctccaatctccctctctcttctctgctcctcacacatacaccatgattctcacaccatttgttaactttctaactcgctcactaatttctctttttctctcttataatttccttcctaattcatatttgaacccttaagagctttccttcaatctctaagttttctttgccattttttctatatttgagatatcctctttattattcccctaggcttttctcaccacatcatctacatcttctctcaacatccaactattttcaaacttaaaaattgattttttttaataactgatatgtatccaacagaataggagcatgatcagaataaatcctcttcagactttctactattataatggatacttcccctcccagcttttagagagtcacctgattattacaccatgtgaacttcctaccacacatactcaactcccacaaattactttgattaataattgcattaaacagaaaattgtatttattataacatcacttcttatttttatcactttcttttttaattatgttaaagtcaccacaatagcattggatgagactattctgacaaaccaaatttctgctataaactcctctaatgttccaaaaagacatttaattttcttttcttatatttattttacttccataccctttattcacttttggggttaacttaattttaaggggctccttttaatttttttttcattacccaaatctctaggtctaaatttgactttataggatcttagataaattaaaattagaattctccttatcagagctgttaacactaattaacccattatcatctacctcatgtggagcatcctccactttattttccacttccttattaacaaattaatcctagccactttaagatccctaaacaaattagcaagaaggaattggagatacttttgtttatgaaagcattcctgatatcggctgttgactagaacctgcaactgtgagagaaataagatacaatttaatcacaaattcagttacaaaaatagtgcgatttttgaaataacacgaaaatacaattacactcacaagtgtctacgaaaatacaattacactcaccagtgtctcgtaacagcacaagatacaatttaatcacaaatgcagttacagaaatagtgcgattttcgaaataacacaaaaatacaattacactcacaagtgtctacaaaaatataattacactcaccagtgtctcgtaatacaaaaatataattacactcaccagtgtctcgtaacagcataagatacaatttaatcacaaattcaattacaaaaatagtgtgattgttaaaataacacgaaaatacaattacacttacctgtgtctcgtaacaacatatcactaacagggcaaggacgtcggctgggacaacagcgagagcaagggtgaattgggagacgcttccagcagcaactgaaggaagacatgtagagtgtataatatgctgaactgttgtcgcttaggcataatctgtggaagacatctgtgacaccctgcgtagacagggtgatagatgcttttgcccttcctatcgtgcttttgttcatcccggcttccaagtcacggtacactactcaaatcaaatctgcaaccgagccttgcgggccctaaatcacaaatggaaagggtcagtttgtgtgcaatggcgtataaatattacatttacatgtagttttctttttgaggaagaagctccattttttcaggaagaagctctatcttgttatttggcggcttgcaatataagctctcgcagcatgcgggtcagcatgggagtagtggttgtatgaattctagtacactcatttctgagatggtttgccatgtacttaatagaagagcattaaaagaaactgcagaccagacaccaaaagcctactctcgacttcgcttcactataaatatgaattgtgaagggccagagaagcttcccttggattagtgttcttcggcaaccgtcatatctattatgcatgaagaacaatcacaaatgactatacataacataacaaacaaggagattattaggggagagctacaaatcggatgtccgatgatgtaaaaaaatcggacggtcaaatgtttcagttgactattggtgcaacattaagttatacatggtgaaacaaaaaaatcagtctctgaaacatatagaaattttgtgaaacacaatgagaatacatggtgaaacatattgctatcacgtatgaaacaataagtttttattgtttgaaacatatgtttttctttcatcagaatataatcatgtgatatcttgttgtaaacatttaattataacgaattcaacagtgtgatcgaatcgttcatcggataaatagtttagaagaaaaatatttttaagatcactaatatatgcaagcatccatggtgtgggagggagccaatagaatggaatggcaggagagagaaggggcaaaagcgtctcataattttttggtcattagtgaaacattgagttatacatggtcaaacacaaattcaattattgaaacatttaaacttttttatgaaacataatgaaaacacatgttgaaacatattgctaacacgtctgaaacattaaatttaacggattgaaacatatgttttctttcatcagaatataatgatgtgatatgttattgtaaagatttaattataacaaatataatggtgtgttcatatcatagattagataagtagttcagaagaaaaaatattttgaaaatcattaaagcatgtatggatgtgtggagtggacagggagatagtagtttgcttgtccgatttttctcgttacgtcagacgtatgatgctaagcattttccagaaaaaaaaacatgtatcctatcttcctatatatataaagttgtatctaatcatttaaaactttgattttattaaaaataacaaatctcatggcaatgtgtgtggtgccaactagtaattaggctgggttcgttccgtggggttgggatctaatcctcaagcacacaaaacggagcaacacattagcacatgattaataaagtattagctattttttaaatatgatttttaatgcaactttcgtatagaaattttttgtaaaaaatacatcgtttattagtttgaaaatcatgcgcacggaaaagaaggaggtgagttgggaaggctaggaaacgaaattgatttcctttagaatacagggaagtaggtaaatgctgatgagaacattaggactcctcataacaagttcatctagtaacttgctgaaaacaattaaatgaatgttaaaaaaaacgatgagtttttttgacaattttattacaaagatagcacagcagcagtcatatgtcacggttaagaagcctcttaaaatcagcacattcaatatttatcaactcttgatttgaataggtggattcaatactcttcagggaagctatatggttataaaacatagcactcactttctctagccgatcattcaaaataagatgacaacactttacttttcggcagtgcaagagcaaaagaggatgttttatgcatcacctcctgccactgtgttgccaaggaaccctgccaatcgtagttaatgatgtattcatggatccacatcatcaattgtaaaccccatagaaaaataatttcagatatataggttagattatatatactagtagaattgtcccaaattttgaactcttatatcgggcattctgcattcccaatttccctagactctacccagtatttcgcatttctaatttccctagactctttacagtgccatccgcctacgcgtcacagtccccgaagatgacggatataagtatactattatgcttaatatttataagaaaatgaaatttttatgtgactttcaccaagcaatttggggtataggatactgttcctaacatgtaaggttatatggcatatttgatcctagctgtgtagggtgacatgaaagattaactatttctggcaaataattataaatgcattatgattagttataaatgaatcatgtaatatttatctcatagtgattgttattcatcaaaatatgggcctagacaaccgccgtcaccaccactagatgtagaaactgatgatgtatctgttatcgttggtgaaaacaagagttacgaaagtgacaacaattagtgtgtgatgtaagtctgtattttcctaaatgactatttctataatgtatataaagttgtgttttaattcattttctagaacaaaggtactcatattaataaatagatacaaatattaatatttttatttttattgttatttacttcctccgttctatattaaaacattttagttttgtcgtaagttagatttatttaacgtcgaatgagtttagagaaagatggattgatatttgcaatgacgaataaatgtatatattatatatacttattactaattttaagttatataacataacataaggtatatgcatttgtacatagtaaaagacacaattgacttgaatagtatttataatgcactatgatcattagattcataacaaatgttacttttaaatttatccatataagttatatatatatatatatatatatatatatatatatatatatgtttattggtattatctaatattatctatatatattattaattgagagaattctagattatgttttaaaaaaatgtctctcaaattatagcaactagttaaataacttggatgcatcaaaatctctctcaaattctaaaatttgactgacgaggcatcgaaaacaaatctttgttctcaaccttaaagtttactaccttcgtcccacaaagaatgcaatcataacatttgagataataattttgttagatggatagagtggatccaattaacctaaagaagtattttcaacaccctggtataggtatatgcatgttttatacattgttaaataaaatatgaaaaattacatgttgtatacattgttaaataaaatatgaaaaatttggctagatatattatgataataatacattaccatacaagcaggcaactacaattgacaattgaagaaaattaaaataataaattttgtctgcacttatttttgtttcttaaagaacaaatcacttaatcatacatgttgatatatgcacttgagcacttctaacatcacaatcaatctaatcttttttttctatttggatgacatacaaataacggagattgcacctgtagacagtaatatgtccctgttagtgatcccgatgatggccgtggagcagggtggaatggattctaatcccgggtttggagtttggactataattactccctccgttttttaagagatgacgccgttgactttttctcacatgtttgaccattcgtcttattgaaaaaatttatgtaattataatttattttgttatgagttgttttatcactcatagttctttaagtgtgatttatatcttatacatttgcataaaatttttgaataagacgaatggacaaacatgtgagaaaaagtcaacggcgtcatctgttaaaagcgggggtagtatcagactaggaaattgcgggaacaaattaactgcgtatgaaatattggaaatttgatcacaccgtaccatactggagtaccacgttgccattgatcaccgtactaccagatgtacattattaggaataacgagcagctaattacacaagacgccgccccgccggcgagcactaggagctaggatgagccggcgcagtcggcgccggcgaaggtgaccgtgccggcgtcgaggtcgtagccgacgtggatgttctgctgcgcgaggttcccgaggatggacaccggctgctgctccgtcgtcgccacgattgccaggcacagcgtcccctcctgcaccgccacgaacgcgttctccggcttcagcgccaccgccgcgccgccgccgaactccagcgtcaagtccgggatgctctcgccggcctccacctcccgcccggcaacgttgtagcacagctgcagcagcccgtccggcgactgcaccggcggcagcgtgatccggcgggagagctcgtcgacgatcggccccagcagcgacgggtcgaggaacgtcagcgtcgtgccggagtccacgatgatgcgggagctcgccgccgacgccaccgtcttgttcccgaccttgacggagtcgaggaccacggtgtagtacgtgtccacgtcgccggcgacgagcggcgtgctcgccgcgccgggctcggtgacgtcggcgagggcgccgaagttgagcgccgacgaggcgttgacggagtgcgggacgaggcagtaggagaatctccgcccgagcgacgtcgcgccgccgagctgcgtcacgagggagaccgcgccgccgccgaggccgaccagaccgtcggccgggaacgagccggccgtcgcggtggagcagccgaacttgacgccgccgacgcgcacctggcgggggctctccccgagccgccgtcgtcgaaggtgaaggtttcggtggagaggacgccggtggtgttcgacccgtcgccgtaggcgtag
